(12) United States Patent
Fraser et al.

(10) Patent No.: US 7,612,192 B2
(45) Date of Patent: Nov. 3, 2009

(54) NEISSERIA GENOMIC SEQUENCES AND METHODS OF THEIR USE

(75) Inventors: Claire Marie Fraser, Potomac, MD (US); Erin Kathleen Hickey, Palatine, IL (US); Jeremy D. Peterson, Arlington, VA (US); Herve Tettelin, Gaithersburg, MD (US); Craig Ventor, Potomac, MD (US); Vega Masignani, Siena (IT); Cesira Galeotti, Staggia-Pegginonsi (IT); Marirosa Mora, Siena (IT); Giulio Ratti, Siena (IT); Maria Scarselli, Siena (IT); Vincenzo Scarlato, Colle di Valdelsa (IT); Rino Rappuoli, Bernadenza (IT); Mariagrazia Pizza, Siena (IT); Guido Grandi, Segrate (IT)

(73) Assignees: Novartis Vaccines & Diagnostics, Inc., Emeryville, CA (US); J. Craig Venter Institute, Rockville, MD (US)

( * ) Notice: Subject to any disclaimer, the term of this patent is extended or adjusted under 35 U.S.C. 154(b) by 18 days.

(21) Appl. No.: 10/915,740

(22) Filed: Aug. 11, 2004

(65) Prior Publication Data

US 2005/0191316 A1    Sep. 1, 2005

Related U.S. Application Data

(63) Continuation of application No. 09/806,866, filed on Sep. 6, 2001, now abandoned.

(51) Int. Cl.
*C12N 15/31*    (2006.01)
*C12N 15/11*    (2006.01)

(52) U.S. Cl. ..................................... 536/23.7; 536/23.1
(58) Field of Classification Search ........................ None
See application file for complete search history.

(56) References Cited

FOREIGN PATENT DOCUMENTS

EP    0 467 714 A    1/1992
EP    0 474 313 A2 *    3/1992
WO    WO 98/17805    4/1998

OTHER PUBLICATIONS

Tettelin, Herve, et al., Complete Genome Sequence of *Neisseria meningitidis* Serogroup B Strain MC58:, Science, vol. 287, Mar. 10, 2000, pp. 1809-1815.
Pizza, Mariagrazia, et al., "Identification of Vaccine Candidates Against Serogroup B *Meningococcus* by Whole-Geonome Sequencing", Science, vol. 287 Mar. 10, 2000, pp. 1816-1820.
Parkhill, J., et al., "Complete DNA Sequence of a Serogroup A Strain of *Neisseria meningitidis* Z2491", Nature, 404, Mar. 2000, pp. 502-506.
Murakami, Kazuhisa, et al., "Cloning and Characterization of the Structural Gene for the Class 2 Protein of *Neisseria meningitidis*", Infection And Immunity, Aug. 1989, pp. 2318-2323.
Kathariou, S., et al. "Transposition of Tn916 to Different Sites in the Chromosome of *Neisseria meningitidis*: A Genetic Tool for *Meningococcal* Mutagenesis", Molecular Microbiology, vol. 4(5), 1990, pp. 729-735.
Ulloa-Aguiree, A., et al., "Structure-Activity Relationships of G Protein-Coupled Receptors", Arcives of Medical Research, 30, 1999, pp. 420-435.
Maiden, M.C.J., et al. "Comparison of the Class 1 Outer Membrane Proteins of Eight Serological Reference Strains of *Neisseria meningitidis*", Molecular Microbiology Vo. 5(3), 1991, pp. 727-736.
McAilister, Carl F., "Analysis in *Neisseria meningitidis* and other *Neisseria* Species of Genes Homologous to the FKBP Immunophilin Family", Molecular Microbiology Vo. 10(1), 1993, pp. 13-23.
Van Der Ley, Peter, et al., "Topology of Outer Membrane Porins in Pathogenic *Neisseria* Spp.", Infection and Immunity, Sep. 1991, pp. 2963-2971.
Rokbi, B., et al., "Variable Sequences in a Mosaic-Like Domain of *Meningococcal* tbp2 Encode Immunoreactive Epitopes", FEMS Microbiology Letters vol. 132, 1995, pp. 277-283.

* cited by examiner

*Primary Examiner*—James Martinell
(74) *Attorney, Agent, or Firm*—Morrison & Foerster LLP

(57) ABSTRACT

The invention provides methods of obtaining immunogenic proteins from genomic sequences including *Neisseria*, including the amino acid sequences and the corresponding nucleotide sequences, as well as the genomic sequence of *Neisseria meningitidis* B. The proteins so obtained are useful antigens for vaccines, immunogenic compositions, and/or diagnostics.

4 Claims, 18 Drawing Sheets

FIG. 1A
919 (46 kDa)
PURIFICATION
M1   919
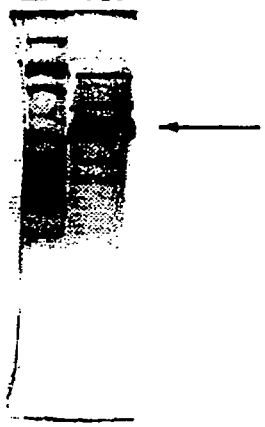
FIG. 1B
919 (46 kDa)
WESTERN BLOT
OMV   TP   PP
FIG. 1C
919 (46 kDa)
FACS
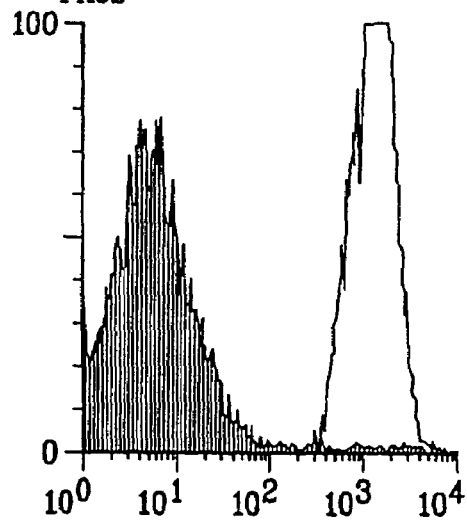
FIG. 1D
919 (46 kDa)
BACTERICIDAL ASSAY
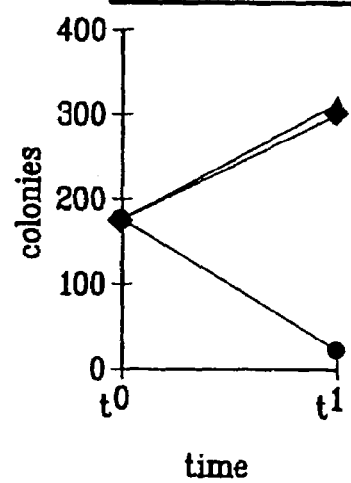
FIG. 1E
919 (46 kDa)
ELISA assay: positive

FIG. 2A
279 (10.5 kDa)
PURIFICATION
M1 279
FIG. 2B
279 (10.5 kDa)
WESTERN BLOT
TP OMV
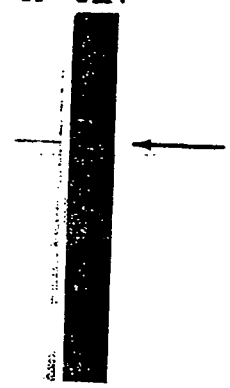
FIG. 2C
279 (10.5 kDa)
FACS
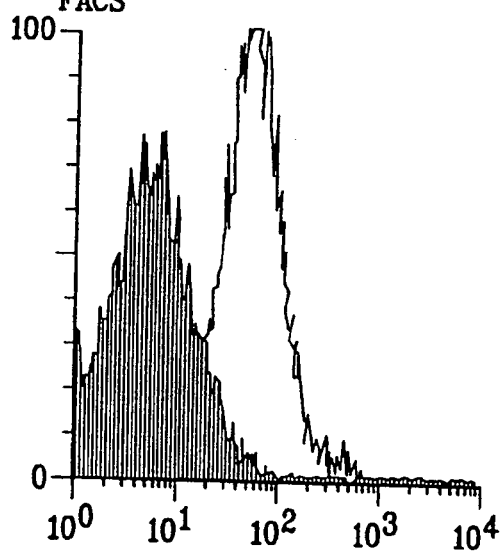
FIG. 2D
279 (10.5 kDa)
BACTERICIDAL ASSAY
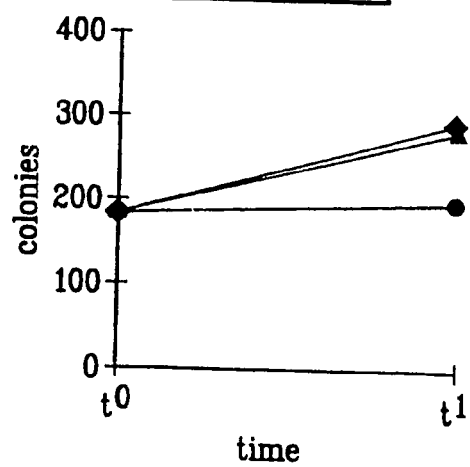
FIG. 2E
279 (10.5 kDa)
ELISA assay: <u>positive</u>

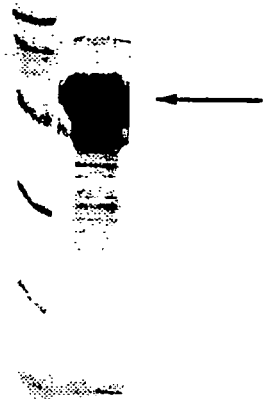
FIG. 3A
576 (27.8 kDa)
PURIFICATION
M1  576
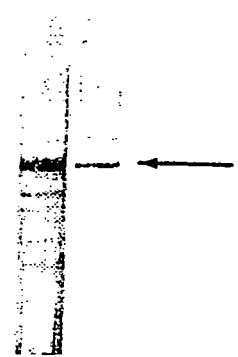
FIG. 3B
576 (27.8 kDa)
WESTERN BLOT
TP OMV
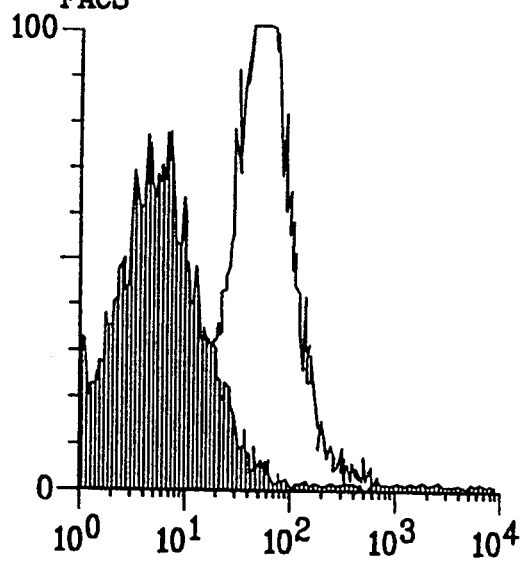
FIG. 3C
576 (27.8 kDa)
FACS
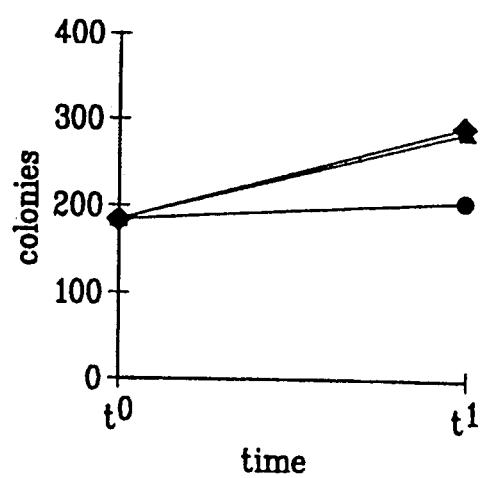
FIG. 3D
576 (27.8 kDa)
BACTERICIDAL ASSAY
- preimmune
- GST
- 576
FIG. 3E
576 (27.8 kDa)
ELISA assay: positive

FIG. 4A
519 (33 kDa)
PURIFICATION
M1  519
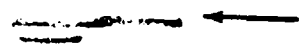
FIG. 4B
519 (33 kDa)
WESTERN BLOT
TP   OMV
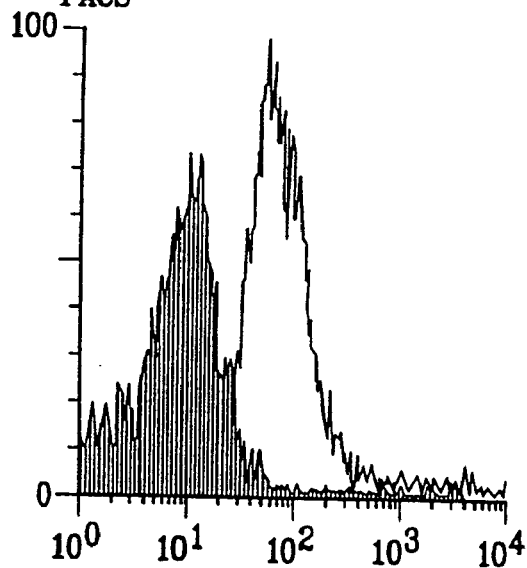
FIG. 4C
519 (33 kDa)
FACS
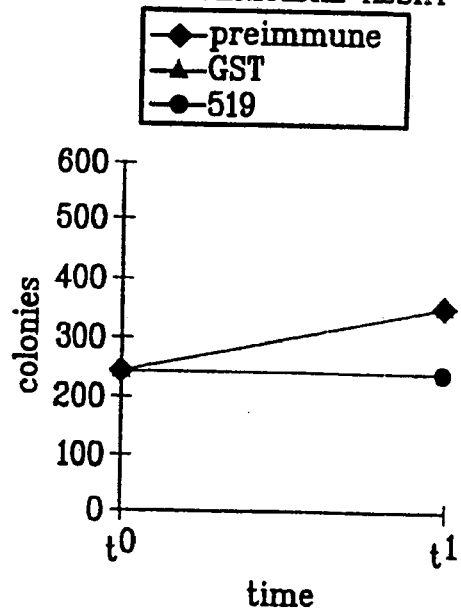
FIG. 4D
519 (33 kDa)
BACTERICIDAL ASSAY
- preimmune
- GST
- 519
FIG. 4E
519 (33 kDa)
ELISA assay: positive

FIG. 5A
121 (40 kDa)
PURIFICATION
M1 121
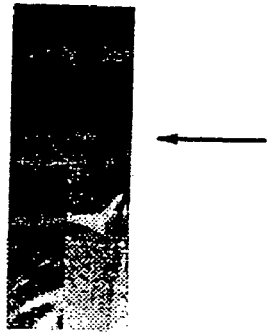
FIG. 5B
121 (40 kDa)
WESTERN BLOT
TP OMV
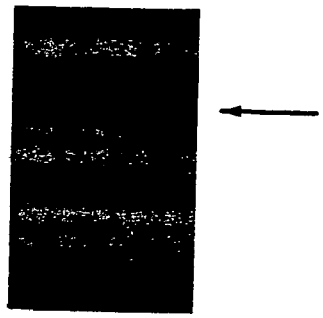
FIG. 5C
121 (40 kDa)
FACS
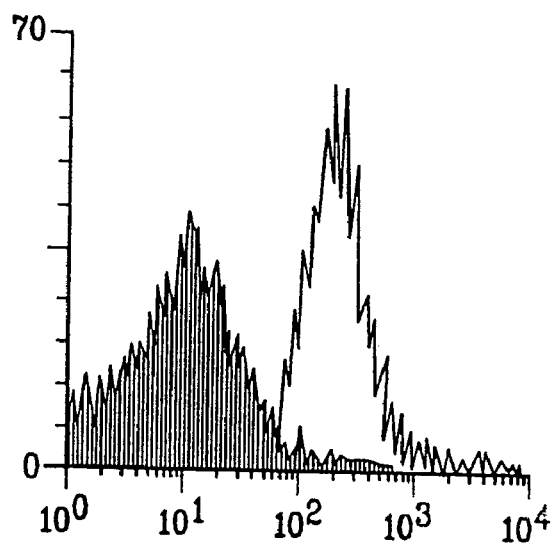
FIG. 5D
121 (40 kDa)
BACTERICIDAL ASSAY
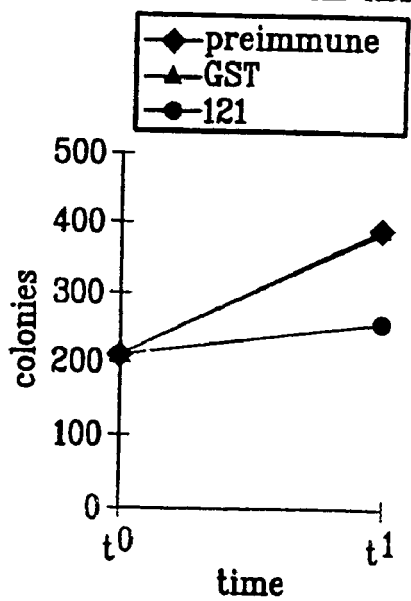
FIG. 5E
121 (40 kDa)
ELISA assay: positive

FIG. 6A
128 (101 kDa)
PURIFICATION
M1   128
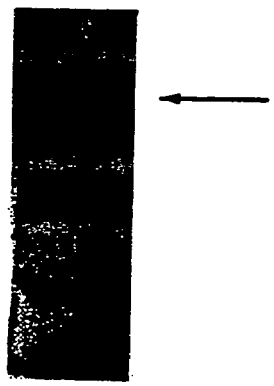
FIG. 6B
128 (101 kDa)
WESTERN BLOT
TP   OMV
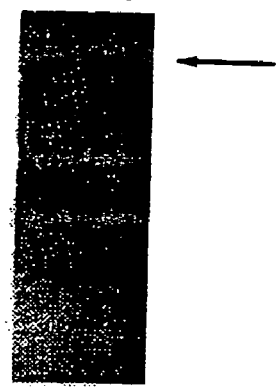
FIG. 6C
128 (101 kDa)
FACS
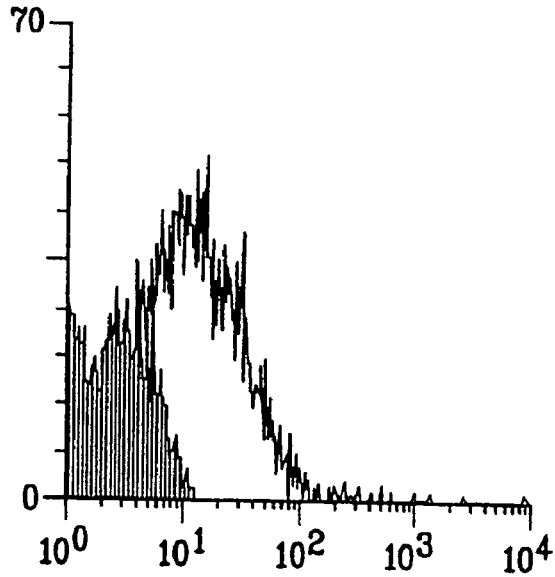
FIG. 6D
128 (101 kDa)
BACTERICIDAL ASSAY
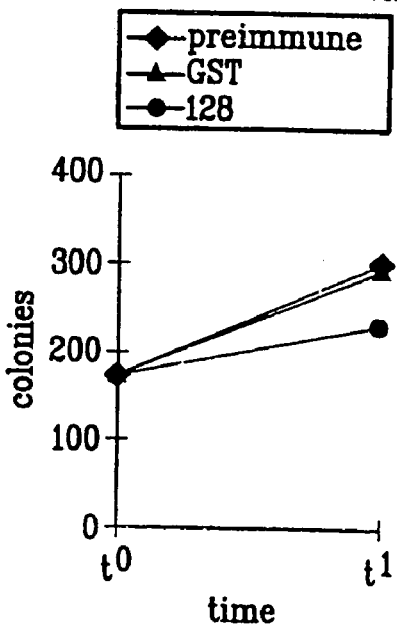
FIG. 6E
128 (101 kDa)
ELISA assay: positive

FIG. 7A
206 (17 kDa)
PURIFICATION
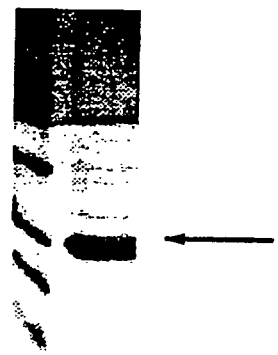
FIG. 7B
206 (17 kDa)
WESTERN BLOT
FIG. 7C
206 (17 kDa)
FACS
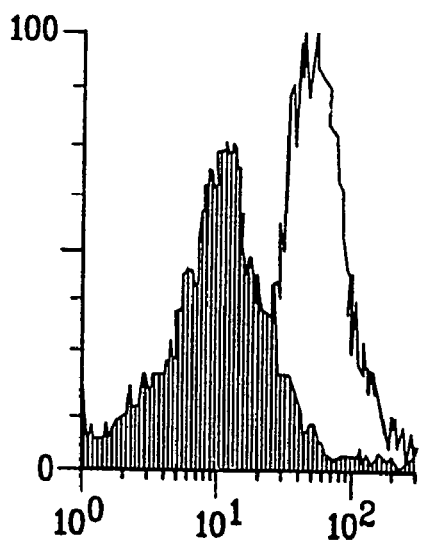
FIG. 7D
206 (17 kDa)
BACTERICIDAL ASSAY
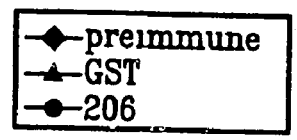
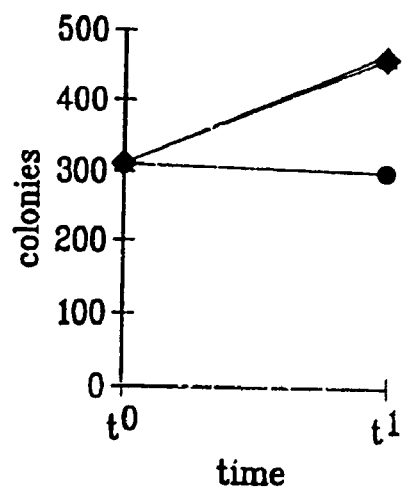
FIG. 7E
206 (17 kDa)
ELISA assay: positive

FIG. 8A
287 (78 kDa)
PURIFICATION
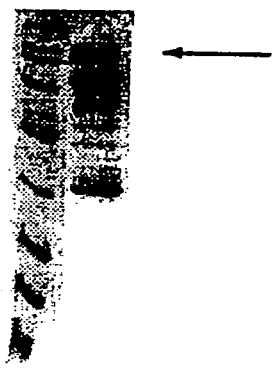
FIG. 8B
287 (78 kDa)
FACS
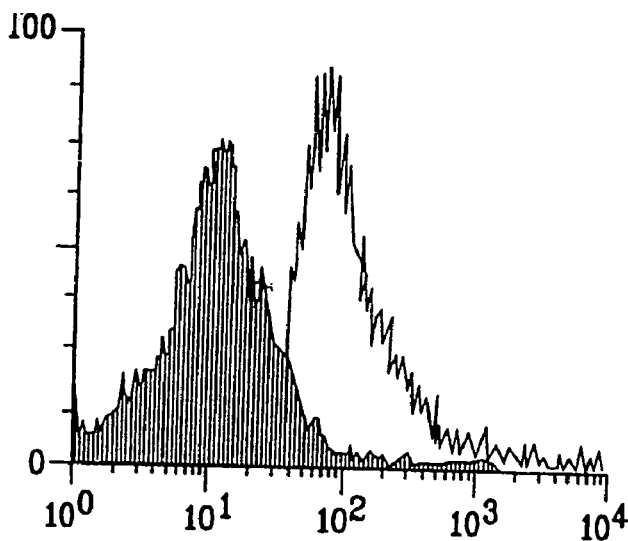
FIG. 8C
287 (78 kDa)
BACTERICIDAL ASSAY
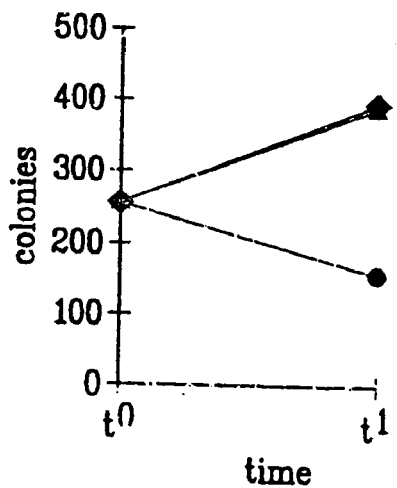
FIG. 8D
287 (78 kDa)
ELISA assay: positive

FIG. 9A
406 (33 kDa)
PURIFICATION
M1  406
FIG. 9B
406 (33 kDa)
WESTERN BLOT
TP  OMV
FIG. 9C
406 (33 kDa)
FACS
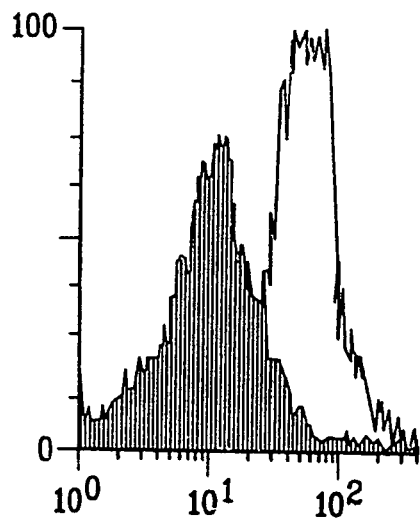
FIG. 9D
406 (33 kDa)
BACTERICIDAL ASSAY
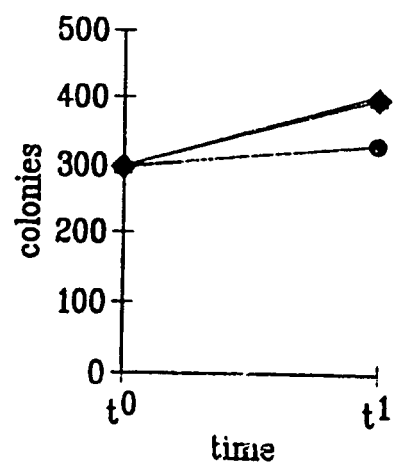
FIG. 9E
406 (33 kDa)
ELISA assay: positive 576-1
Hydrophilicity Plot, Antigenic Index and AMPHI Regions 519-1
Hydrophilicity Plot, Antigenic Index and AMPHI Regions

128-1
Hydrophilicity Plot, Antigenic Index and AMPHI Regions

406
Hydrophilicity Plot, Antigenic Index and AMPHI Regions

NEISSERIA GENOMIC SEQUENCES AND METHODS OF THEIR USE

CROSS REFERENCE TO RELATED APPLICATIONS

This application is a continuation of U.S. application Ser. No. 09/806,866 filed Sep. 6, 2001, which is a National Stage application of co-pending PCT application PCT/US99/23573 filed Oct. 8, 1999, which was published in English under PCT Article 21(2) on Apr. 20, 2000, which claims the benefit of U.S. provisional application Ser. No. 60/103,794 filed Oct. 9, 1998 and Ser. No. 60/132,068 filed Apr. 30, 1999. These applications are incorporated herein by reference in their entireties.

This invention relates to methods of obtaining antigens and immunogens, the antigens and immunogens so obtained, and nucleic acids from the bacterial species: *Neisseria meningitidis*. In particular, it relates to genomic sequences from the bacterium; more particularly its "B" serogroup.

BACKGROUND

*Neisseria meningitidis* is a non-motile, gram negative *diplococcus* human pathogen. It colonizes the pharynx, causing meningitis and, occasionally, septicaemia in the absence of meningitis. It is closely related to *N. gonorrhoea*, although one feature that clearly differentiates meningococcus from gonococcus is the presence of a polysaccharide capsule that is present in all pathogenic meningococci.

*N. meningitidis* causes both endemic and epidemic disease. In the United States the attack rate is 0.6-1 per 100,000 persons per year, and it can be much greater during outbreaks. (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) Bacterial Meningitis in the United States in 1995. *N Engl J Med* 337(14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae*, *N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants (e.g., Morbidity and Mortality weekly report, Vol. 46, No. RR-5 (1997)). This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger W D "New and Improved Vaccines Against Meningococcal Disease". In: *New Generation Vaccines*, supra, pp. 469-488; Lieberman et al (1996) supra; Costantino et al (1992) Development and phase I clinical testing of a conjugate vaccine against meningococcus A (mena) and C (menC) (*Vaccine* 10:691-698)).

Meningococcus B (MenB) remains a problem, however. This serotype currently is responsible for approximately 50% of total meningitis in the United States, Europe, and South America The polysaccharide approach cannot be used because the MenB capsular polysaccharide is a polymer of α(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to MenB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (e.g., Poolman JT (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (e.g., Ala'Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonococcal genes and proteins (e.g., EP-A-0467714, WO96/29412), but this is by no means complete. The provision of further sequences could provide an opportunity to identify secreted or surface-exposed proteins that are presumed targets for the immune system and which are not antigenically variable or at least are more antigenically conserved than other and more variable regions. Thus, those antigenic sequences that are more highly conserved are preferred sequences. Those sequences specific to *Neisseria meningitidis* or *Neisseria gonorrhoeae* that are more highly conserved are further preferred sequences. For instance, some of the identified proteins could be components of efficacious vaccines against meningococcus B, some could be components of vaccines against all meningococcal serotypes, and others could be components of vaccines against all pathogenic *Neisseriae*. The identification of sequences from the bacterium will also facilitate the production of biological probes, particularly organism-specific probes.

It is thus an object of the invention is to provide Neisserial DNA sequences which (1) encode proteins predicted and/or shown to be antigenic or immunogenic, (2) can be used as probes or amplification primers, and (3) can be analyzed by bioinformatics.

BRIEF DESCRIPTION OF THE DRAWINGS

FIG. 1 illustrates the products of (A) protein expression and purification, (B) western blot, (C) FACs analysis, (D) bacteriacidal assay, and (E) ELISA assay of the predicted ORF 919 as cloned and expressed in E. coli.

FIG. 2 illustrates the products of (A) protein expression and purification, (B) western blot, (C) FACs analysis, (D) bacteriacidal assay, and (E) ELISA assay of the predicted ORF 279 as cloned and expressed in E. coli.

FIG. 3 illustrates the products of (A) protein expression and purification, (B) western blot, (C) FACs analysis, (D) bacteriacidal assay, and (E) ELISA assay of the predicted ORF 576-1 as cloned and expressed in E. coli.

FIG. 4 illustrates the products of (A) protein expression and purification, (B) western blot, (C) FACs analysis, (D) bacteriacidal assay, and (E) ELISA assay of the predicted ORF 519-1 as cloned and expressed in E. coli.

FIG. 5 illustrates the products of (A) protein expression and purification, (B) western blot, (C) FACs analysis, (D) bacteriacidal assay, and (E) ELISA assay of the predicted ORF 121-1 as cloned and expressed in E. coli.

FIG. 6 illustrates the products of (A) protein expression and purification, (B) western blot, (C) FACs analysis, (D) bacteriacidal assay, and (E) ELISA assay of the predicted ORF 128-1 as cloned and expressed in E. coli.

FIG. 7 illustrates the products of (A) protein expression and purification, (B) western blot, (C) FACs analysis, (D) bacteriacidal assay, and (E) ELISA assay of the predicted ORF 206 as cloned and expressed in E. coli.

FIG. 8 illustrates the products of (A) protein expression and purification, (B) FACs analysis, (C) bacteriacidal assay, (D) ELISA assay of the predicted ORF 287 as cloned and expressed in E. coli.

FIG. 9 illustrates the products of (A) protein expression and purification, (B) western blot, (C) FACs analysis, (D) bacteriacidal assay, and (E) ELISA assay of the predicted ORF 406 as cloned and expressed in E. coli.

THE INVENTION

Figure 10:
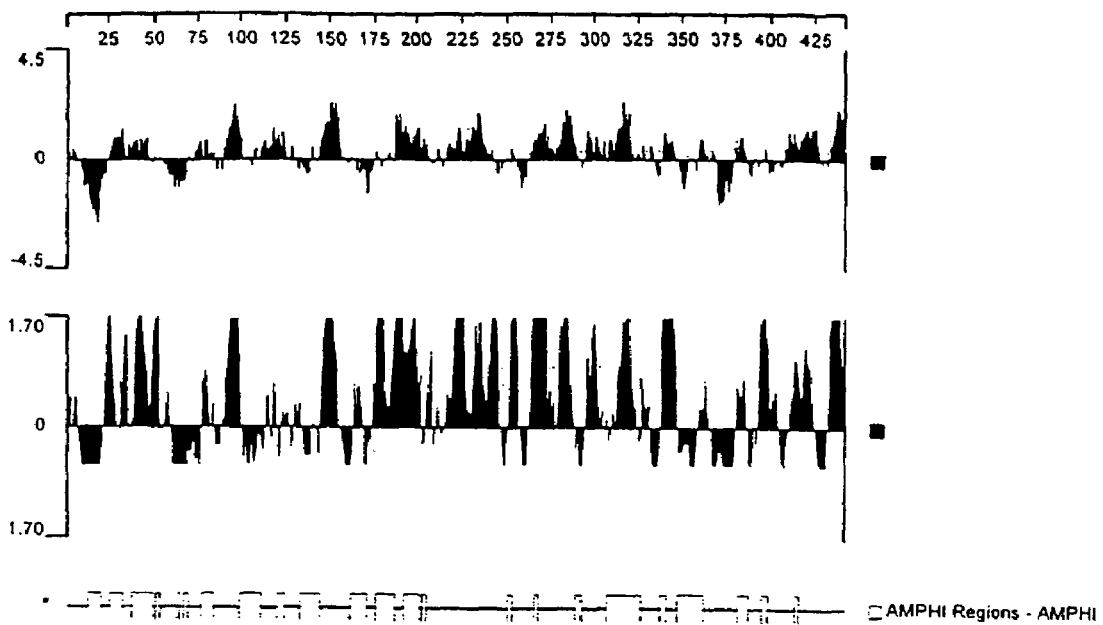
FIG. 10 illustrates the hydrophilicity plot, antigenic index and AMPHI regions of the products of protein expression the predicted ORF 919 as cloned and expressed in E. coli.

The invention is based on the 961 nucleotide sequences from the genome of N. meningitidis shown as SEQ ID NOs: 1-961 of Appendix C, and the full length genome of N. meningitidis shown as SEQ ID NO. 1068 in Appendix D. The 961 sequences in Appendix C represent substantially the whole genome of serotype B of N. meningitidis (>99.98%). There is partial overlap between some of the 961 contiguous sequences ("contigs") shown in the sequences in Appendix C, which overlap was used to construct the single full length sequence shown in SEQ ID NO. 1068 in Appendix D, using the TIGR Assembler [G. S. Sutton et al., *TIGR Assembler: A New Tool for Assembling Large Shotgun Sequencing Projects*, Genome Science and Technology, 1:9-19 (1995)]. Some of the nucleotides in the contigs had been previously released. (See ftp:11ftp.tigr.org/pub/data/n_meningitidis on the world-wide web or "WWW"). The coordinates of the 2508 released sequences in the present contigs are presented in Appendix A. These data include the contig number (or i.d.) as presented in the first column; the name of the sequence as found on WWW is in the second column; with the coordinates of the contigs in the third and fourth columns, respectively. The sequences of certain MenB ORFs presented in Appendix B feature in International Patent Application filed by Chiron SpA on Oct. 9, 1998 (PCT/IB98/01665) and Jan. 14, 1999 (PCT/IB99/00103) respectively.

In a first aspect, the invention provides nucleic acid including one or more of the N. meningitidis nucleotide sequences shown in SEQ ID NOs:1-961 and 1068 in Appendices C and E. It also provides nucleic acid comprising sequences having sequence identity to the nucleotide sequence disclosed herein. Depending on the particular sequence, the degree of sequence identity is preferably greater than 50% (e.g., 60%, 70%, 80%, 90%, 95%, 99% or more). These sequences include, for instance, mutants and allelic variants. The degree of sequence identity cited herein is determined across the length of the sequence determined by the Smith-Waterman homology search algorithm as implemented in MPSRCH program (Oxford Molecular) using an affine gap search with the following parameters: gap open penalty 12, gap extension penalty 1.

The invention also provides nucleic acid including a fragment of one or more of the nucleotide sequences set out herein. The fragment should comprise at least n consecutive nucleotides from the sequences and, depending on the particular sequence, n is 10 or more (e.g., 11, 12, 13, 14, 15, 16, 17, 18, 19, 20, 21, 22, 23, 24, 25, 30, 35, 40, 45, 50, 60, 75, 100 or more). Preferably, the fragment is unique to the genome of N. meningitidis, that is to say it is not present in the genome of another organism. More preferably, the fragment is unique to the genome of strain B of N. meningitidis. The invention also provides nucleic acid that hybridizes to those provided herein. Conditions for hybridizing are disclosed herein.

The invention also provides nucleic acid including sequences complementary to those described above (e.g., for antisense, for probes, or for amplification primers).

Nucleic acid according to the invention can, of course, be prepared in many ways (e.g., by chemical synthesis, from DNA libraries, from the organism itself, etc.) and can take various forms (e.g., single-stranded, double-stranded, vectors, probes, primers, etc.). The term "nucleic acid" includes DNA and RNA, and also their analogs, such as those containing modified backbones, and also peptide nucleic acid (PNA) etc.

It will be appreciated that, as SEQ ED NOs:1-961 represent the substantially complete genome of the organism, with partial overlap, references to SEQ ID NOs:1-961 include within their scope references to the complete genomic sequence, e.g., where two SEQ ID NOs overlap, the invention encompasses the single sequence which is formed by assembling the two overlapping sequences. Thus, for instance, a nucleotide sequence which bridges two SEQ ID NOs but is not present in its entirety in either SEQ ID NO is still within the scope of the invention. Additionally, such a sequence will be present in its entirety in the single full length sequence of SEQ ID NO. 1068.

The invention also provides vectors including nucleotide sequences of the invention (e.g., expression vectors, sequencing vectors, cloning vectors, etc.) and host cells transformed with such vectors.

According to a further aspect, the invention provides a protein including an amino acid sequence encoded within a N. meningitidis nucleotide sequence set out herein. It also provides proteins comprising sequences having sequence identity to those proteins. Depending on the particular sequence, the degree of sequence identity is preferably greater than 50% (e.g., 60%, 70%, 80%, 90%, 95%, 99% or more). Sequence identity is determined as above disclosed. These homologous proteins include mutants and allelic variants, encoded within the *N. meningitidis* nucleotide sequence set out herein.

The invention further provides proteins including fragments of an amino acid sequence encoded within a *N. meningitidis* nucleotide sequence set out in the sequence listing. The fragments should comprise at least n consecutive amino acids from the sequences and, depending on the particular sequence, n is 7 or more (e.g., 8, 10, 12, 14, 16, 18, 20 or more). Preferably the fragments comprise an epitope from the sequence.

The proteins of the invention can, of course, be prepared by various means (e.g., recombinant expression, purification from cell culture, chemical synthesis, etc.) and in various forms (e.g. native, fusions etc.). They are preferably prepared in substantially isolated form (i.e., substantially free from other *N. meningitidis* host cell proteins).

Various tests can be used to assess the in vivo immunogenicity of the proteins of the invention. For example, the proteins can be expressed recombinantly or chemically synthesized and used to screen patient sera by immunoblot. A positive reaction between the protein and patient serum indicates that the patient has previously mounted an immune response to the protein in question; i.e., the protein is an immunogen. This method can also be used to identify immunodominant proteins.

The invention also provides nucleic acid encoding a protein of the invention.

In a further aspect, the invention provides a computer, a computer memory, a computer storage medium (e.g., floppy disk, fixed disk, CAROM, etc.), and/or a computer database containing the nucleotide sequence of nucleic acid according to the invention. Preferably, it contains one or more of the *M. meningitidis* nucleotide sequences set out herein.

This may be used in the analysis of the *N. meningitidis* nucleotide sequences set out herein. For instance, it may be used in a search to identify open reading frames (ORFs) or coding sequences within the sequences.

In a further aspect, the invention provides a method for identifying an amino acid sequence, comprising the step of searching for putative open reading frames or protein-coding sequences within a *N. meningitidis* nucleotide sequence set out herein. Similarly, the invention provides the use of a *N. meningitidis* nucleotide sequence set out herein in a search for putative open reading frames or protein-coding sequences.

Open-reading frame or protein-coding sequence analysis is generally performed on a computer using standard bioinformatic techniques. Typical algorithms or program used in the analysis include ORFFINDER (NCBI), GENMARK [Borodovsky & McIninch (1993) *Computers Chem* 17:122-133], and GLIMMER [Salzberg et al. (1998) *Nucl Acids Res* 26:544-548].

A search for an open reading frame or protein-coding sequence may comprise the steps of searching a *N. meningitidis* nucleotide sequence set out herein for an initiation codon and searching the upstream sequence for an in-frame termination codon. The intervening codons represent a putative protein-coding sequence. Typically, all six possible reading frames of a sequence will be searched.

An amino acid sequence identified in this way can be expressed using any suitable system to give a protein. This protein can be used to raise antibodies which recognize epitopes within the identified amino acid sequence. These antibodies can be used to screen *N. meningitidis* to detect the presence of a protein comprising the identified amino acid sequence.

Furthermore, once an ORF or protein-coding sequence is identified, the sequence can be compared with sequence databases. Sequence analysis tools can be found at NCBI (http://www.ncbi.nlm.nih.gov) e.g., the algorithms BLAST, BLAST2, BLASTn, BLASTp, tBLASTn, BLASTx, & tBLASTx [see also Altschul et al. (1997) Gapped BLAST and PSI-BLAST: new generation of protein database search programs. *Nucleic Acids Research* 25:2289-3402]. Suitable databases for comparison include the nonredundant GenBank, EMBL, DDBJ and PDB sequences, and the nonredundant GenBank CDS translations, PDB, SwissProt, Spupdate and PIR sequences. This comparison may give an indication of the function of a protein.

Hydrophobic domains in an amino acid sequence can be predicted using algorithms such as those based on the statistical studies of Esposti et al. [Critical evaluation of the hydropathy of membrane proteins (1990) *Eur J Biochem* 190:207-219]. Hydrophobic domains represent potential transmembrane regions or hydrophobic leader sequences, which suggest that the proteins may be secreted or be surface-located. These properties are typically representative of good immunogens.

Similarly, transmembrane domains or leader sequences can be predicted using the PSORT algorithm (http://www.psort.nibb.acjp), and functional domains can be predicted using the MOTIFS program (GCG Wisconsin & PROSITE).

The invention also provides nucleic acid including an open reading frame or protein-coding sequence present in a *N. meningitidis* nucleotide sequence set out herein. Furthermore, the invention provides a protein including the amino acid sequence encoded by this open reading frame or protein-coding sequence.

According to a further aspect, the invention provides antibodies which bind to these proteins. These may be polyclonal or monoclonal and may be produced by any suitable means known to those skilled in the art.

The antibodies of the invention can be used in a variety of ways, e.g., for confirmation that a protein is expressed, or to confirm where a protein is expressed. Labeled antibody (e.g., fluorescent labeling for FACS) can be incubated with intact bacteria and the presence of label on the bacterial surface confirms the location of the protein, for instance.

According to a further aspect, the invention provides compositions including protein, antibody, and/or nucleic acid according to the invention. These compositions may be suitable as vaccines, as immunogenic compositions, or as diagnostic reagents.

The invention also provides nucleic acid, protein, or antibody according to the invention for use as medicaments (e.g., as vaccines) or as diagnostic reagents. It also provides the use of nucleic acid, protein, or antibody according to the invention in the manufacture of (I) a medicament for treating or preventing infection due to Neisserial bacteria (ii) a diagnostic reagent for detecting the presence of Neisserial bacteria or of antibodies raised against Neisserial bacteria Said Neisserial bacteria may be any species or strain (such as *N. gonorrhoeae*) but are preferably *N. meningitidis*, especially strain A, strain B or strain C.

In still yet another aspect, the present invention provides for compositions including proteins, nucleic acid molecules, or antibodies. More preferable aspects of the present invention are drawn to immunogenic compositions of proteins. Further preferable aspects of the present invention contemplate pharmaceutical immunogenic compositions of proteins or vaccines and the use thereof in the manufacture of a medicament for the treatment or prevention of infection due to Neisserial bacteria, preferably infection of MenB.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression. A process which may further include chemical synthesis of proteins and/or chemical synthesis (at least in part) of nucleotides.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

Another aspect of the present invention provides for a process for detecting antibodies that selectably bind to antigens or polypeptides or proteins specific to any species or strain of Neisserial bacteria and preferably to strains of *N. gonorrhoeae* but more preferably to strains of *N. meningitidis*, especially strain A, strain B or strain C, more preferably MenB, where the process comprises the steps of: (a) contacting antigen or polypeptide or protein according to the invention with a biological sample under conditions suitable for the formation of an antibody-antigen complexes; and (b) detecting said complexes.

Having now generally described the invention, the same will be more readily understood through reference to the following examples which are provided by way of illustration, and are not intended to be limiting of the present invention, unless specified.

Methodology—Summary of Standard Procedures and Techniques

General

This invention provides *Neisseria meningitidis* MenB nucleotide sequences, amino acid sequences encoded therein. With these disclosed sequences, nucleic acid probe assays and expression cassettes and vectors can be produced. The proteins can also be chemically synthesized. The expression vectors can be transformed into host cells to produce proteins. The purified or isolated polypeptides can be used to produce antibodies to detect MenB proteins. Also, the host cells or extracts can be utilized for biological assays to isolate agonists or antagonists. In addition, with these sequences one can search to identify open reading frames and identify amino acid sequences. The proteins may also be used in immunogenic compositions and as vaccine components.

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

Expression Systems

The *Neisseria* MenB nucleotide sequences can be expressed in a variety of different expression systems; for example those used with mammalian cells, plant cells, baculoviruses, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box.

An upstream promoter element determines the rate at which transcription is initiated and can act in either orientation (Sambrook et al. (1989) "Expression of Cloned Genes in Mammalian Cells." In *Molecular Cloning. A Laboratory Manual, 2nd ed*).

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible). Depending on the promoter selected, many promotes may be inducible using known substrates, such as the use of the mouse mammary tumor virus (MMTV) promoter with the glucocorticoid responsive element (GRE) that is induced by glucocorticoid in hormone-responsive transformed cells (see for example, U.S. Pat. No. 5,783,681).

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter (Maniatis et al. (1987) *Science* 236:1237; Alberts et al. (1989) *Molecular Biology of the Cell,* 2nd ed.). Enhancer elements derived from viruses may be particularly useful, because they usually have a broader host range. Examples include the SV40 early gene enhancer (Dijkema et al (1985) *EMBO J.* 4:761) and the enhancer/promoters derived from the long terminal repeat (LTR) of the Rous Sarcoma Virus (Gorman et al. (1982b) *Proc. Natl. Acad. Sci.* 79:6777) and from human cytomegalovirus (Boshart et al. (1985) *Cell* 41:521). Additionally, some enhancers are regulatable and become active only in the presence of an inducer, such as a hormone or metal ion (Sassone-Corsi and Borelli (1986) *Trends Genet.* 2:215; Maniatis et al. (1987) Science 236:1237).

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105). These sequences direct the transcription of an mRNA which can be translated into the polypeptide encoded by the DNA. Examples of transcription terminator/polyadenylation signals include those derived from SV40 (Sambrook et al (1989) "Expression of cloned genes in cultured mammalian cells." In *Molecular Cloning: A Laboratory Manual*).

Usually, the above-described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria Mammalian replication systems include those derived from animal viruses, which require trans-acting factors to replicate. For example, plasmids containing the replication systems of papovaviruses, such as SV40 (Gluzman (1981) *Cell* 23:175) or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Plant Cellular Expression Systems

There are many plant cell culture and whole plant genetic expression systems known in the art Exemplary plant cellular genetic expression systems include those described in patents, such as: U.S. Pat. Nos. 5,693,506; 5,659,122; and 5,608, 143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:3340 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell*, 2:1027-1038(1990); Maas et al., *EMBO J.* 9:3447-3452 (1990); Benkel and Hickey, *Proc. Natl. Acad. Sci.* 84:1337-1339 (1987).

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker, and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts' reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No. 1555* (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human (alpha) α-interferon, Maeda et al., (1985), *Nature* 315:592; human gastrin-releasing peptide, Lebacq-Verheyden et al., (1988), *Molec. Cell. Biol.* 8:3129; human IL2, Smith et al., (1985) *Proc. Nat'l Acad. Sci. USA*, 82:8404; mouse IL3, (Niyajima et al., (1987) *Gene* 58:273; and human glucocerebrosidase, Martin et al. (1988) *DNA*, 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovinus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 µm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Narmely, the plaques are screened under the light microscope for the presence (indicative of wild-type virus) or absence (indicative of recombinant virus) of occlusion bodies. *Current Protocols in Microbiology* Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Trichoplusia ni* (PCT Pub. No. WO 89/046699; Carbonell et al., (1985) *J. Virol.* 56:153; Wright (1986) *Nature* 321:718; Smith et al., (1983) *Mol. Cell. Biol* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) (Raibaud et al. (1984) *Annu. Rev. Genet.* 18:173). Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) (Chang et al. (1977) *Nature* 198:1056), and maltose. Additional examples include promoter sequences derived from biosynthetic enzymes such as tryptophan (trp) (Goeddel et al. (1980) *Nuc. Acids Res.* 8:4057; Yelverton et al. (1981) *Nucl. Acids Res.* 9:731; U.S. Pat. No. 4,738,921; EPO Publ. Nos. 036 776 and 121 775). The beta-lactamase (bla) promoter system (Weissmann (1981) "The cloning of interferon and other mistakes." In *Interferon* 3 (ed. I. Gresser)), bacteriophage lambda PL (Shimatake et al. (1981) *Nature* 292:128) and T5 (U.S. Pat. No. 4,689,406) promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac promoter is a hybrid trp-lac promoter comprised of both trp promoter and lac operon sequences that is regulated by the lac repressor (Amann et al. (1983) *Gene* 25:167; de Boer et al. (1983) *Proc. Natl. Acad. Sci.* 80:21). Furthermore, a bacterial promoter can include naturally occurring promoters of non-bacterial origin that have the ability to bind bacterial RNA polymerase and initiate transcription. A, naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO Publ. No. 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of *E. coli* 16S rRNA (Steitz et al. (1979) "Genetic signals and nucleotide sequences in messenger RNA." In *Biological Regulation and Development: Gene Expression* (ed. R. F. Goldberger)). To express eukaryotic genes and prokaryotic genes with weak ribosome-binding site, it is often necessary to optimize the distance between the SD sequence and the ATG of the eukaryotic gene (Sambrook et al. (1989) "Expression of cloned genes in *Escherichia coli*." In *Molecular Cloning. A Laboratory Manual*.

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo or in vitro incubation with a bacterial methionine N-terminal peptidase (EPO Publ. No. 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria The resulting fusion protein preferably retains a site for a processing enzyme (factor Xa) to cleave the bacteriophage protein from the foreign gene (Nagai et al. (1984) *Nature* 309:810). Fusion proteins can also be made with sequences from the lacZ (Jia et al. (1987) *Gene* 60:197), trpE (Allen et al. (1987) J. Biotechnol. 5:93; Makoff et al. (1989) *J. Gen. Microbiol.* 135:11), and Chey (EPO Publ. No. 324 647) genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated (Miller et al. (1989) *Bio/Technology* 7:698).

Alternatively, foreign proteins can also be secreted from the cell by creating chimeric DNA molecules that encode a fusion protein comprised of a signal peptide sequence fragment that provides for secretion of the foreign protein in bacteria (U.S. Pat. No. 4,336,336). The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) (Masui et al. (1983), in: *Experimental Manipulation of Gene Expression*; Ghrayeb et al. (1984) *EMBO J.* 3:2437) and the *E. coli* alkaline phosphatase signal sequence (whoa) (Oka et al. (1985) *Proc. Natl. Acad. Sci.* 82:7212). As an additional example, the signal sequence of the alpha-amylase gene from various *Bacillus* strains can be used to secrete heterologous proteins from *B. subtilis* (Palva et al. (1982) *Proc. Natl. Acad. Sci USA* 79:5582; EPO Publ. No. 244 042).

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EPO Publ. No. 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline (Davies et al. (1978) *Annu. Rev. Microbiol.* 32:469). Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* (Palva et al. (1982) *Proc. Natl. Acad. Sci. USA* 79:5582; EPO Publ. Nos. 036 259 and 063 953; PCT Publ. No. WO 84/04541), *Escherichia coli* (Shimatake et al. (1981) *Nature* 292:128; Amann et al. (1985) *Gene* 40:183; Studier et al. (1986) *J. Mol. Biol.* 189:113; EPO Publ. Nos. 036 776, 136 829 and 136 907), *Streptococcus cremoris* (Powell et al. (1988) *Appl. Environ. Microbiol.* 54:655); *Streptococcus lividans* (Powell et al. (1988) *Appl. Environ. Microbiol.* 54:655), *Streptomyces lividans* (U.S. Pat. No. 4,745,056).

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. (See e.g., use of *Bacillus*: Masson et al. (1989) *FEMS Microbiol. Lett.* 60:273; Palva et al. (1982) *Proc. Natl. Acad. Sci. USA* 79:5582; EPO Publ. Nos. 036 259 and 063 953; PCT Publ. No. WO 84/04541; use of *Campylobacter*: Miller et al. (1988) *Proc. Natl. Acad. Sci.* 85:856; and Wang et al. (1990) *J. Bacteriol* 172:949; use of *Escherichia coli*: Cohen et al. (1973) *Proc. Natl. Acad Sci* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; use of *Lactobacillus*: Chassy et al. (1987) *FEMS Microbiol. Lett.* 44:173; use of *Pseudomonas*: Fiedler et al. (1988) *Anal. Biochem* 170:38; use of *Staphylococcus*: Augustin et al. (1990) *FEMS Microbiol. Lett.* 66:203; use of *Streptococcus*: Barany et al. (1980) *J. Bacteriol.* 144:698; Harlander (1987) "Transformation of *Streptococcus* lactis by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EPO Publ. No. 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO Publ. No. 329 203). The yeast PHO5 gene, encoding acid phosphatase, also provides useful promoter sequences (Myanohara et al. (1983) *Proc. Natl. Acad. Sci. USA* 80:1).

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EPO Publ. No. 164 556). Furthermore, a yeast promoter can include naturally occurring promoters of non-yeast origin that have the ability to bind yeast RNA polymerase and initiate transcription. Examples of such promoters include, inter alia, (Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109).

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, plant, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EPO Publ. No. 196056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EPO Publ. No. 012 873; JPO Publ. No. 62:096,086) and the A-factor gene (U.S. Pat. No. 4,588,684).

Alternatively, leaders of non-yeast origin, such as an interferon leader, exist that also provide for secretion in yeast (EPO Publ. No. 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EPO Publ. No. 324 274). Additional leaders employing an alpha-factor leader fragment that provides for secretion include hybrid alpha-factor leaders made with a presequence of a first yeast, but a pro-region from a second yeast alpha factor. (See e.g., PCT Publ. No. WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al. (1979) *Gene* 8:17-24), pC1/1 (Brake et al. (1984) *Proc. Natl. Acad. Sci USA* 81:4642-4646), and YRp17 (Stinchcomb et al. (1982) *J. Mol. Biol.* 158:157). In addition, a replicon may be either a high or low copy number plasmid A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al. (1983) *Methods in Enzymol.* 101:228-245). An integrating vector may be directed to a specific locus in yeast by selecting the appropriate homologous sequence for inclusion in the vector. See Orr-Weaver et al., supra. One or more expression construct may integrate, possibly affecting levels of recombinant protein produced (Rine et al. (1983) *Proc. Natl. Acad. Sci. USA* 80:6750). The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions (Butt et al. (1987) *Microbiol, Rev.* 51:351).

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors and methods of introducing exogenous DNA into yeast hosts have been developed for, inter alia, the following yeasts: *Candida albicans* (Kurtz, et al. (1986) *Mol. Cell. Biol.* 6:142); *Candida maltosa* (Kunze, et al. (1985) *J. Basic Microbiol.* 25:141); *Hansenula polymorpha* (Gleeson, et al. (1986) *J. Gen. Microbiol.* 132:3459; Roggenkamp et al. (1986) *Mol. Gen. Genet* 202:302); *Kluyveromyces fragilis* (Das, et al. (1984) *J. Bacteriol.* 158:1165); *Kluyveromyces lactis* (De Louvencourt et al. (1983) *J. Bacteriol.* 154:737; Van den Berg et al. (1990) *Bio/Technology* 8:135); *Pichia guillerimondii* (Kunze et al. (1985) *J. Basic Microbiol.* 25:141); *Pichia pastoris* (Cregg, et al. (1985) *Mol. Cell. Biol.* 5:3376; U.S. Pat. Nos. 4,837,148 and 4,929,555); *Saccharomyces cerevisiae* (Hinnen et al. (1978) *Proc. Natl. Acad. Sci. USA* 75:1929; Ito et al. (1983) *J. Bacteriol.* 153:163); *Schizosaccharomyces pombe* (Beach and Nurse (1981) *Nature* 300:706); and *Yarrowia lipolytica* (Davidow, et al. (1985) *Curr. Genet.* 10:380471 Gaillardin, et al. (1985) Curr. Genet. 10:49).

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75;1929; Ito et al. (1983) *J. Bacteriol* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as a DNA, RNA or amino acid sequence differing from but having homology with the native or disclosed sequence. Depending on the particular sequence, the degree of homology between the native or disclosed sequence and the mutant sequence is preferably greater than 50% (e.g., 60%, 70%, 80%, 90%, 95%, 99% or more) which is calculated as described above. As used herein, an "allelic variant" of a nucleic acid molecule, or region, for which nucleic acid sequence is provided herein is a nucleic acid molecule, or region, that occurs at essentially the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions. (see, for example, U.S. Pat. No. 5,753,235).

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanized antibodies, altered antibodies, univalent antibodies, Fab proteins, and single domain antibodies.

Antibodies against the proteins of the invention are useful for affinity chromatography, immunoassays, and distinguishing/identifying Neisseria MenB proteins. Antibodies elicited against the proteins of the present invention bind to antigenic polypeptides or proteins or protein fragments that are present and specifically associated with strains of Neisseria meningitidis MenB. In some instances, these antigens may be associated with specific strains, such as those antigens specific for the MenB strains. The antibodies of the invention may be immobilized to a matrix and utilized in an immunoassay or on an affinity chromatography column, to enable the detection and/or separation of polypeptides, proteins or protein fragments or cells comprising such polypeptides, proteins or protein fragments. Alternatively, such polypeptides, proteins or protein fragments may be immobilized so as to detect antibodies bindably specific thereto.

Antibodies to the proteins of the invention, both polyclonal and monoclonal, may be prepared by conventional methods.

In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient Immunization is generally boosted 26 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein (Nature (1975) 256:495-96), or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells that express membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}$P and $^{125}$I), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Antigens, immunogens, polypeptides, proteins or protein fragments of the present invention elicit formation of specific binding partner antibodies. These antigens, immunogens, polypeptides, proteins or protein fragments of the present invention comprise immunogenic compositions of the present invention. Such immunogenic compositions may further comprise or include adjuvants, carriers, or other compositions that promote or enhance or stabilize the antigens, polypeptides, proteins or protein fragments of the present invention. Such adjuvants and carriers will be readily apparent to those of ordinary skill in the art.

Pharmaceutical Compositions

Pharmaceutical compositions can include either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature, when given to a patient that is febrile. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgment of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal and transcutaneous applications, needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunizing antigen(s) or immunogen(s), immunogenic polypeptide, protein(s) or protein fragments, or nucleic acids (e.g., ribonucleic acid or deoxyribonucleic acid), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the immunogen or antigen may be conjugated to a bacterial toxoid, such as a toxoid from diphtheria, tetanus, cholera, H. pylori, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; (6) detoxified mutants of a bacterial ADP-ribosylating toxin such as a cholera toxin (CT), a pertussis toxin (PT), or an E. coli heat-labile toxin (LT), particularly LT-K63, LT-R72, CT-S 109, PT-K9/G129; see, e.g., WO 93/13302 and WO 92/19265; and (7) other substances that act as immunostimulating agents to enhance the effectiveness of the composition. Alum and MFS9 are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-huydroxyphosphoryloxy)-ethylamine (MTP-PE), etc.

The vaccine compositions comprising immunogenic compositions (e.g., which may include the antigen, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Alternatively, vaccine compositions comprising immunogenic compositions may comprise an antigen, polypeptide, protein, protein fragment or nucleic acid in a pharmaceutically acceptable carrier.

More specifically, vaccines comprising immunogenic compositions comprise an immunologically effective amount of the immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

Typically, the vaccine compositions or immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

The immunogenic compositions are conventionally administered parenterally, e.g., by injection, either subcutaneously or intramuscularly. Additional formulations suitable for other modes of administration include oral and pulmonary formulations, suppositories, and transdermal and transcutaneous applications. Dosage treatment may be a single dose schedule or a multiple dose schedule. The vaccine may be administered in conjunction with other immunoregulatory agents.

As an alternative to protein-based vaccines, DNA vaccination may be employed (e.g., Robinson & Torres (1997) Seminars in Immunology 9:271-283; Donnelly et al. (1997) Annu Rev Immunol 15:6174-648).

Gene Delivery Vehicles

Gene therapy vehicles for delivery of constructs, including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) Cancer Gene Therapy 1:51-64; Kimura (1994) Human Gene Therapy 5:845-852; Connelly (1995) Human Gene Therapy 6:185-193; and Kaplitt (1994) Nature Genetics 6:148-153.

Retroviral vectors are well known in the art, including B, C and D type retroviruses, xenotropic retroviruses (for example, NZB-X1, NZB-X2 and NZB9-1 (see O'Neill (1985) J. Virol. 53:160) polytropic retroviruses e.g., MCF and MCF-MLV (see Kelly (1983) J. Virol. 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) J Virol 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. Nos. 5,219,740, 4,405,712, 4,861, 719, 4,980,289, 4,777,127, 5,591,624. See also Vile (1993) Cancer Res 53:3860-3864, Vile (1993) Cancer Res 53:962-

967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy:* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczk U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. Nos. 5,354,678, 5,173,414, 5,139,941, and 5,252,479.

The gene therapy vectors comprising sequences of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3:pgC-lacZ described in Fink (1992) *Human Gene Therapy* 3:11-19 and HSV 7134,2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC in Rockville, Md. or isolated from known sources using comnonly available techniques. Preferably, alphavirus vectors with reduced cytotoxicity are used (see U.S. Ser. No. 08/679,640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569:86, Flexner (1990) *Vaccine* 8:17; in U.S. Pat. No. 4,603,112 and 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and Nature (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-$^{125}$I, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed to transform a host cell. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. S No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprise a therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, transdermally or transcutaneously, intravenously or intramuscularly or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment may be a single dose schedule or a multiple dose schedule. See WO98/20734.

Methods for the ex vivo delivery and reimplantation of transformed cells into a subject are known in the art and described in e.g., WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asialoorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, Etc.

Other groups that can be included in a pharmaceutical composition include, for example: hormones, steroids, androgens, estrogens, thyroid hormone, or vitamins, folic acid.

C. Polyalkylenes, Polysaccharides, etc.

Also, polyalkylene glycol can be included in a pharmaceutical compositions with the desired polynucleotides and/or polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide) may be included in a pharmaceutical composition.

D. Lipids, and Liposomes

The desired polynucleotide or polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid or polypeptide. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101: 512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N(1-2,3-dioleyloxy)propyl)-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, e.g., Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See e.g., Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide or polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI AII, AIV; CI, CII, CIII.

A lipoprotein can comprise more than one apoprotein. For example, naturally occurring chylomicrons comprises of A, B, C, and E, over time these lipoproteins lose A and acquire C and B apoproteins. VLDL comprises A, B, C, and E apoproteins, LDL comprises apoprotein B; and HDL comprises apoproteins A, C, and E.

The amino acid sequences of these apoproteins are known and are described in, for example, Breslow (1985) *Annu Rev. Biochem* 54:699; Law (1986) *Adv. Exp Med. Biol.* 151: 162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443.

Lipoproteins can also be purchased from commercial suppliers, such as Biomedical Technologies, Inc., Stoughton, Mass., USA.

Further description of lipoproteins can be found in Zuckermann et al., PCT. Appln. No. US97/14465.

F. Polycationic Agents

Polycationic agents can be included, with or without lipoprotein, in a composition with the desired polynucleotide and/or polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples of useful polypeptides include histones, protamines, human serum albumin, DNA binding proteins, non-histone chromosomal proteins, coat proteins from DNA viruses, such as ΦX174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

G. Synthetic Polycationic Agents

Synthetic polycationic agents which are useful in pharmaceutical compositions include, for example, DEAE-dextra, polybrene. Lipofectin™, and lipofectAMINE™ are monomers that form polycationic complexes when combined with polynucleotides or polypeptides.

Immunodiagnostic Assays

Neisseria MenB antigens, or antigenic fragments thereof, of the invention can be used in immunoassays to detect antibody levels (or, conversely, anti-Neisseria MenB antibodies can be used to detect antigen levels). Immunoassays based on well defined, recombinant antigens can be developed to replace invasive diagnostics methods. Antibodies to Neisseria MenB proteins or fragments thereof within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridization

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. (supra) Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of yeast DNA, blotting for two hours, and hybridizing for 48 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$T_m = 81 + 16.6(\log_{10} Ci) + 0.4(\% (G+C)) - 0.6(\% \text{ formamide}) - 600/n - 1.5(\% \text{ mismatch})$$

where Ci is the salt concentration (monovalent ions) and n is the length of the hybrid in base pairs (slightly modified from Meinkoth & Wahl (1984) Anal. Biochem. 138:267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (i.e., stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. (*J. Am. Chem. Soc.* (1981) 103:3185), or according to Urdea et al. (*Proc. Natl. Acad. Sci. USA* (1983) 80: 7461), or using commercially available automated oligonucleotide synthesizers.

The chemical nature of the probe can be selected according to preference. For certain applications, DNA or RNA are appropriate. For other applications, modifications may be incorporated e.g., backbone modifications, such as phosphorothioates or methylphosphonates, can be used to increase in vivo half-life, alter RNA affinity, increase nuclease resistance etc. (e.g., see Agrawal & Iyer (1995) *Curr Opin Biotechnol* 6:12-19; Agrawal (1996) *TIBTECH* 14:376-387); analogues such as peptide nucleic acids may also be used (e.g., see Corey (1997) *TIBTECH* 15:224229; Buchardt et al. (1993) *TIBTECH* 11:384-386).

One example of a nucleotide hybridization assay is described by Urdea et al. in international patent application WO92/02526 (see also U.S. Pat. No. 5,124,246).

Alternatively, the polymerase chain reaction (PCR) is another well-known means for detecting small amounts of target nucleic acids. The assay is described in: Mullis et al. (*Meth. Enzymol.* (1987) 155: 335-350); U.S. Pat. Nos. 4,683, 195; and 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labeled probe will hybridize to the Neisserial sequence (or its complement).

Also, mRNA or cDNA can be detected by traditional blotting techniques described in Sambrook et al (supra). mRNA, or cDNA generated from mRNA using a polymerase enzyme, can be purified and separated using gel electrophoresis. The nucleic acids on the gel are then blotted onto a solid support, such as nitrocellulose. The solid support is exposed to a labeled probe and then washed to remove any unhybridized probe. Next, the duplexes containing the labeled probe are detected. Typically, the probe is labeled with a radioactive moiety.

EXAMPLES

The invention is based on the 961 nucleotide sequences from the genome of *N. meningitidis* set out in Appendix C, SEQ ID NOs:1-961, which together represent substantially the complete genome of serotype B of *N. meningitidis*, as well as the full length genome sequence shown in Appendix D, SEQ ID NO 1068.

It will be self-evident to the skilled person how this sequence information can be utilized according to the invention, as above described.

The standard techniques and procedures which may be employed in order to perform the invention (e.g. to utilize the disclosed sequences to predict polypeptides useful for vaccination or diagnostic purposes) were summarized above. This summary is not a limitation on the invention but, rather, gives examples that may be used, but are not required.

These sequences are derived from contigs shown in Appendix C (SEQ ID NOs 1-961) and from the full length genome sequence shown in Appendix D (SEQ ID NO 1068), which were prepared during the sequencing of the genome of *N. meningitidis* (strain B). The full length sequence was assembled using the TIGR Assembler as described by G. S. Sutton et al., *TIGR Assembler: A New Tool for Assembling Large Shotgun Sequencing Projects*, Genome Science and Technology, 1:9-19 (1995) [see also R. D. Fleischmann, et al., Science 269, 496-512 (1995); C. M. Fraser, et al., Science 270, 397-403 (1995); C. J. Bult, et al., Science 273, 1058-73 (1996); C. M. Fraser, et. al, Nature 390, 580-586 (1997); J.-F.

Tomb, et. al., Nature 388, 539-547 (1997); H. P. Klenk, et al., Nature 390, 364-70 (1997); C. M. Fraser, et al., Science 281, 375-88 (1998); M. J. Gardner, et al., Science 282, 1126-1132 (1998); K. E. Nelson, et al., Nature 399, 323-9 (1999)]. Then, using the above-described methods, putative translation products of the sequences were determined. Computer analysis of the translation products were determined based on database comparisons. Corresponding gene and protein sequences, if any, were identified in *Neisseria meningitidis* (Strain A) and *Neisseria gonorrhoeae*. Then the proteins were expressed, purified, and characterized to assess their antigenicity and immunogenicity.

In particular, the following methods were used to express, purify, and biochemically characterize the proteins of the invention.

Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris-HCl, 50 mM EDTA, adjusted to pH 8.0). After 10 minutes incubation on ice, the bacteria were lysed by adding 10 ml lysis solution (50 mM NaCl, 1% Na-Sarkosyl, 50 µg/ml Proteinase K), and the suspension was incubated at 37° C. for 2 hours. Two phenol extractions (equilibrated to pH 8) and one ChCl$_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4 ml buffer (10 mM Tris-HCl, imM EDTA, pH 8). The DNA concentration was measured by reading the OD at 260 nm.

Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus. Any predicted signal peptides were omitted, by deducing the 5'-end amplification primer sequence immediately downstream from the predicted leader sequence.

For most ORFs, the 5' primers included two restriction enzyme recognition sites (BamHI-NdeI, BamHI-NheI, or EcoRI-NheI, depending on the gene's restriction pattern); the 3' primers included a XhoI restriction site. This procedure was established in order to direct the cloning of each amplification product (corresponding to each ORF) into two different expression systems: pGEX-KG (using either BamHI-XhoI or EcoRI-XhoI), and pET21b+(using either NdeI-XhoI or NheI-XhoI).

5'-end primer tail:
CGC<u>GGATCCCATATG</u> (BamHI-NdeI) SEQ ID NO: 1069

CGC<u>GGATCCGCTAGC</u> (BamHI-NheI) SEQ ID NO: 1070

CCG<u>GAATTCTAGCTAGC</u> (EcoRI-NheI) SEQ ID NO: 1071

3'-end primer tail:
CCCG<u>CTCGAG</u> (XhoI) SEQ ID NO: 1072

For some ORFs, two different amplifications were performed to clone each ORF in the two expression systems. Two different 5' primers were used for each ORF; the same 3' XhoI primer was used as before:

5'-end primer tail: GGAATTC<u>CATATG</u>GCCATGG (NdeI) SEQ ID NO: 1073

5'-end primer tail: CG<u>GGATCC</u> (BamHI) SEQ ID NO: 1074

Other ORFs were cloned in the pTRC expression vector and expressed as an amino-terminus His-tag fusion. The predicted signal peptide may be included in the final product. NheI-BamHI restriction sites were incorporated using primers:

5'-end primer tail: GATCA<u>GCTAGC</u>CATATG (NheI) SEQ ID NO: 1075

3'-end primer tail: CG<u>GGATCC</u> (BamHI) SEQ ID NO: 1074

As well as containing the restriction enzyme recognition sequences, the primers included nucleotides which hybridized to the sequence to be amplified. The number of hybridizing nucleotides depended on the melting temperature of the whole primer, and was determined for each primer using the formulae:

$T_m=4(G+C)+2(A+T)$ (tail excluded)

$T_m=64.9+0.41(\% \, GC)-600/N$ (whole primer)

The average melting temperature of the selected oligos were 65-70° C. for the whole oligo and 50-55° C. for the hybridising region alone.

Oligos were synthesized by a Perkin Elmer 394 DNA/RNA Synthesizer, eluted from the columns in 2 ml NH$_4$—OH, and deprotected by 5 hours incubation at 56° C. The oligos were precipitated by addition of 0.3M Na-Acetate and 2 volumes ethanol. The samples were then centrifuged and the pellets resuspended in either 100 µl or 1 ml of water. OD$_{260}$ was determined using a Perkin Elmer Lambda Bio spectophotometer and the concentration was determined and adjusted to 2-10 pmol/µl.

Table 1 shows the forward and reverse primers used for each amplification. In certain cases, it might be noted that the sequence of the primer does not exactly match the sequence in the ORF. When initial amplifications are performed, the complete 5' and/or 3' sequence may not be known for some meningococcal ORFs, although the corresponding sequences may have been identified in gonoccus. For amplification, the gonococcal sequences could thus be used as the basis for primer design, altered to take account of codon preference. In particular, the following codons may be changed: ATA→ATT; TCG→TCT; CAG→CAA; AAG→AAA; GAG→GAA; CGA and CGG→CGC; GGG→GGC.

Amplification

The standard PCR protocol was as follows: 50-200 ng of genomic DNA were used as a template in the presence of 20-40 µM of each oligo, 400-800 µM dNTPs solution, 1×PCR buffer (including 1.5 mM MgCl$_2$), 2.5 units TaqI DNA polymerase (using Perkin-Elmer AmpliTaQ, GIBCO Platinum, Pwo DNA polymerase, or Tahara Shuzo Taq polymerase).

In some cases, PCR was optimsed by the addition of 10 µl DMSO or 50 µl 2M betaine.

After a hot start (adding the polymerase during a preliminary 3 minute incubation of the whole mix at 95° C.), each sample underwent a double-step amplification: the first 5 cycles were performed using as the hybridization temperature the one of the oligos excluding the restriction enzymes tail, followed by 30 cycles performed according to the hybridization temperature of the whole length oligos. The cycles were followed by a final 10 minute extension step at 72° C.

The standard cycles were as follows:

|  | Denaturation | Hybridisation | Elongation |
|---|---|---|---|
| First 5 cycles | 30 seconds 95° C. | 30 seconds 50–55° C. | 30–60 seconds 72° C. |
| Last 30 cycles | 30 seconds 95° C. | 30 seconds 65–70° C. | 30–60 seconds 72° C. |

The elongation time varied according to the length of the ORF to be amplified.

The amplifications were performed using either a 9600 or a 2400 Perkin Elmer GeneAmp PCR System. To check the results, 1/10 of the amplification volume was loaded onto a 1-1.5% agarose gel and the size of each amplified fragment compared with a DNA molecular weight marker.

The amplified DNA was either loaded directly on a 1% agarose gel or first precipitated with ethanol and resuspended in a suitable volume to be loaded on a 1% agarose gel. The DNA fragment corresponding to the right size band was then eluted and purified from gel, using the Qiagen Gel Extraction Kit, following the instructions of the manufacturer. The final volume of the DNA fragment was 30 μl or 50 μl of either water or 10 mM Tris, pH 8.5.

Digestion of PCR Fragments

The purified DNA corresponding to the amplified fragment was split into 2 aliquots and double-digested with:

NdeI/XhoI or NheI/XhoI for cloning into pET-21b+ and further expression of the protein as a C-terminus His-tag fusion BamHI/XhoI or EcoRI/XhoI for cloning into pGEX-KG and further expression of the protein as a GST N-terminus fusion.

For ORF 76, NheI/BamHI for cloning into pTRC-HisA vector and further expression of the protein as N-terminus His-tag fusion.

Each purified DNA fragment was incubated (37° C. for 3 hours to overnight) with 20 units of each restriction enzyme (New England Biolabs) in a either 30 or 40 μl final volume in the presence of the appropriate buffer. The digestion product was then purified using the QIAquick PCR purification kit, following the manufacturer's instructions, and eluted in a final volume of 30 (or 50) μl of either water or 10 nM Tris-HCl, pH 8.5. The final DNA concentration was determined by 1% agarose gel electrophoresis in the presence of titrated molecular weight marker.

Digestion of the Cloning Vectors (pET22B, pGEX-KG and pTRC-His A)

10 μg plasmid was double-digested with 50 units of each restriction enzyme in 200 μl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 μl of 10 mM Tris-HCl, pH 8.5. The DNA concentration was evaluated by measuring $OD_{260}$ of the sample, and adjusted to 50 μg/μl. 1 μl of plasmid was used for each cloning procedure.

Cloning

The fragments corresponding to each ORF, previously digested and purified, were ligated in both pET22b and pGEX-KG. In a final volume of 20 μl, a molar ratio of 3:1 fragment/vector was ligated using 0.5 μl of NEB T4 DNA ligase (400 units/μl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 μl E. coli DH5 competent cells were incubated with the ligase reaction solution for 40 minutes on ice, then at 37° C. for 3 minutes, then, after adding 800 μl LB broth, again at 37° C. for 20 minutes. The cells were then centrifuged at maximum speed in an Eppendorf microfuge and resuspended in approximately 200 μl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 μg/ml ampicillin. The cells were then pelletted and the DNA extracted using the Qiagen QIAprep Spin Miniprep Kit, following the manufacturer's instructions, to a final volume of 30 μl. 5 μl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

Cloning

Certain ORFs may be cloned into the pGEX-HIS vector using EcoRI-PstI, EcoRI-SalI, or SalI-PstI cloning sites. After cloning, the recombinant plasmids may be introduced in the E. coli host W3110.

Expression

Each ORF cloned into the expression vector may then be transformed into the strain suitable for expression of the recombinant protein product. 1 μl of each construct was used to transform 30 μl of E. coli BL21 (pGEX vector), E. coli TOP 10 (pTRC vector) or E. coli BL21-DE3 (pET vector), as described above. In the case of the pGEX-His vector, the same E. coli strain (W3110) was used for initial cloning and expression Single recombinant colonies were inoculated into 2 ml LB+Amp (100 μg/ml), incubated at 37° C. overnight, then diluted 1:30 in 20 ml of LB+Amp (100 μg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-10D for pGEX and pGEX-His vectors). For the pET, pTRC and pGEX-His vectors, the protein expression was induced by addiction of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

GST-fusion Proteins Large-Scale Purification.

A single colony was grown overnight at 37° C. on LB+Amp agar plate. The bacteria were inoculated into 20 ml of LB+Amp liquid colture in a water bath shaker and grown overnight. Bacteria were diluted 1:30 into 600 ml of fresh medium and allowed to grow at the optimal temperature (20-37° C.) to OD$_{550}$ 0.8-1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed two times and centrifuged again. The supernatant was collected and mixed with 150 μl Glutatione-Sepharose 4B resin (Pharmacia) (previously washed with PBS) and incubated at room temperature for 30 minutes. The sample was centrifuged at 700 g for 5 minutes at 4C. The resin was washed twice with 10 ml cold PBS for 10 minutes, resuspended in 1 ml cold PBS, and loaded on a disposable column. The resin was washed twice with 2 ml cold PBS until the flow-through reached OD$_{280}$ of 0.02-0.06. The GST-fusion protein was eluted by addition of 700 μl cold Glutathione elution buffer 10 mM reduced glutathione, 50 mM Tris-HCl) and fractions collected until the OD$_{280}$ was 0.1. 21 μl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M') (220, 66, 46, 30, 21.5, 14.3 kDa) as standards. As the MW of GST is 26 kDa, this value must be added to the MW of each GST-fusion protein.

His-fusion Soluble Proteins Large-scale Purification.

A single colony was grown overnight at 37° C. on a LB+Amp agar plate. The bacteria were inoculated into 20 ml of LBtAmp liquid culture and incubated overnight in a water bath shaker. Bacteria were diluted 1:30 into 600 ml fresh medium and allowed to grow at the optimal temperature (20-37° C.) to OD$_{550}$ 0.6-0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml cold 10 mM imidazole buffer (300 mM NaCl, 50 mM phosphate buffer, 10 mM imidazole, pH 8). The cells were disrupted by sonication on ice for 30 sec at 40 W using a Branson sonifier B-15, frozen and thawed two times and centrifuged again. The supernatant was collected and mixed with 150 μl Ni$^{2+}$-resin (Pharmacia) (previously washed with 10 mM imidazole buffer) and incubated at room temperature with gentle agitation for 30 minutes. The sample was centrifuged at 700 g for 5 minutes at 4° C. The resin was washed twice with 10 ml cold 10 mM imidazole buffer for 10 minutes, resuspended in 1 ml cold 10 mM imidazole buffer and loaded on a disposable column. The resin was washed at 4° C. with 2 ml cold 10 mM imidazole buffer until the flow-through reached the O.D$_{280}$ of 0.02-0.06. The resin was washed with 2 ml cold 20 mM imidazole buffer (300 mM NaCl, 50 mM phosphate buffer, 20 mM imidazole, pH 8) until the flow-through reached the O.D$_{280}$ of 0.02-0.06. The His-fusion protein was eluted by addition of 700 μl cold 250 mM imidazole buffer (300 mM NaCl, 50 mM phosphate buffer, 250 mM imidazole, pH 8) and fractions collected until the O.D$_{280}$ was 0.1. 21 μl of each fraction were loaded on a 12% SDS gel.

His-fusion Insoluble Proteins Large-scale Purification.

A single colony was grown overnight at 37° C. on a LB+Amp agar plate. The bacteria were inoculated into 20 ml of LB+Amp liquid culture in a water bath shaker and grown overnight. Bacteria were diluted 1:30 into 600 ml fresh medium and let to grow at the optimal temperature (37° C.) to O.D$_{550}$ 0.6-0.8. Protein expression was induced by addition of 1 mM IPTG and the culture further incubated for three hours. The culture was centrifuged at 800 rpm at 4° C. The supernatant was discarded and the bacterial pellet was resuspended in 7.5 ml buffer B (urea 8M, 10 mM Tris-HCl, 100 mM phosphate buffer, pH 8.8). The cells were disrupted by sonication on ice for 30 sec at 40 W using a Branson sonifier B-15, frozen and thawed twice and centrifuged again. The supernatant was stored at -20° C., while the pellets were resuspended in 2 ml guanidine buffer (6M guanidine hydrochloride, 100 mM phosphate buffer, 10 mM Tris-HCl, pH 7.5) and treated in a homogenizer for 10 cycles. The product was centrifuged at 13000 rpm for 40 minutes. The supernatant was mixed with 1501 μl Ni$^{2+}$-resin (Pharmacia) (previously washed with buffer B) and incubated at room temperature with gentle agitation for 30 minutes. The sample was centrifuged at 700 g for 5 minutes at 4° C. The resin was washed twice with 10 ml buffer B for 10 minutes, resuspended in 1 ml buffer B, and loaded on a disposable column. The resin was washed at room temperature with 2 ml buffer B until the flow-through reached the OD$_{280}$ of 0.02-0.06. The resin was washed with 2 ml buffer C (urea 8M, 10 mM Tris-HCl, 100 mM phosphate buffer, pH 6.3) until the flow-through reached the O.D$_{280}$ of 0.02-0.06. The His-fusion protein was eluted by addition of 700 μl elution buffer (urea 8M, 10 mM Tris-HCl, 100 mM phosphate buffer, pH 4.5) and fractions collected until the OD$_{280}$ was 0.1. 21 μl of each fraction were loaded on a 12% SDS gel.

His-fusion Proteins Renaturation

10% glycerol was added to the denatured proteins. The proteins were then diluted to 20 μg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C. Protein concentration was evaluated using the formula:

$$\text{Protein (mg/ml)} = (1.55 \times OD_{280}) - (0.76 \times OD_{260})$$

Mice Immunisations

20 μg of each purified protein were used to immunise mice intraperitoneally. In the case of some ORFs, Balb-C mice were immunised with Al(OH)$_3$ as adjuvant on days 1, 21 and 42, and immune response was monitored in samples taken on day 56. For other ORFs, CD1 mice could be immunised using the same protocol. For other ORFs, CD1 mice could be immunised using Freund's adjuvant, and the same immunisation protocol was used, except that the immune response was measured on day 42, rather than 56. Similarly, for still other ORFs, CD1 mice could be immunised with Freund's adjuvant, but the immune response was measured on day 49.

ELISA Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following OD$_{620}$. The bacteria were let to grow until the OD reached the value of 0.3-0.4. The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stirring. 100 μl bacterial cells were added to each well of a 96 well Greiner plate and incubated overnight at 4° C. The wells were then washed three times with PBT washing buffer (0.1% Tween-20 in PBS). 200 μl of saturation buffer (2.7% Polyvinylpyrrolidone 10 in water) was added to each well and the plates incubated for 2 hours at 37° C. Wells were washed three times with PBT. 200 μL of diluted sera (Dilution buffer: 1% BSA, 0.1% Tween-20, 0.1% NaN$_3$ in PBS) were added to each well and the plates incubated for 90 minutes at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of O-phenildiamine and 10 µl of $H_2O$) were added to each well and the plates were left at room temperature for 20 minutes. 100 µl $H_2SO_4$ was added to each well and $OD_{490}$ was followed. The ELISA was considered positive when OD490 was 2.5 times the respective pre-immune sera.

FACScan Bacteria Binding Assay Procedure

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA, 0.4% $NaN_3$) and centrifuged for 5 minutes at 4000 rpm. Cells were resuspended in blocking buffer to reach $OD_{620}$ of 0.07. 100 µl bacterial cells were added to each well of a Costar 96 well plate. 100 µl of diluted (1:200) sera (in blocking buffer) were added to each well and plates incubated for 2 hours at 4° C. Cells were centrifuged for 5 minutes at 4000 rpm, the supernatant aspirated and cells washed by addition of 200 µl/well of blocking buffer in each well. 100 µl of R-Phicoerytrin conjugated $F(ab)_2$ goat anti-mouse, diluted 1:100, was added to each well and plates incubated for 1 hour at 4° C. Cells were spun down by centrifugation at 4000 rpm for 5 minutes and washed by addition of 200 µl/well of blocking buffer. The supernatant was aspirated and cells resuspended in 200 µl/well of PBS, 0.25% formaldehyde. Samples were transferred to FACScan tubes and read. The condition for FACScan setting were: FL1 on, FL2 and FL3 off; FSC-H Treshold: 92; FSC PMT Voltage: E 02; SSC PMT: 474; Amp. Gains 7.1; FL2 PMT: 539. Compensation values: 0.

OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10' on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Whole Extracts Preparation

Bacteria were grown overnight on a GC plate, harvested with a loop and resuspended in 1 ml of 20 mM Tris-HCl. Heat inactivation was performed at 56° C. for 30' minutes.

Western Blotting

Purified proteins (500 ng/lane), outer membrane vesicles (5 µg) and total cell extracts (25 µg) derived from MenB strain 2996 were loaded on 15% SDS-PAGE and transferred to a nitrocellulose membrane. The transfer was performed for 2 hours at 150 mA at 4° C., in transferring buffer (0.3% Tris base, 1.44% glycine, 20% methanol). The membrane was saturated by overnight incubation at 4° C. in saturation buffer (10% skimmed milk, 0.1% Triton X100 in PBS). The membrane was washed twice with washing buffer (3% skimmed milk, 0.1% Triton X100 in PBS) and incubated for 2 hours at 37° C. with 1:200 mice sera diluted in washing buffer. The membrane was washed twice and incubated for 90 minutes with a 1:2000 dilution of horseradish peroxidase labeled anti-mouse Ig. The membrane was washed twice with 0.1% Triton X100 in PBS and developed with the Opti-4CN Substrate Kit (Bio-Rad). The reaction was stopped by adding water.

Bactericidal Assay

MC58 strain was grown overnight at 37° C. on chocolate agar plates. 5-7 colonies were collected and used to inoculate 7 ml Mueller-Hinton broth. The suspension was incubated at 37° C. on a nutator and let to grow until $OD_{620}$ was in between 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 µl of Gey's buffer/1% BSA was added to each well of a 96-well tissue culture plate. 25 µL of diluted (1:100) mice sera (dilution buffer: Gey's buffer/0.2% BSA) were added to each well and the plate incubated at 4° C. 25 µl of the previously described bacterial suspension were added to each well. 25 µl of either heat-inactivated (56° C. waterbath for 30 minutes) or normal baby rabbit complement were added to each well. Immediately after the addition of the baby rabbit complement, 22 µl of each sample/well were plated on Mueller-Hinton agar plates (time 0). The 96-well plate was incubated for 1 hour at 37° C. with rotation and then 22 µl of each sample/well were plated on Mueller-Hinton agar plates (time 1). After overnight incubation the colonies corresponding to time 0 and time 1 h were counted.

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrohoeae* DNA sequence, number 1. The presence of the suffix "-1" or "-2" to these sequences indicates an additional sequence found for the same ORF. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. Computer analysis was performed for the comparisons that follow between "g", "m", and "a" peptide sequences; and therein the "pep" suffix is implied where not expressly stated.

Example 1

The following ORFs were predicted from the contig sequences and/or the full length sequence using the methods herein described.

Localization of the ORFs

| ORF: | contig: |
|---|---|
| 279 | gnm4.seq |

The following partial DNA sequence was identified in *N. meningitidis* <SEQ ID 962>:

```
m279.seq
   1 ATAACGCGGA TTTGCGGCTG CTTGATTTCA ACGGTTTTCA GGGCTTCGGC

51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 963; ORF 279>:

```
m279.pep
   1 ITRICGCLIS TVFRASASLS AAGFIRLQWE GTDTGSGRAR LAPASLAAAM

51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

The following partial DNA sequence was identified in *N. gonorrhoeae* <SEQ ID 964>:

```
g279.seq
   1 atgacgcgga tttgcggctg cttgatttca acggttttga gtgtttcggc 51 aagtttgtcg gcggcgggtt tcatcaggct gcaatgggaa ggaacggata 101 ccggcagcgg cagggcgcgt ttggctccgg cttctttggc ggcagccatg 151 gtgcgtccga cggcggcggc gttgcctgca atcacgactt gtccgggcga 201 gttgaagttg acggcttcga ccacttcgcc ctgtgcggat tcggcacaaa 251 tctgcctgac ctgttcatct tccaaaccca aaatggccgc cattgcgcct 301 acgccttgcg gtacggcgga ctgcatcagt tcggcgcgca ggcggacgag 351 tttgacggca tcggcaaaat ccaatgcttc ggcggcgaca agcgcggtgt 401 attcgccgag gctgtgtccg gcaacggcgg caggcgtttt gccgcccact 451 tccaaatag
```

This corresponds to the amino acid sequence <SEQ ID 965; ORF 279.ng>:

```
g279.pep
   1 MTRICGCLIS TVLSVSASLS AAGFIRLQWE GRDTGSGRAR LAPASLAAAM

51 VRPTAAALPA ITTCPGELKL TASTTSPCAD SAQICLTCSS SKPKMAAIAP
```

```
101 TPCGTADCIS SARRRTSLTA SAKSNASAAT SAVYSPRLCP ATAAGVLPPT

151 SK*
```

---

ORF 279 shows 89.5% identity over a 152 aa overlap with a predicted ORF (ORF 279.ng) from *N. gonorrhoeae*:

```
                  10         20         30         40         50         60
m279.pep  ITRICGCLISTVFRASASLSAAGFIRLQWEGTDTGSGRARLAPASLAAAMARPTAAALPA
          :|||||||||||: :||||||||||||||||||||||||||||||||||: ||||||||
g279      MTRICGCLISTVLSVSASLSAAGFIRLQWEGTDTGSGRARLAPASLAAAMVRPTAAALPA
                  10         20         30         40         50         60

70         80         90        100        110        120
m279.pep  ITICPGELKLTASTTSLWAASAQMALTCSSSKPRIAAIAPTPCGTADCISSARRRTSLTA
          || |||||||||||||| |||: |||||||::||||||||||||||||||||||||||||
g279      ITTCPGELKLTASTTSPCADSAQICLTCSSSKPKMAAIAPTPCGTADCISSARRRTSLTA
                  70         80         90        100        110        120

130        140        150
m279.pep  SAKFNAPAATSAVYSPRLCPATAAGVLPPASKX    SEQ ID NO:963
          ||| || ||||||||||||||||||||||:|||
g279      SAKSNASAATSAVYSPRLCPATAAGVLPPTSKX    SEQ ID NO:965
                 130        140        150
```

The following partial DNA sequence was identified in *N. meningitidis* SEQ ID 966>:

```
a279.seq
   1 ATGACNCNGA TTTGCGGCTG CTTGATTTCA ACGGTTTNNA GGGCTTCGGC

51 GAGTTTGTCG GCGGCGGGTT TCATGAGGCT GCAATGGGAA GGTACNGACA

101 CNGGCAGCCG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAAOGGCGG CAGGCGTTTT GCCGCCCGCT

451 TCCGAATAG
```

This corresponds to the amino acid sequence <SEQ ID 967; ORF 279.a>:

```
a279.pep
   1 MTXICGCLIS TVXRASASLS AAGFMRLQWE GTDTGSGRAR LAPASLAASI

51 ARSTAAALPA ITTCPGELKL TASTTSSCAD SAQICFTCSS SKPRIAAIAP

101 TPCGTADCIS SARXRTSLTA SAKSNAPAAT SAVYSPXLCP ATAAGVLPPA

151 SE*
```

| |
|---|
| m279/a279 ORFs 279 and 279.a showed a 88.2% identity in 152 aa overlap |

```
              10         20         30         40         50         60
m279.pep  ITRICGCLISTVFRASASLSAAGFIRLQWEGIDTGSGRARLAPASLAAAMARPTAAALPA
          :| |||||||||| ||||||||||||:||||||||||||||||||||||::|| ||||||
a279      MTXICGCLISTVXRASASLSAAGFMRLQWEGTDTGSGRARLAPASLAASIARSTAAALPA
              10         20         30         40         50         60

70         80         90        100        110        120
m279.pep  ITICPGELKLTASTTSLWAASAQMALTCSSSKPRIAAIAPTPCGTADCISSARRRTSLTA
          || |||||||||||||| |||: :||||||||||||||||||||||||||||| ||||||
a279      ITTCPGELKLTASTTSSCADSAQICFTCSSSKPRIAAIAPTPCGTADCISSARXRTSLTA
              70         80         90        100        110        120

130        140        150
m279.pep  SAKFNAPAATSAVYSPRLCPATAAGVLPPASKX   SEQ ID NO 963
          ||| |||||||||||||| |||||||||||||:|
a279      SAKSNAPAATSAVYSPXLCPATAAGVLPPASEX   SEQ ID NO 966
             130        140        150
```

519 and 519-1 gnm7.seq

The following partial DNA, sequence was identified in *N. meningitidis* <SEQ ID 968>:

```
m519.seq (partial)
  1..TCCGTTATCG GGCGTATGGA GTTGGACAAA ACGTTTGAAG AACGCGACGA 51  AATCAACAGT ACTGTTGTTG CGGCTTTGGA CGAGGCGGCC GGGgCTTgGG

101  GTGTGAAGGT TTTGCGTTAT GAGATTAAAG ACTTGGTTCC GCCGCAAGAA

151  ATCCTTCGCT CAATGCAGGC GCAAATTACT GCcGAACGCG AAAAACGCGC

201  CCGTATCGCC GAATCCGAAG GTCGTAAAAT CGAACAAATC AACCTTGCCA

251  GTGGTCAGCG CGAAGCCGAA ATCCAACAAT CCGAAGGCGA GGCTCAGGCT

301  GCGGTCAATG CGTCAAATGC CGAGAAAATC GCCCGCATCA ACCGCGCCAA

351  AGGTGAAGCG CAATCCTTGC GCCTTGTTGC CGAAGCCAAT GCCGAAGCCA

401  TCCGTCAAAT TGCCGCCGCC CTTCAAACCC AAGGCGGTGC GGATGCGGTC

451  AATCTGAAGA TTGCGGAACA ATACGTCGCT GCGTTCAACA ATCTTGCCAA

501  AGAAAGCAAT ACGCTGATTA TGCCCGCCAA TGTTGCCGAC ATCGGCAGCC

551  TGATTTCTGC CGGTATGAAA ATTATCGACA GCAGCAAAAC CGCCAAaTAA
```

This corresponds to the amino acid sequence <SEQ ID 969; ORF 519>:

```
m519.pep (partial)
  1..SVIGRMELDK TFEEPDEINS TVVAALDRAA GAWGVKVLRY EIKDLVPPQK

51  ILRSMQAQIT AEREKRARIA ESEGRKIEQI NLASGQREAE IQQSEGEAQA

101  AVNASNAEKI ARINRAKGEA ESLRLVARAN AEAIRQIAAA LQTQGGADAV

151  NLKIAEQYVA AFNNLAKESN TLIMPANVAD IGSLISAGMK IIDSSKTAK*
```

The following partial DNA sequence was identified in *N. gonorrhoeae* <SEQ ID 970>:

```
g519.seq
  1  atggaatttt tcattatctt gttggcagcc gtcgccgttt tcggcttcaa
 51  atcctttgtc gtcatccccc agcaggaagt ccacgttgtc gaaaggctcg
```

-continued

```
101 ggcgtttcca tcgcgccctg acggccggtt tgaatatttt gattcccttt 151 atcgaccgcg tcgcctaccg ccattcgctg aaagaaatcc ctttagacgt 201 acccagccag gtctgcatca cgcgcgataa tacgcaattg actgttgacg 251 gcatcatcta tttccaagta accgatccca aactcgcctc atacggttcg 301 agcaactaca ttatggcaat tacccagctt gcccaaacga cgctgcgttc 351 cgttatcggg cgtatggagt tggacaaaac gtttgaagaa cgcgacgaaa 401 tcaacagtac cgtcgtctcc gccctcgatg aagccgccgg ggcttggggt 451 gtgaaagtcc tccgttacga aatcaaggat ttggttccgc cgcaagaaat 501 ccttcgcgca atgcaggcac aaattaccgc cgaacgcgaa aaacgcgccc 551 gtattgccga atccgaaggc cgtaaaatcg aacaaatcaa ccttgccagt 601 ggtcagcgtg aagccgaaat ccaacaatcc gaaggcgagg ctcaggctgc 651 ggtcaatgcg tccaatgccg agaaaatcgc ccgcatcaac cgcgccaaag 701 gcgaagcgga atccctgcgc cttgttgccg aagccaatgc cgaagccaac 751 cgtcaaattg ccgccgccct tcaaacccaa agcggggcgg atgcggtcaa 801 tctgaagatt gcgggacaat acgttaccgc gttcaaaaat cttgccaaag 851 aagacaatac gcggattaag cccgccaagg ttgccgaaat cgggaaccct 901 aattttcggc ggcatgaaaa attttcgcca gaagcaaaaa cggccaaata 951 a
```

This corresponds to the amino acid sequence <SEQ ID 971; ORF 519.ng>:

```
g519.pep
   1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIIQ LVPPQEILRA MQAQTTAERE KRARIAESEG RKIEQINLAS

201 GQREAEIQQS EGEAOAAVNA SNAEKIARIN RAKGEAESLR LVAEANAEAN

251 RQIAAALQTQ SGADAVNLKI AGQYVTAFKN LAKEDNTRIK PAKVAEIGNP

301 NERRHEKFSP EAKTAK*
```

ORF 519 shows 87.5% identity over a 200 aa overlap with a predicted ORF (ORF 519.ng) from *N. gonorrhoeae:* m519/g519

```
                                          10        20        30
m519.pep                              SVIGRMELDKTFEERDFINSTVVAALDEAA
                                      ||||||||||||||||||||||:||||||
g519     YFQVTDPKLASYGSSNYIMAITQLAQTTLRSVIGRMELDKTFEERDFINSTVVSALDEAA
           90        100       110       120       130       140

40        50        60        70        80        90
m519.pep  GAWGVKVLRYEIKDLVPPQEILRSMQAQITAEREKRARIAESEGRKIEQINLASGQREAE
          |||||||||||||||||||||||:||||||||||||||||||||||||||||||||||||
g519      GAWGVKVLRYEIKDLVPPQEILRAMQAQITAEREKRARIAESEGRKIEQINLASGQREAE
            150       160       170       180       190       200
```

ORF 519 shows 87.5% identity over a 200 aa overlap with a predicted ORF (ORF 519.ng) from
*N. gonorrhoeae*:
m519/g519

```
                100       110       120       130       140       150
m519.pep  IQQSEGEAQAAVNASNAEKIARINRAKGEAESLRLVAEANAEAIRQIAAALQTQGGADAV
          |||||||||||||||||||||||||||||||||||||||||||||:|||||||:|||||
g519      IQQSEGEAQAAVNASNAEKIARINRAKGEAESLRLVAEANAEANRQIAAALQTQSGADAV
                210       220       230       240       250       260

160       170       180       190       200
m519.pep  NLKIAEQYVAAFNNLAKESNTLIMPANVADIGSL-ISAGMKIIDSSKTAK   SEQ ID NO: 969
          ||||  |||:||:|||||:||  |::||:||:  :     |:   :||||
g519      NLKIAGQYVTAFKNLAKEDNTRIKPAKVAEIGNPNFRRHEKFSPEAKTAK  SEQ ID NO: 971
                270       280       290       300       310
```

The following partial DNA sequence was identified in *N. meningitidis* SEQ ID 972>:

```
a519.seq
    1 ATGGAATTTT TCATTATCTT GCTGGCAGCC GTCGTTGTTT TCGGCTTCAA

51 ATCCTTTGTT GTCATCCCAC AGCAGGAACT CCACGTTGTC GAAAGGCTCG

101 GGCGTTTCCA TCGCGCCCTG ACGGCCGGTT TGAATATTTT CATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCCACCCCA AACTCGCCTC ATACGGTTCC

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGk GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG ACAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ED 973; ORF 519.a>:

```
    1 MEFFIILLAA VVVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRS MQAQITAERE KPARIAESEG RKIEQINLAS

201 GQREAEIQQS EGEAQAAVNA SNAEKIARIN RAKGEAESLR LVAEANAEAI
```

-continued

```
251 RQIAAALQTQ GGADAVNLKI AEQYVAAFNN LAKESNTLIM PANVADIGSL

301 ISAGMKIIDS SKTAX*
```

| m519/a519 ORFs 519 and 519.a showed a 99.5% identity in 199 aa overlap |
|---|

```
                                    10         20         30
m519.pep                    SVIGRMELDKTFEERDEINSTVVAALDEAA
                            ||||||||||||||||||||||||:||||||
a516        YFQVTDPKLASYGSSNYIMAITQLAQTTLRSVIGRMELDKTFEERDEINSTVVSALDEAA
              90        100       110       120       130       140

40         50         60         70         80         90
m519-1.pep  GAWGVKVLRYEIKDLVPPQEILRSMQAQITAEREKRARIAESEGRKIEQINLASGQREAE
            ||||||||||||||||||||||||||||||||||||||||||||||||||||||||||||
a519-1      GAWGVKVLRYEIKDLVPPQEILRSMQAQITAEREKRARIAESEGRKIEQINLASGQREAE
            150       160       170       180       190       200

100        110        120        130        140        150
m519-1.pep  IQQSEGEAQAAVNASNAEKIARINRAKGFAESLRLVAENANEAIRQIAAALQTQGGADAV
            ||||||||||||||||||||||||||||||||||||||||||||||||||||||||||||
a519-1      IQQSEGEAQAAVNASNAEKIARINRAKGFAESLRLVAENANEAIRQIAAALQTQGGADAV
            210       220       230       240       250       260

160        170        180        190        200
m519-1.pep  NLKIAEQYVAAFNNLAKESNTLIMPANVADIGSLISAGMKIIDSSKTAKX   SEQ ID NO: 969
            ||||||||||||||||||||||||||||||||||||||||||||||||||
a519-1      NLKIAEQYVAAFNNLAKESNTLIMPANVADIGSLISAGMKIIDSSKTAKX   SEQ ID NO: 969
            270       280       290       300       310
```

Further work revealed the following DNA sequence identified in *N. meningitidis* <SEQ ID 974>:

```
m519-1.seq
  1 ATGGAATTTT TCATTATCTT GTTGGTAGCC GTCGCCGTTT TCGGTTTCAA

51 ATCCTTTGTT GTCATCCCAC AACAGGAAGT CCACGTTGTC GAAAGGCTGG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGCGGT

451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

752 CGTCAAATTG CCGCCGCCCT TCAAACCCAA GGCGGrGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 975; ORF 519-1>:

```
m519-1.
    1 MEFFIILLVA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVA ALDEAAGAWG

151 VKVLRYEIKD LVPPOEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGNKIXDS SKTAK*
```

The following DNA sequence was identified in *N. gonorrhoeae* <SEQ ID 976>:

```
g519-1.seq
    1 ATGGAATTTT TCATTATCTT GTTGGCAGCC GTCGCCGTTT TCGGCTTCAA

51 ATCCTTTGTC GTCATCCCCC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGATAA TACGCAATTG ACTGTTGACG

251 GCATCATCTA TTTCCAAGTA ACCGATCCCA AACTCGCCTC ATACGGTTCG

301 AGCAACTACA TTATGGCAAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC CGTCGTCTCC GCCCTCGATG AAGCCGCCGG GGCTTGGGCT

451 GTGAAACTCC TCCGTTACGA AATCAAGGAT TTGGTTCCGC CGCAAGAAAT

501 CCTTCGCGCA ATGCAGGCAC AAATTACCGC CGAACGCGAA AAACGCGCCC

551 GTATTGCCGA ATCCGAAGGC CGTAAAATCG AACAAATCAA CCTTGCCAGT

601 GGTCAGCGTG AAGCCGAAAT CCAACAATCC GAAGGCGAGG CTCAGGCTGC

651 GGTCAATGCG TCCAATGCCG AGAAAATCGC CCGCATCAAC CGCGCCAAAG

701 GCGAAGCGGA ATCCCTGCGC CTTGTTGCCG AAGCCAATGC CGAAGCCATC

751 CGTCAAATTG CCGCCGCCCT TCAAACCCAA GGCGGGGCGG ATGCGGTCAA

801 TCTCAAGATT GCGGAACAAT ACGTAGCCGC GTTCAACAAT CTTGCCAAAG

851 AAAGCAATAC GCTGATTATG CCCGCCAATG TTGCCGACAT CGGCAGCCTG

901 ATTTCTGCCG GCATGAAAAT TATCGACAGC AGCAAAACCG CCAAATAA
```

This corresponds to the amino acid sequence <SEQ ED 977; ORF 519-1.ng>:

```
g519-1.pep
    1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS
```

-continued
```
201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

```
         m519-1/g519-1 ORFs 519-1 and 519-1.ng showed a 99.0% identity in 315 aa overlap
                    10         20         30         40         50         60
g519-1.pep  MEFFIILLAAVAVFGFKSFVVIPQQEVHVVERLGRFHRALTAGLNILIPFIDRVAYRHSL
            ||||||||:|||||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10         20         30         40         50         60

70         80         90        100        110        120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70         80         90        100        110        120

130        140        150        160        170        180
g519-1.pep  RMFLDKTFEERDEINSTVVSALDEAAGAWGVKVLRYEIKDLVPPQEILRAMQAQITAERE
            ||||||||||||||||||||:|||||||||||||||||||||||||||||:|||||||||
m519-1      RMFLDKTFEERDEINSTVVAALDEAAGAWGVKVLRYEIKDLVPPQEILRSMQAQITAERE
                   130        140        150        160        170        180

190        200        210        220        230        240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190        200        210        220        230        240

250        260        270        280        290        300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250        260        270        280        290        300

310
g519-1.pep  ISAGMKIIDSSKTAKX    SEQ ID NO: 977
            ||||||||||||||||
m519-1      ISAGMKIIDSSKTAKX    SEQ ID NO: 977
                   310
```

40

The following DNA sequence was identified in *N. meningitidis* <SEQ ID 978>:

```
a519-1.seq
    1 ATGGAATTTT TCATTATCTT GCTGGCAGCC GTCGTTGTTT TCGGCTTCAA

51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC
```

```
651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 979; ORF 519-1.a>: a519-1.pep.

```
  1  MEFFIILLAA VVVFGFKSFV VIPQQEVHVV ERLGRFHRAL TAGLNILIPF

51  IDRVAYRHSL KEIPLDVPSQ VCITRDNTQL TVDGIIYFQV TDPKLASYGS

101  SNYIMAITQL AQTTLRSVIG RMELDKTFEE RDEINSTVVS ALDEAAGAWG

151  VKVLRYEIKD LVPPQEILRS MQAQITAERE KPARIAESEG RKIEQINLAS

201  GQREAEIQQS EGEAQAAVNA SNAEKIARIN RAKGEAESLR LVAEANAEAI

251  RQIAAALQTQ GGADAVNLKI AEQYVAAFNN LAKESNTLIM PANVADIGSL

301  ISAGMKIIDS SKTAK*
```

---

| m519-1/a519-1 ORFs 519-1 and 519-1.a showed a 99.0% identity in 315 aa overlap |
|---|

```
                    10         20         30         40         50         60
a519-1.pep  MEFFIILLAAVVVFGFKSFVVIPQQEVHVVERLGRFHRALTAGLNILIPFIDRVAYRHSL
            ||||||||:||:||||||||||||||||||||||||||||||||||||||||||||:|||
m519-1      MEFFIILLVAVAVFGFKSFVVIPQQEVHVVERLGRFHRALTAGLNILIPFIDRVATRHSL
                    10         20         30         40         50         60

70         80         90        100        110        120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70         80         90        100        110        120

130        140        150        160        170        180
a519-1.pep  RMFLDKTFEERDEINSTVVSALDFAAGAWGVKVLRYEIKDLVPPQEILRSMQAQITAERE
            |||||||||||||||||||:||||||||||||||||||||||||||||||||||||||||
m519-1      RMFLDKTFEERDEINSTVVAALDFAAGAWGVKVLRYEIKDLVPPQEILRSMQAQITAERE
                   130        140        150        160        170        180

190        200        210        220        230        240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190        200        210        220        230        240

250        260        270        280        290        300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250        260        270        280        290        300

310
a519-1.pep  ISAGMKIIDSSKTAKX    SEQ ID NO: 979
            ||||||||||||||||
m519-1      ISAGMKIIDSSKTAKX    SEQ ID NO: 975
                   310
```

576 and 576-1 gnm22.seq

The following partial DNA sequence was identified in *N. meningitidis* <SEQ ID 980>:

```
m576.seq . . . (partial)
    1 . . . ATGCAGCAGG CAAGCTATGC GATGGGCGTG GACATCGGAC GCTCCCTGAA

51        GCAAATGAAG GAACAGGGCG CGGAAATCGA TTTGAAAGTC TTTACCGAAG

101        CCATGCAGGC AGTGTATGAC GGCAAAGAAA TCAAAATGAC CGAAGAGCAG

151        GCTCAGGAAG TCATGATGAA ATTCCTTCAG GAACAACAGG CTAAAGCCGT

201        AGAAAAACAC AAGGCGGACG CGAAGGCCAA TAAAGAAAAA GGCGAAGCCT

251        TTCTGAAAGA AAATGCCGCC AAAGACGGCG TGAAGACCAC TGCTTCCGGC

301        CTGCAATACA AAATCACCAA ACAGGGCGAA GGCAAACAGC CGACCAAAGA

351        CGACATCGTT ACCGTGGAAT ACGAAGGCCG CCTGATTGAC GGTACGGTAT

401        TCGACAGCAG CAAAGCCAAC GGCGGCCCGG TCACCTTCCC TTTGAGCCAA

451        GTGATTCCGG GTTGGACCGA AGgCGTACAG CTTCTGAAAG AAGGCGGCGA

501        AGCCACGTTC TACATCCCGT CCAACCTTGC CTACCGCGAA CAGGGTGCGG

551        GCGACAAAAT CGGTCCGAAC GCCACTTTGG TATTTGATGT GAAACTGGTC

601        AAAATCGGCG CACCCGAAAA CGCGCCCGCC AAGCAGCCGG CTCAAGTCGA

651        CATCAAAAAA GTAAATTAA
```

This corresponds to the amino acid sequence <SEQ ID 981; ORF 576>:

```
m576.pep . . . (partial)
    1 . . . MQQASYAMGV DIGRSLKQMK EQGAEIDLKV FTEAMQAVYD GKEIKMTEEQ

51        AQEVMMKFLQ EQQAKAVEKH KADAKANKEK GEAFLKENAA KDGVKTTASG

101        LQYKITKQGE GKQPTKDDIV TVEYEGRLID GTVFDSSKAN GGPVTFPLSQ

151        VIPGWTEGVQ LLKEGGEATF YIPSNLAYRE QGAGDKIGPN ATLVFDVKLV

201        KIGAPENAPA KQPAQVDIKK VN*
```

The following partial DNA sequence was identified in *N. gonorrhoeae* <SEQ ID 982>:

```
g576.seq . . . (partial)
    1 . . . atgggcgtgg acatcggacg ctccctgaaa caaatgaagg aacaggcgc 51        ggaaatcgat ttgaaagtct ttaccgatgc catgcaggca gtgtatgacg 101        gcaaagaaat caaaatgacc gaagagcagg cccaggaagt gatgatgaaa 151        ttcctgcagg agcagcaggc taaagccgta gaaaacaca aggcggatgc 201        gaaggccaac aaagaaaaag gcgaagcctt cctgaaggaa aatgccgccg 251        aagacggcgt gaagaccact gcttccggtc tgcagtacaa aatcaccaaa 301        cagggtgaag gcaaacagcc gacaaaagac gacatcgtta ccgtggaata 351        cgaaggccgc ctgattgacg gtaccgtatt cgacagcagc aaagccaacg 401        gcggcccggc caccttccct ttgagccaag tgattccggg ttggaccgaa 451        ggcgtacggc ttctgaaaga aggcggcgaa gccacgttct acatcccgtc 501        caaccttgcc taccgcgaac agggtgcggg cgaaaaaatc ggtccgaacg
```

```
551       ccactttggt atttgacgtg aaactggtca aaatcggcgc acccgaaaac 601       gcgcccgcca agcagccgga tcaagtcgac atcaaaaaag taaattaa
```

This corresponds to the amino acid sequence <SEQ ID 983; ORF 576.ng>:

```
g576.pep . . . (partial)
   1 . . . MGVDIGRSLK QMKEQGAEID LKVFTDAMQA VYDGKEIKMT EEQAQEVMMK

51       FLQEQQAKAV EKHKADAKAN KEKGEAFLKE NAAEDGVKTT ASGLQYKITK

101       QGEGKQPTKD DIVTVEYEGR LIDGTVFDSS KANGGPATFP LSQVIPGWTE

151       GVRLLKEGGE ATFYIPSNLA YREQGAGEKI GPNATLVFDV KLVKIGAPEN

201       APAKQPDQVD IKKVN*
```

Computer analysis of this amino acid sequence gave the following results: Homology with a predicted ORF from *N. gonorrhoeae*

```
                       m576/g576 97.2% identity in 215 aa overlap 10         20         30         40         50         60
m576.pep  MQQASYAMGVDIGRSLKQMKEQGAEIDLKVFTEAMQAVYDGKEIKMTEEQAQEVMMKFLQ
                 ||||||||||||||||||||||||||:|||||||||||||||||||||||||||
g576             MGVDIGRSLKQMKEQGAEIDLKVFTDAMQAVYDGKEIKMTEEQAQEVMMKFLQ
                         10         20         30         40         50

70         80         90        100        110        120
m576.pep  EQQAKAVEKHKADAKANKEKGEAFLKENAAKDGVKTTASGLQYKITKQGEGKQPTKDDIV
          ||||||||||||||||||||||||||||||:|||||||||||||||||||||||||||||
g576      EQQAKAVEKHKADAKANKEKGEAFLKENAAEDGVKTTASGLQYKITKQGEGKQPTKDDIV
              60         70         80         90        100        110

130        140        150        160        170        180
m576.pep  TVEYEGRLIDGTVFDSSKANGGPVTFPLSQVIPGWTEGVQLLKEGGEATFYIPSNLAYRE
          |||||||||||||||||||||||:|||||||||||||||:||||||||||||||||||||
g576      TVEYEGRLIDGTVFDSSKANGGPATFPLSQVIPGWTEGVRLIKEGGEATFYIPSNLAYRE
              120        130        140        150        160        170

190        200        210        220
m576.pep  QGAGDKIGPNATLVFDVKLVKIGAPENAPAKQPAQVDIKKVNX   SEQ ID NO: 981
          ||||:|||||||||||||||||||||||||||||| ||||||||
g576      QGAGEKIGPNATLVFDVKLVFDVKLVKIGAPENAPAKQPDQVDIKKVNX   SEQ ID NO: 983
              180        190        200        200
```

The following partial DNA sequence was identified in *N. meningitidis* <SEQ ID 984>:

```
a576.seq
   1 ATGAACACCA TTTTCAAAAT CAGCGCACTG ACCCTTTCCG CCGCTTTGGC

51 ACTTTCCCCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT
```

```
-continued
401 TTCTGAAAGA AAATGCCGCC AAAGACGGCG TGAAGACCAC TGCTTCCGGC
451 CTGCAATACA AAATCACCAA ACACGGCGAA GGCAAACAGC CGACCAAAGA
501 CGACATCGTT ACCGTGGAAT ACGAAGGCCG CCTGATTGAC GGTACGGTAT
551 TCGACAGCAC CAAACCCAAC GGCGGCCCGG TCACCTTCCC TTTGAGCCAA
601 GTGATTCTGG GTTGGACCGA AGGCGTACAG CTTCTGAAAG AAGGCGGCGA
651 AGCCACGTTC TACATCCCGT CCAACCTTGC CTACCGCGAA CAGGGTGCGG
701 GCGACAAAAT CGGCCCGAAC GCCACTTTGG TATTTGATGT GAAACTGGTC
751 AAAATCGGCG CACCCGAAAA CGCGCCCGCC AAGCAGCCGG CTCAAGTCGA
801 CATCAAAAAA GTAAATTAA
```

This corresponds to the amino acid sequence <SEQ ID 985; ORF 576.a>:
a576.pep

```
  1 MNTIFKISAL TLSAALALSA CGKKEAAPAS ASEPAAASSA QGDTSSIGST

51 MQQASYAMGV DIGRSLKQMK EQGAEIDLKV FTEAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VILGWTEGVQ LLKEGGEATF YIPSNLAYRE QGAGDKIGPN ATLVFDVKLV

251 KIGAPENAPA KQPAQVDIKK VN*
```

--- m576/a576 ORFs 576 and 576.a showed a 99.5% identity in 222 aa overlap

```
                            10          20          30
m576.pep                    MQQASYAMGVDIGRSLKQMKEQGAEIDLKV
                            ||||||||||||||||||||||||||||||
a576      CGKKEAAPASASEPAAASSAQGDTSSIGSTMQQASYAMGVDIGRSLKQMKEQGAEIDLKV
              30        40        50        60        70        80

40        50        60        70        80        90
m576.pep  FTEAMQAVYDGKEIKMTEEQAQEVMMKFLQEQQAKAVEKHKADAKANKEKGEAFLKENAA
          ||||||||||||||||||||||||||||||||||||||||||||||||||||||||||||
a576      FTEAMQAVYDGKEIKMTEEQAQEVMMKFLQEQQAKAVEKHKADAKANKEKGEAFLKENAA
                  90       100       110       120       130       140

100       110       120       130       140       150
m576.pep  KDGVKTTASGLQYKITKQGEGKQPTKDDIVTVEYEGRLIDGTVFDSSKANGGPVTFPLSQ
          || |||||||||||||||||||||||||||||||||||||||||||||||||||||||||
a576      KDFVKTTASGLQYKITKQGEGKQPTKDDIVTVEYEGRLIDGTVFDSSKANGGPVTFPLSQ
                 150       160       170       180       190       200

160       170       180       190       200       210
m576.pep  VIPGWTEGVQLLKEGGEATFYIPSNLAYREQGAGDKIGPNATLVFDVKLVKIGAPENAPA
          || |||||||||||||||||||||||||||||||||||||||||||||||||||||||||
a576      VILGWTEGVQLLKEGGEATFYIPSNLAYREQGAGDKIGPNATLVFDVKLVKIGAPENAPA
                 210       220       230       240       250       260

220
m576.pep  KQPAQVDIKKVNX   SEQ ID NO: 981
          |||||||||||||
a576      KQPAQVDIKKVNX   SEQ ID NO: 985
                 270
```

Further work revealed the following DNA sequence identified in *N. meningitidis* <SEQ ID 986>:

```
m576-1.seq
    1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC CCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AACGCGGACC CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCCCG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGTCCGAAC GCCACTTTGG TATTTGATGT GAAACTGGTC

751 AAAATCGGCG CACCGGAAAA CGCGCCCGCC AAGCAGCCGG CTCAAGTCGA

801 CATCAAAAAA GTAAATTAA
```

This corresponds to the amino acid sequence <SEQ ID 987; ORF 576-1>:

```
m576-1.pep
    1 MNTIFKISAL TLSAALALSA CGKKEAAPAS ASEPAAASSA QGDTSSIGST

51 MQQASYANGV DIGRSLKQMK EQGAEIDLKV FTEAMQAVYD GKEIKMTEEQ

101 AQEVNMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VIPGWTEGVQ LLKEGGEATF YIPSNLAYRE QGAGDKIGPN ATLVFDVKLV

251 KIGAPENAPA KQPAQVDIKK VN*
```

The following DNA sequence was identified in *N. gonorrhoeae* <SEQ ID 988>:

```
g576-1.seq
    1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTGCCGCG CAGGGCGACA CCTCTTCAAT CGGCAGCACG

151 ATGCAGCAGG CAAGCTATGC AATGGGCGTG GACATCGGAC GCTCCCTGAA

201 ACAAATGAAG GAACAGGGCG CGGAAATCGA TTTGAAAGTC TTTACCGATG

251 CCATGCAGGC AGTGTATGAC GGCAAAGAAA TCAAAATGAC CGAAGAGCAG

301 GCCCAGGAAG TGATGATGAA ATTCCTGCAG GAGCAGCAGG CTAAAGCCGT
```

```
-continued
351 AGAAAAACAC AAGGCGGATG CGAAGGCCAA CAAAGAAAAA GGCGAAGCCT

401 TCCTGAAGGA AATGCCGCC AAAGACGGCG TGAACACCAC TGCTTCCGGT

451 CTGCAGTACA AAATCACCAA ACAGGGTGAA CGCAAACAGC CGACAAAAGA

501 CGACATCGTT ACCGTGGAAT ACGAAGGCCG CCTGATTGAC GGTACCGTAT

551 TCGACAGCAG CAAAGCCAAC GGCGGCCCGG CCACCTTCCC TTTGAGCCAA

601 GTGATTCCGG GTTGGACCGA AGGCGTACGG CTTcTGAAAG AAGGCGGCGA

651 AGCCACGTTC TACATCCCGT CCAACCTTGC CTACCGCGAA CAGGGTGCGG

701 GCGAAAAAAT CGGTCCGAAC GCCACTTTCG TATTTGACCT GAAACTGGTC

751 AAAATCGGCG CACCCGAAAA CGCGCCCGCC AAGCAGCCGG ATCAAGTCGA

801 CATCAAAAAA GTAAATTAA
```

This corresponds to the amino acid sequence <SEQ ID 989; ORF 576-1.ng>:
g576-1

```
  1 MNTIFKISAL TLSAALALSA CGKKEAAPAS ASEPAAASAA QGDTSSIGST

51 MQQASYAMGV DIGRSLKQMK EQGAEIDLKV FTDAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPATFPLSQ

201 VIPGWTEGVR LLKEGGEATF YIPSNLAYRE QGAGEKIGPN ATLVFDVKLV

251 KIGAPENAPA KQPDQVDIKK VN*
```

| g576-1/m576-1 ORFs 576-1 and 576-1.ng showed a 97.8% identity in 272 aa overlap |
|---|
| ```
              10         20         30         40         50         60
g576-1.pep   MNTIFKISALTLSAALALSACGKKEAAPASASEPAAASAAQGDTSSIGSTMQQASYAMGV
             ||||||||||||||||||||||||||||||||||||||||:|||||||||||||||||||
m576-1       MNTIFKISALTLSAALALSACGKKEAAPASASEPAAASSAQGDTSSIGSTMQQASYAMGV
              10         20         30         40         50         60

70         80         90        100        110        120
g576-1.pep   DIGRSLKQMKEQGAEIDLKVFTDAMQAVYDGKEIKMTEEQAQEVMMKFLQEQQAKAVEKH
             |||||||||||||||||||||:||||||||||||||||||||||||||||||||||||||
m576-1       DIGRSLKQMKEQGAEIDLKVFTEAMQAVYDGKEIKMTEEQAQEVMMKFLQEQQAKAVEKH
              70         80         90        100        110        120

130        140        150        160        170        180
g576-1.pep   KADAKANKEKGEAFLKFNAAKDGVKTTASGLQYKITKQGEGKQPTKDDIVTVEYEGRLID
             ||||||||||||||||||||||||||||||||||||||||||||||||||||||||||||
m576-1       KADAKANKEKGEAFLKFNAAKDGVKTTASGLQYKITKQGEGKQPTKDDIVTVEYEGRLID
             130        140        150        160        170        180

190        200        210        220        230        240
g576-1.pep   GTVFDSSKANGGPATFPLSQVIPGWTEGVRLLKEGGEATFYIPSNLAYREQGAGEKIGPN
             ||||||||||||:|||||||||||||||||:|||||||||||||||||||||||:||||
m576-1       GTVFDSSKANGGPVTFPLSQVIPGWTEGVQLLKEGGEATFYIPSNLAYREQGAGDKIGPN
             190        200        210        220        230        240

250        260        270
g576-1.pep   ATLVFDVKLVKIGAPENAPAKQPDQVDIKKVNX   SEQ ID NO: 989
             ||||||||||||||||||||||||:|||||||
m576-1       ATLVFDVKLVKIGAPENAPAKQPAQVDIKKVNX   SEQ ID NO: 987
             250        260        270
``` |

The following DNA sequence was identified in N. meningitidis <SEQ ID 990>:

```
a576-1.seq
  1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGrG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCTT

401 TTCTGAAAGA AAATGCCGCC AAAGACGGCG TGAACACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCCG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 991; ORF 576-1.a>:

a576-1 pep

```
  1 MNTIFKISAL TLSAALALSA CGKKEAAPAS ASEPAAASSA QGDTSSIGST

51 MQQASYAMGV DIGRSLKQMK EQGAEIDLKV FTEAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VILGWTEGVQ LLKEGGEATF YIPSNLAYRE QGAGDKIGPN ATLVFDVKLV

251 KIGAPENAPA KQPAQVDIKK VN*
```

| a576-1/m576-1 ORFs 576-1 and 576-1.a 99.6% identity in 272 aa overlap |
|---|
|                    10         20         30         40         50         60 |

```
                  10        20        30        40        50        60
a576-1.pep   MNTIFKISALTLSAALALSACGKKEAAPASASEPAAASSAQGDTSSIGSTMQQASYAMGV
             ||||||||||||||||||||||||||||||||||||||||||||||||||||||||||||
m576-1       MNTIFKISALTLSAALALSACGKKEAAPASASEPAAASSAQGDTSSIGSTMQQASYAMGV
                  10        20        30        40        50        60

70        80        90       100       110       120
a576-1.pep   DIGRSLKQMKEQGAEIDLKVFTEAMQAVYDGKEIKMTEEQAQEVMMKFLQEQQAKAVEKH
             ||||||||||||||||||||||||||||||||||||||||||||||||||||||||||||
m576-1       DIGRSLKQMKEQGAEIDLKVFTEAMQAVYDGKEIKMTEEQAQEVMMKFLQEQQAKAVEKH
                  70        80        90       100       110       120

130       140       150       160       170       180
a576-1.pep   KADAKANKEKGEAFLKENAAKDGVKTTASGLQYKITKQGEGKQPTKDDIVTVEYEGRLID
             ||||||||||||||||||||||||||||||||||||||||||||||||||||||||||||
m576-1       KADAKANKEKGEAFLKENAAKDGVKTTASGLQYKITKQGEGKQPTKDDIVTVEYEGRLID
                 130       140       150       160       170       180
```

-continued

| a576-1/m576-1 ORFs 576-1 and 576-1.a 99.6% identity in 272 aa overlap |
|---|

```
                190       200       210       220       230       240
a576-1.pep  GTVFDSSKANGGPVTFPLSQVILGWTEGVQLLKEGGEATFYIPSNLAYREQGAGDKIGPN
            ||||||||||||||||||||||| ||||||||||||||||||||||||||||||||||||
m576-1      GTVFDSSKANGGPVTFPLSQVIPGWTEGVQLLKEGGEATFYIPSNLAYREQGAGDKIGPN
                190       200       210       220       230       240

250       260       270
a576-1.pep  ATLVFDVKLVKIGAPENAPAKQPAQVDIKKVNX      SEQ ID NO: 991
            ||||||||||||||||||||||||||||||||
m576-1      ATLVFDVKLVKIGAPENAPAKQPAQVDIKKVNX      SEQ ID NO: 987
                250       260       270
```

919 and 919-2.

The following partial DNA sequence was identified in *N. meningitidis* <SEQ ID 992>:

```
m919.seq
   1 ATGAAAAAAT ACCTATTCCG CGCCGCCCTG TACGGCATCG CCGCCGCCAT

51 CCTCGCCGCC TGCCAAAGCA AGAGCATCCA AACCTTTCCG CAACCCGACA

101 CATCCGTCAT CAACGGCCCG GACCGGCCGG TCGGCATCCC CGACCCCGCC

151 GGAACGACGG TCGGCGGCGG CGGGGCCGTC TATACCGTTG TACCGCACCT

201 GTCCCTGCCC CACTGGGCGG CGCAGGATTT CGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTCCAT TCCTTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 QGGAOGQCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCCG ATTCCCCATC ACCGCGCGCA CAACAGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCTG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCyTA CGTTTCCATC GGACGCTATA TGGCGGATAA GGGCTACCTC

901 AAACTCGGAC AAACCTCCAT GCAGGGCATT AAGTCTTATA TGCGGCAAAA

951 TCCGCAACGC CTCGCCGAAG TTTFGGGTCA AACCCCAGC TATATCTTTT

1001 TCCGCGAGCT TGCCGGAAGC AGCAATGACG GCCCTGTCGG CGCACTGGGC

1051 ACGCCQCTGA TGGGGGAATA TGCCGGCGCA GTCGACCGGC ACTACATTAC

1101 CTTGGGTGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTC CTACCCAACG

1301 GTATGAAGCC CGAATACCGC CCGTAA
```

This corresponds to the amino acid sequence <SEQ ID 993; ORF 919>:

```
m919.pep
  1 MKKYLFRAAL YGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SFQAKQFFER YFTPWQVAGN GSLAGTVTGY YEPVLKGDDR

151 RTAQARPPIY GIPDDFISVP LPAGLRSGKA LVRIRQTGKN SGTIDNTGGT

201 HTADLSRFPI TARTTAIKGR FEGSRPLPYH TRNQINGGAL DGKAPILGYA

251 EDPVELEFNH IQGSGRLKTP SGKYIRIGYA DKNEHPYVSI GRYMADKGYL

301 KLGQTSMQGI KSYMRQNPQR LAEVLGQNPS YIPFRELAGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

The following partial DNA sequence was identified in *N. meningitidis* <SEQ ID 994>:

```
m919-2.seq
   1 ATGAAAAAAT ACCTATTCCG CGCCGCCCTG TACGGCATCG CCGCCGCCAT

51 CCTCGCCGCC TGCCAAAGCA AGAGCATCCA AACCTTTCCG CAACCCGACA

101 CATCCGTCAT CAACGGCCCG GACCGGCCGG TCGGCATCCC CGACCCCGCC

151 GGAACGACGG TCGGCGGCGG CGGGGCCGTC TATACCGTTG TACCGCACCT

201 GTCCCTGCCC CACTGGGCGG CGCAGGATTT CGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTCCAT TCCTTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 CGGACGGCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCCG ATTCCCCATC ACCGCGCGCA CAACAGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCTG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCCTA CGTTTCCATC GGACGCTATA TGGCGGATAA GGGCTACCTC

901 AAACTCGGAC AAACCTCCAT GCAGGGCATT AAGTCTTATA TGCGGCAAAA

951 TCCGCAACGC CTCGCCGAAG TTTTGGGTCA AAACCCCAGC TATATCTTTT

1001 TCCGCGAGCT TGCCGGAAGC AGCAATGACG GCCCTGTCGG CGCACTGGGC

1051 ACGCCGCTGA TGGGGGAATA TGCCGGCGCA GTCGACCGGC ACTACATTAC

1101 CTTGGGTGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT
```

-continued
```
1251 TGCCGGCAAA CAGAAAACCA CGGGATATGT CTGGCAGCTC CTACCCAACG

1301 GTATGAAGCC CGAATACCGC CCGTAA
```

This corresponds to the amino acid sequence <SEQ ID 995; ORF 919-2>:

```
m919-2.pep
   1 MKKYLFRAAL YGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SFQAFQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KSYMRQNPQR LAEVLGQNPS YIFFRELAGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

The following partial DNA sequence was identified in *N. gonorrhoeae* <SEQ ID 996>:

```
g919.seq
     1 ATGAAAAAAC ACCTGCTCCG CTCCGCCCTG TACGGcatCG CCGCCgccAT

51 CctcgCCGCC TGCCAAAgca gGAGCATCCA AACCTTTCCG CAACCCGACA

101 CATCCGTCAT CAACGGCCCG GACCGGCCGG CCGGCATCCC CGACCCCGCC

151 GGAACGACGG TTGCCGGCGG CGGGGCCGTC TATACCGTTG TGCCGCACCT

201 GTCCATGCCC CACTGGGCGG CGCaggATTT TGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTGCAT TCCTTTCAGG CAAAGcGgTT

351 TTTTGAACGC TATTTCACGC cgtGGCaggt tgcaggcaAC GGAAGcCTTG

401 Caggtacggt TACCGGCTAT TACGAACCGG TGCTGAAGGG CGACGGCAGG

451 CGGACGGAAC GGGCCCGCTT CCCGATTTAC GGTATTCCCG ACGATTTTAT

501 CTCCGTCCCG CTGCCTGCCG GTTTGCGGGG CGGAAAAAAC CTTGTCCGCA

551 TCAGGCAGac ggGGAAAAAC AGCGGCACGA TCGACAATGC CGGCGGCACG

601 CATACCGCCG ACCTCTCCCG ATTCCCCATC ACCGCGCGCA CAACGGcaat 651 caaaGGCAGG TTTGAaggAA GCCGCTTCCT CCCTTACCAC ACGCGCAACC 701 AAAtcaacGG CGGCGcgcTT GACGGCAAag cccCCATCCT CggttacgcC 751 GAagaccCcG tcgaacttTT TTTCATGCAC AtccaaggCT CGGGCCGCCT 801 GAAAACCCcg tccggcaaat acatCCGCAt cggaTacgcc gacAAAAACG 851 AACAtccgTa tgtttccatc ggACGctaTA TGGCGGACAA AGGCTACCTC 901 AAGctcgggc agACCTCGAT GCAGGgcatc aaagcCTATA TGCGGCAAAA

951 TCCGCAACGC CTCGCCGAAG TTTTGGGTCA AAACCCCAGC TATATCTTTT

1001 TCCGCGAGCT TGCCGGAAGC GGCAATGAGG GCCCCGTCGG CGCACTGGGC

1051 ACGCCACTGA TGGGGGAATA CGCCGGCGCA ATCGACCGGC ACTACATTAC
```

-continued

```
1101 CTTGGGCGCG CCCTTATTTG TCGCCACCGC CCATCCGGTT ACCCGCAAAG

1151 CCCTCAACCG CCTGATTATG GCGCAGGATA CAGGCAGCGC GATCAAAGGC

1201 GCGGTGCGCG TGGATTATTT TTGGGGTTAC GGCGACGAAG CCGGCGAACT

1251 TGCCGGCAAA CAGAAAACCA CGGGATACGT CTGGCAGCTC CTGCCCAACG

1301 GCATGAAGCC CGAATACCGC CCGTGA
```

This corresponds to the amino acid sequence <SEQ ID 997; ORF 919.ng>:

```
g919.pep
    1 MKKHLLRSAL YGIAAAILAA CQSRSIQTFP QPDTSVINGP DRPAGIPDPA

51 GTTVAGGGAV YTVVPHLSMP HWAAQDFAKS LQSFRLGCAN LKNRQGWQDV

101 CAQAFQTPVH SFQAKRFFER YFTPWQVAGN GSLAGTVTGY YEPVLKGDGR

151 RTERARFPIY GIPDDPISVP LPAGLRGGKN LVRIRQTGKN SGTIDNAGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMRQNPQR LAEVLGQNPS YIFFRELAGS GNEGPVGALG

351 TPLMGEYAGA IDRHYITLGA PLFVATAHPV TRKALNRLIM AQDTGSAIKG

401 AVRVDYFWGY GDEAGELAGK QKTTGYVWQL LPNGMKPEYR P*
```

---

ORF 919 shows 95.9% identity over a 441 aa overlap with a predicted ORF (ORF 919.ng) from *N. gonorrhoeae*:
m919/g919

```
                 10         20         30         40         50         60
m919.pep MKKYLFRAALYGIAAAILAACQSKSIQTFPQPDTSVINGPDRPVGIPDPAGTTVGGGGAV
         |||:|:|:||||||||||||||:||||||||||||||||||:|||||||||:||||
g919     MKKHLLRSALYGIAAAILAACQSRSIQTFPQPDTSVINGPDRPAGIPDPAGTTVAGGGAV
                 10         20         30         40         50         60

70         80         90        100        110        120
m919.pep YTVVPHLSLPHWAAQDFAKSLQSFRLGCANLKNRQGWQDVCAQAFQTPVHSFQAKQFFER
         ||||||||:||||||||||||||||||||||||||||||||||||||||||||:||||
g919     YTVVPHLSMPHWAAQDFAKSLQSFRLGCANLKNRQGWQDVCAQAFQTPVHSFQAKRFFER
                 70         80         90        100        110        120

130        140        150        160        170        180
m919.pep YFTPWQVAGNGSLAGTVTGYYEPVLKGDDRRTAQARFPIYGIPDDPISVPLPAGLRGGKA
         |||||||||||||||||||||||||||| |||:||||||||||||||||||||||:||
g919     YFTPWQVAGNGSLAGTVTGYYEPVLKGDGRRTERARFPIYGIPDDPISVPLPAGLRGGKN
                130        140        150        160        170        180

190        200        210        220        230        240
m919.pep LVRIRQTGKNSGTIDNTGGTHTADLSRFPITARTTAIKGRFEGSRFLPYHTRNQINGGAL
         ||||||||||||||||:|||||||||||||||||||||||||||||||||||||||||
g919     LVRIRQTGKNSGTIDNAGGTHTADLSRFPITARTTAIKGRFEGSRFLPYHTRNQINGGAL
                190        200        210        220        230        240

250        260        270        280        290        300
m919.pep DGKAPILGYAEDPVELFFMHIQGSGRLKTPSGKYIRIGYADKNEHPYVSIGRYMADKGYL
         ||||||||||||||||||||||||||||||||||||||||||||||||||||||||||
g919     DGKAPILGYAEDPVELFFMHIQGSGRLKTPSGKYIRIGYADKNEHPYVSIGRYMADKGYL
                250        260        270        280        290        300

310        320        330        340        350        360
m919.pep KLGQTSMQGIKSYMRQNPQRLAEVLGQNPSYIFFRELAGSSNDGPVGALGTPLMGEYAGA
         ||||||||||:|||||||||||||||||||||||||||::|||||||||||||||||
g919     KLGQTSMQGIKAYMRQNPQRLAEVLGQNPSYIFFRELAGSGNEGPVGALGTPLMGEYAGA
                310        320        330        340        350        360
```

-continued

ORF 919 shows 95.9% identity over a 441 aa overlap with a predicted ORF (ORF 919.ng) from
*N. gonorrhoeae*:
m919/g919

```
                370        380        390        400        410        420
m919.pep   VDRHYITLGAPLFVATAHPVTRKALNRLIMAQDTGSAIKGAVRVDYFWGYGDEAGELAGK
           :|||||||||||||||||||||||||||||||||||||||||||||||||||||||||||
g919       IDRHYITLGAPLFVATAHPVTRKALNRLIMAQDTGSAIKGAVRVDYFWGYGDEAGELAGK
                370        380        390        400        410        420

430        440
m919.pep   QKTTGYVWQLLPNGMKPEYRPX    SEQ ID NO: 993
           |||||||||||||||||||||||
g919       QKTTGYVWQLLPNGMKPEYRPX    SEQ ID NO: 997
                430        440
```

The following partial DNA sequence was identified in *N. meningitidis* <SEQ ID 998>:

```
a919.seq
    1 ATGAAAAAAT ACCTATTCCG CGCCGCCCTG TGCGGCATCG CCGCCGCCAT

51 CCTCGCCGCC TGCCAAAGCA AGAGCATCCA AACCTTTCCG CAACCCGACA

101 CATCCGTCAT CAACGGCCCG GACCGGCCGG TCGGCATCCC CGACCCCGCC

151 GGAACGACGG TCGGCGGCGG CGGGGCCGTT TATACCGTTG TGCCGCACCT

201 GTCCCTGCCC CACTGGGCGG CGCAGGATTT CGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTCCAT TCCGTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAGCCGG TGCTGAAGGG CGACGACAGG

451 CGGACGGCAC AAGCCCGCTT CCCGATTTAC GGTATTCCCG ACGATTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCCA ATTCCCCATC AGTGCGCGCA CAACGGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCCG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCCTA CGTTTCCATC GGACGCTATA TGGCGGACAA AGGCTACCTC

901 AAGCTCGGGC AGACCTCGAT GCAGGGCATC AAAGCCTATA TGCAGCAAAA

951 CCCGCAACGC CTCGCCGAAG TTTTGGGGCA AAACCCCAGC TATATCTTTT

1001 TCCGAGAGCT TACCGGAAGC AGCAATGACG GCCCTGTCGG CGCACTGGGC

1051 ACGCCGCTGA TGGGCGAGTA CGCCGGCGCA GTCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CCGGCAGCGC GATTAAGGC

1201 GCGGTGCGCG TGGATTATTT TTGGGGATAC GCGCGACGAAG CCGGCGAACT

1251 TGCCGGCAAA CAGAAAACCA CGGGATATGT CTGGCAGCTT CTGCCCAACG

1301 GTATGAAGCC CGAATACCGC CCGTAA
```

This corresponds to the amino acid sequence <EQ ID 999; ORF 919.a>:

a919.pep

```
  1 MKKYLFRAAL CGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SVQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSQFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMQQNPQR LAEVLGQNPS YIFFRELTGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

```
           m919/a919 ORFs 919 and 919.a showed a 98.6% identity in
                              441 aa overlap 10         20         30         40         50         60
m919.pep  MKKYLFRAALYGIAAAILAACQSKSIQTFPQPDTSVINGPDRPVGIPDPAGTTVGGGGAV
          ||||||||||  |||||||||||||||||||||||||||||||||||||||||||||||
a919      MKKYLFRAALCGIAAAILAACQSKSIQTFPQPDTSVINGPDRPVGIPDPAGTTVGGGGAV
                 10         20         30         40         50         60

70         80         90        100        110        120
m919.pep  YTVVPHLSLPHWAAQDFAKSLQSFRLGCANLKNRQGWQDVCAQAFQTPVHSFQAKQFFER
          ||||||||||||||||||||||||||||||||||||||||||||||||||| ||||||||
a919      YTVVPHLSLPHWAAQDFAKSLQSFRLGCANLKNRQGWQDVCAQAFQTPVHSVQAKQFFER
                 70         80         90        100        110        120

130        140        150        160        170        180
m919.pep  YFTPWQVAGNGSLAGTVTGYYEPVLKGDDRRTAQARFPIYGIPDDFISVPLPAGLRSGKA
          ||||||||||||||||||||||||||||||||||||||||||||||||||||||||||||
a919      YFTPWQVAGNGSLAGTVTGYYEPVLKGDDRRTAQARFPIYGIPDDFISVPLPAGLRSGKA
                130        140        150        160        170        180

190        200        210        220        230        240
m919.pep  LVRIRQTGKNSGTIDNTGGTHTADLSRFPITARTTAIKGRFEGSRFLPYHTRNQINGGAL
          |||||||||||||||||||||||||| :||||||||||||||||||||||||||||||||
a919      LVRIRQTGKNSGTIDNTGGTHTADLSQFPITARTTAIKGRFEGSRFLPYHTRNQINGGAL
                190        200        210        220        230        240

250        260        270        280        290        300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
a919      DGKAPILGYAEDPVELFFMHIQGSGRLKTPSGKYIRIGYADKNEHPYVSIGRYMADKGYL
                250        260        270        280        290        300

310        320        330        340        350        360
m919.pep  KLGQTSMQGIKSYMRQNPQRLAEVLGQNPSYIFFRELAGSSNDGPVGALGTPLMGEYAGA
          ||||||||||| :||:||||||||||||||||||||||| ||||||||||||||||||||
a919      KLGQTSMQGIKAYMQQNPQRLAEVLGQNPSYIFFRELTGSSNDGPVGALGTPLMGEYAGA
                310        320        330        340        350        360

370        380        390        400        410        420
m919.pep  VDRHYITLGAPLFVATAHPVTRKALNRLIMAQDTGSAIKGAVRVDYFWGYGDEAGELAGK
          ||||||||||||||||||||||||||||||||||||||||||||||||||||||||||||
a919      VDRHYITLGAPLFVATAHPVTRKALNRLIMAQDTGSAIKGAVRVDYFWGYGDEAGELAGK
                370        380        390        400        410        420

430        440
m919.pep  QKTTGYVWQLLPNGMKPEYRPX  SEQ ID NO: 919
          ||||||||||||||||||||||
a919      QKTTGYVWQLLPNGMKPEYRPX  SEQ ID NO: 999
                430        440
```

121 and 121-1.

The following partial DNA sequence was identified in *N. meningitidis* <SEQ ID 1000>:

```
m121.seq
      1 ATGGAAACAC AGCTTTACAT CGGCATCATG TCGGGAACCA GCATGGACGG

51 GGCGGATGCC GTACTGATAC CGATGGACGG CGGCAAATGG CTGGGCGCGG

101 AAGGGCACGC CTTTACCCCC TACCCCGGCA GGTTACGCCG CCAATTGCTG

151 GATTTGCAGG ACACAGGCGC AGACGAACTG CACCGCAGCA GGATTTTGTC

201 GCAAGAACTC AGCCGCCTAT ATGCGCAAAC CGCCGCCGAA CTGCTGTGCA

251 GTCAAAACCT CGCACCGTCC GACATTACCG CCCTCGGCTG CCACGGGCAA

301 ACCGTCCGAC ACGCGCCGGA ACACGGTTAC AGCATACAGC TTGCCGATTT

351 GCCGCTGCTG GCGxxxxxxx xxxxxxxxxx xxxxxxxxxx xxxxxxxxxx 401 xxxxxxxxxx xxxxxxxxxx xxxxxxxxxx xxxxxxxxxx xxxxxxxxxx 451 xxxxxxxxxx xxxxxxxxxx xxxxxxxxxx xxxxxxxxxx xxxxxxxxxx 501 xxxxxxxxxx xxxxxxxxxx xxxxxxxxxx xxxxxxxxxx xxxxxxxxxx 551 xxxxxxxxxx xxxxxxxxxx xxxxxxxxxx xxxxxxxxxx xxxxxxxxxx 601 xxxxxxCAGC TTCCTTACGA CAAAAACGGT GCAAAGTCGG CACAAGGCAA

651 CATATTGCCG CAACTGCTCG ACAGGCTGCT CGCCCACCCG TATTTCGCAC

701 AACGCCACCC TAAAAGCACG GGGCGCGAAC TGTTTGCCAT AAATTGGCTC

751 GAAACCTACC TTGACGGCGG CGAAAACCGA TACGACGTAT TGCGGACGCT

801 TTCCCGTTTT ACCGCGCAAA CCGTTTGCGA CGCCGTCTCA CACGCAGCGG

851 CAGATGCCCG TCAAATGTAC ATTTGCGACG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGnATTTG

1001 CGTGGTTGGC GGCGTGTTGG ATTAATCGCA TTCCCGGTAG TCCGCACAAA

1051 GCAACCGGCG CATCCAAACC GTGTATTCTG AnCGCGGGAT ATTATTATTG

1101 A
```

This corresponds to the amino acid sequence <SEQ ID 1001; ORF 121>:

```
m121.pep
      1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL Axxxxxxxxx xxxxxxxxxx xxxxxxxxxx 151 xxxxxxxxxx xxxxxxxxxx xxxxxxxxxx xxxxxxxxxx xxxxxxxxxx 201 xxQLPYDKNG AKSAQGNILP QLLDRLLAHP YFAQRHPKST GRELFAINWL

251 ETYLDGGENR YDVLRTLSRF TAQTVCDAVS HAAADARQMY ICDGGIRNPV

301 LMADLAECFG TRVSLHSTAD LNLDPQWVEA AXFAWLAACW INRIPGSPHK

351 ATGASKPCIL XAGYYY*
```

The following partial DNA sequence was identified in *N. gonorrhoeae* <SEQ ID 1002>:

```
g121.seq
    1 ATGGAAACAC AGCTTTACAT CGGCATTATG TCGGGAACCA GTATGGACGG
   51 GGCGGATGCC GTGCTCGTAC GGATGGACGG CGGCAAATGG CTGGGCGCGG
  101 AAGGGCACGC CTTTACCCCC TACCCTGACC GGTTGCGCCG CAAATTGCTG
  151 GATTTGCAGG ACACAGGCAC AGACGAACTG CACCGCAGCA GGATGTTGTC
  201 GCAAGAACTC AGCCGCCTGT ACGCGCAAAC CGCCGCCGAA CTGCTGTGCA
  251 GTCAAAACCT CGCTCCGTGC GACATTACCG CCCTCGGCTG CCACGGGCAA
  301 ACCGTCCGAC ACGCGCCGGA ACACGGTtac AGCATACAGC TTGCCGATTT
  351 GCCGCTGCTG GCGGAACTGa cgcggatttT TACCGTCggc gacttcCGCA
  401 GCCGCGACCT TGCTGCCGGC GGacaAGGTG CGCCGCTCGT CCCCGCCTTT
  451 CACGAAGCCC TGTTCCGCGA TGACAGGGAA ACACGCGTGG TACTGAACAT
  501 CGGCGGGATT GCCAACATCA GCGTACTCCC CCCCGGCGCA CCCGCCTTCG
  551 GCTTCGACAC AGGGCCGGGC AATATGCTGA TGGAcgcgtg gacgcaggca
  601 cacTGGcagc TGCCTTACGA CAAAAacggt gcAAAGgcgg caCAAGGCAA
  651 catatTGCcg cAACTGCTCG gcaggctGCT CGCCcaccCG TATTTCTGAC
  701 AACCCcaccc aaAAAGCACG GGgcGCGaac TgtttgcccT AAattggctc
  751 gaaacctAcc ttgacggcgg cgaaaaccga tacgacgtat tgcggacgct
  801 ttcccgattc accgcgcaaA ccgTttggga cgccgtctca CACGCAGCGG
  851 CAGATGCCCG TCAAATGTAC ATTTGCGGCG GCGGCATCCG CAATCCTGTT
  901 TTAATGGCGG ATTTGGCAGA ATGTTTCGGC ACACGCGTTT CCCTGCACAG
  951 CACCGCCGAA CTGAACCTCG ATCCTCAATG GGTGGAGGCG gccgCATTtg
 1001 cgtggttggC GGCGTGTTGG ATTAACCGCA TTCCCGGTAG TCCGCACAAA
 1051 GCGACCGGCG CATCCAAACC GTGTATTCTG GGCGCGGGAT ATTATTATTG
 1101 A
```

This corresponds to the amino acid sequence <SEQ ID 1003; ORF 121.ng>:

```
g121.pep
    1 METQLYIGIM SGTSMDGADA VLVRMDGGKW LGAEGHAFTP YPDRLRRKLL
   51 DLQDTGTDEL HRSRMLSQEL SRLYAQTAAE LLCSQNLAPC DITALGCHGQ
  101 TVRHAPEHGY SIQLADLPLL AELTRIFTVG DFRSRDLAAG GQGAPLVPAF
  151 HEALFRDDRE TRVVLNIGGI ANISVLPPGA PAFGFDTGPG NMLMDAWTQA
  201 HWQLPYDKNG AKAAQGNILP QLLGRLLAHP YFSQPHPKST GRELFALNWL
  251 ETYLDGGENR YDVLRTLSRF TAQTVWDAVS HAAADARQMY ICGGIRNPV
  301 LMADLAECFG TRVSLHSTAE LNLDPQWVEA AAFAWLAACW INRIPGSPHK
  351 ATGASKPCIL GAGYYY*
```

```
ORF 121 shows 73.5% identity over a 366 aa overlap with a
      predicted ORF (ORF121.ng) from N. gonorrhoeae:
                          m121/g121

10        20        30        40        50        60
m121.pep  METQLYIGIMSGTSMDGADAVLIRMDGGKWLGAEGHAFTPYPGRLRRQLLDLQDTGADEL
          ||||||||||||||||||||:|||||||||||||||||||||||:||||||||:|||
g121      METQLYIGIMSGTSMDGADAVLVRMDGGKWLGAEGHAFTPYPDRLRRKLLDLQDTGTDEL
                 10        20        30        40        50        60

70        80        90       100       110       120
m121.pep  HRSRILSQELSRLYAQTAAELLCSQNLAPSDITALGCHGQTVRHAPEHGYSIQLADLPLL
          ||||:|||||||||||||||||||||||||:|||||||||||||||||||||||||||||
g121      HRSRMLSQELSRLYAQTAAELLCSQNLAPCDITALGCHGQTVRHAPEHGYSIQLADLPLL
                 70        80        90       100       110       120

130       140       150       160       170       180
m121.pep  AXXXXXXXXXXXXXXXXXXXXXXXXXXXXXXXXXXXXXXXXXXXXXXXXXXXXXXXXX
          |   :                                            :
g121      AELTRIFTVGDFRSRDLAAGGQGAPLVPAFHEALFRDDRETRVVLNIGGIANISVLPPGA
                130       140       150       160       170       180

190       200       210       220       230       240
m121.pep  XXXXXXXXXXXXXXXXXXXXXXXXQLPYDKNGAKSAQGNILPQLLDRLLAHPYFAQRHPKST
              :          :       ||||||||||:||||||||| ||||||||:|||||
g121      PAFGFDTGPGNMLMDAWTQAHWQLPYDKNGAKAAQGNILPQLLGRLLAHPYFSQPHPKST
                190       200       210       220       230       240

250       260       270       280       290       300
m121.pep  GRELFAINWLETYLDGGENRYDVLRTLSRFTAQTVCDAVSHAAADARQMYICDGGIRNPV
          |||||:||||||||||||||||||||||||||||| ||||||||||||||||:|||||||
g121      GRELFALNWLETYLDGGENRYDVLRTLSRFTAQTVWDAVSHAAADARQMYICGGGIRNPV
                250       260       270       280       290       300

310       320       330       340       350       360
m121.pep  LMADLAECFGTRVSLHSTADLNLDPQWVEAAXGAWLAACWINRIPGSPHKATGASKPCIL
          |||||||||||||||||||:|||||||||||| |||||||||||||||||||||||||||
g121      LMADLAECFGTRVSLHSTAELNLDPQWVEAAAFAWLAACWINRIPGSPHKATGASKPCIL
                310       320       330       340       350       360 m121.pep  XAGYYYX     SEQ ID NO: 1001
           |||||
g121      GAGYYYX     SEQ ID NO: 1003
```

The following partial DNA sequence was identified in N. meningitidis <SEQ ID 1004>:

```
a121.seq
    1 ATGGAAACAC AGCTTTACAT CGGCATCATG TCGGGAACCA GCATGGACGG

51 GGCGGATGCC GTACTGATAC GCATGGACGG CGGCAAATGG CTGGGCGCGG

101 AAGGGCACGC CTTTACCCCC TACCCCGGCA GGTTACGCCG CAAATTGCTG

151 GATTTGCAGG ACACAGGCGC GGACGAACTG CACCGCAGCA GGATGTTGTC

201 GCAAGAACTC AGCCGCCTGT ACGCGCAAAC CGCCGCCGAA CTGCTGTGCA

251 CTCAAAACCT CGCGCCGTCC GACATTACCG CCCTCGGCTG CCACGGGCAA

301 ACCGTCAGAC ACGCGCCGGA ACACAGTTAC AGCGTACAGC TTGCCGATTT

351 GCCGCTGCTG GCGGAACGGA CTCAGATTTT TACCGTCGGC GACTTCCGCA

401 GCCGCGACCT TGCGGCCGGC GGACAAGGCG CGCCGCTCGT CCCCGCCTTT

451 CACGAAGCCC TGTTCCGCGA CGACAGGGAA CACGCGCGG TACTGAACAT

501 CGGCGGGATT GCCAACATCA GCGTACTCCC CCCCGACGCA CCCGCCTTCG

551 GCTTCGACAC AGGACCGGGC AATATGCTGA TGGACGCGTG GATGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC
```

```
-continued
 701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 1005; ORF 121.a>:

```
a121.pep
   1 METQLYIGIM SGTSMDGADA VLIRMDGGKW LGAEGHAFTP YPGRLRRKLL

51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AAFAWMAACW VNRIPGSPHK

351 ATGASKPCIL GAGYYY*
```

```
                m121/a121 ORFs 121 and 121.a 74.0%
                       identity in 366 aa overlap 10        20        30        40        50        60
m121.pep  METQLYIGIMSGTSMDGADAVLIRMDGGKWLGAEGHAFTPYPGRLRRQLLDLQDTGADEL
          ||||||||||||||||||||||||||||||||||||||||||||||:||||||||||||
a121      METQLYIGIMSGTSMDGADAVLIRMDGGKWLGAEGHAFTPYPGRLRRKLLDLQDTGADEL
                  10        20        30        40        50        60

70        80        90       100       110       120
m121.pep  HRSRILSQELSRLYAQTAAELLCSQNLAPSDITALGCHGQTVRHAPEHGYSIQLADLPLL
          ||||:|||||||||||||||||||||||||||||||||||||||||||:||:||||||| 
a121      HRSRMLSQELSRLYAQTAAELLCSQNLAPSDITALGCHGQTVRHAPEHSYSVQLADLPLL
                  70        80        90       100       110       120

130       140       150       160       170       180
m121.pep  AXXXXXXXXXXXXXXXXXXXXXXXXXXXXXXXXXXXXXXXXXXXXXXXXXXXXXXXXXXX
          | :  :
a121      AERTQIFTVGDFRSRDLAAGGQGAPLVPAFHEALFRDDRETRAVLNIGGIANISVLPPDA
                 130       140       150       160       170       180

190       200       210       220       230       240
m121.pep  XXXXXXXXXXXXXXXXXXXXXXXXXQLPYDKNGAKSAQGNILPQLLDRLLAHPYFAQRHPKST
                                   : ||||||||||:|||||||||||||||||||||| |||||
a121      PAFGFDTGPGNMLMDAWMQAHWQLPYDKNGAKAAQGNILPQLLDRLLAHPYFAQPHPKST
                 190       200       210       220       230       240

250       260       270       280       290       300
m121.pep  GRELFAINWLETYLDGGENRYDVLRTLSRFTAQTVCDAVSHAAADARQMYICDGGIRNPV
          |||||:|||||||||||||||||||||||||||||:|||||||||||||||||:||||||
a121      GRELFALNWLETYLDGGENRYDVLRTLSRFTAQTVFDAVSHAAADARQMYICGGGIRNPV
                 250       260       270       280       290       300
```

-continued

| m121/a121 ORFs 121 and 121.a 74.0% identity in 366 aa overlap |
|---|

```
              310        320        330        340        350        360
m121.pep  LMADLAECFGTRVSLHSTADLNLDPQWVEAAXFAWLAACWINRIPGSPHKATGASKPCIL
          ||||||||||||||||||:|||||||||| |||:||||:|||||||||||||||||||
a121      LMADLAECFGTRVSLHSTAELNLDPQWVEAAAFAWMAACWVNRIPGSPHKATGASKPCIL
              310        320        330        340        350        360 m121.pep  XAGYYYX     SEQ ID NO: 1001
          ||||||
a121      GAGYYYX     SEQ ID NO: 1005
```

Further work revealed the DNA sequence identified in *N. meningitidis* <SEQ ID 1006>:

```
m121-1.seq
   1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CCAATTGCTG

151 GATTTGCAGG ACACAGGCGC AGACGAACTG CACCGCAGCA GGATTTTGTC

201 GCAAGAACTC AGCCGCCTAT ATGCGCAAAC CGCCGCCGAA CTGCTGTGCA

251 GTCAAAACCT CGCACCGTCC GACATTACCG CCCTCGGCTG CCACGGGCAA

301 ACCGTCCGAC ACGCGCCGGA ACACGGTTAC AGCATACAGC TTGCCGATTT

351 GCCGCTGCTG GCGGAACGGA CGCGGATTTT TACCGTCGGC GACTTCCGCA

401 GCCGCGACCT TGCGGCCGGC GGACAAGGCG CGCCACTCGT CCCCGCCTTT

451 CACGAAGCCC TGTTCCGCGA CAACAGGGAA CACGCGCGG TACTGAACAT

501 CGGCGGGATT GCCAACATCA GCGTACTCCC CCCCGACGCA CCCGCCTTCG

551 GCTTCGACAC AGGGCCGGGC AATATGCTGA TGGACGCGTG GACGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGTTTT ACCGCGCAAA CCGTTTGCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGNATTTG

1001 CGTGGTTGGC GGCGTGTTGG ATTAATCGCA TTCCCGGTAG TCCGCACAAA

1051 GCAACCGGCG CATCCAAACC GTGTATTCTG ANCGCGGGAT ATTATTATTG

1101 A
```

This corresponds to the amino acid sequence <SEQ ID 1007; ORF 121-1>:

```
m121.pep
   1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ
```

-continued

```
101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY*
```

---

|  | m121-1/g121 ORFs 121-1 and 121-1.ng showed a 95.6% identity in 366 aa overlap |
|---|---|

```
                    10         20         30         40         50         60
m121-1.pep  METQLYIGIMSGTSMDGADAVLIRMDGGKWLGAEGHAFTPYPGRLRRQLLDLQDTGADEL
            ||||||||||||||||||||:|||||||||||||||||||||:||||:|||||||:|||
g121        METQLYIGIMSGTSMDGADAVLVRMDGGKWLGAEGHAFTPYPDRLRRKLLDLQDTGTDEL
                    10         20         30         40         50         60

70         80         90        100        110        120
m121-1.pep  HRSRILSQELSRLYAQTAAELLCSQNLAPSDITALGCHGQTVRHAPEHGYSIQLADLPLL
            ||||:|||||||||||||||||||||||||||:|||||||||||||||||||||||||||
g121        HRSRMLSQELSRLYAQTAAELLCSQNLAPCDITALGCHGQTVRHAPEHGYSIQLADLPLL
                    70         80         90        100        110        120

130        140        150        160        170        180
m121-1.pep  AERTQIFTVGDFRSRDLAAGGQGAPLVPAFHEALFRDNRETRAVLNIGGIANISVLPPDA
            ||:||||||||||||||||||||||||||||||||||:||||:||||||||||||||:|
g121        AELTQIFTVGDFRSRDLAAGGQGAPLVPAFHEALFRDDRETRVVLNIGGIANISVLPPGA
                   130        140        150        160        170        180

190        200        210        220        230        240
m121-1.pep  PAFGFDTGPGNMLMDAWTQAHWQLPYDKNGAKAAQGNILPQLLDRLLAHPYFAQPHPKST
            ||||||||||||||||||||||||||||||||||||||||||||:|||||||:|||||||
g121        PAFGFDTGPGNMLMDAWTQAHWQLPYDKNGAKAAQGNILPQLLGRLLAHPYFSQPHPKST
                   190        200        210        220        230        240

250        260        270        280        290        300
m121-1.pep  GRELFALNWLETYLDGGENRYDVLRTLSRFTAQTVCDAVSHAAADARQMYICGGGIRNPV
            ||||||||||||||||||||||||||||||||||:|||||||||||||||||||||||||
g121        GRELFALNWLETYLDGGENRYDVLRTLSRFTAQTVWDAVSHAAADARQMYICGGGIRNPV
                   250        260        270        280        290        300

310        320        330        340        350        360
m121-1.pep  LMADLAECFGTRVSLHSTADLNLDPQWVEAAXFAWLAACWINRIPGSPHKATGASKPCIL
            |||||||||||||||||||:|||||||||||| |||||||||||||||||||||||||||
g121        LMADLAECFGTRVSLHSTAELNLDPQWVEAAAFAWLAACWINRIPGSPHKATGASKPCIL
                   310        320        330        340        350        360 m121-1.pep  XAGYYYX    SEQ ID NO:1007
            ||||||
g121        GAGYYYX    SEQ ID NO:1003
```

The following partial DNA sequence was identified in *N. meningitidis* <SEQ ID 1008>:

```
a121-1.seq
   1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CAAATTGCTG

151 GATTTGCAGG ACACAGGCGC GGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCGCCGTCC GACATTACCG CCCTCGGCTG CCACGGGCAA

301 ACCGTCAGAC ACGCGCCGGA ACACAGTTAC AGCGTACAGC TTGCCGATTT
```

```
-continued
 351 GCCGCTGCTG GCGGAACGGA CTCAGATTTT TACCGTCGGC GACTTCCGCA

401 GCCGCGACCT TGCGGCCGGC GGACAAGGCG CGCCGCTCGT CCCCGCCTTT

451 CACGAAGCCC TGTTCCGCGA CGACAGGGAA ACACGCGCGG TACTGAACAT

501 CGGCGGGATT GCCAACATCA GCGTACTCCC CCCCGACGCA CCCGCCTTCG

551 GCTTCGACAC AGGACCGGGC AATATGCTGA TGGACGCGTG GATGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 1009; ORF 121-1.a>:

```
a121-1.pep
   1 METQLYIGIM SGTSMDGADA VLIRMDGGKW LGAEGHAFTP YPGRLRRKLL

51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AAFAWMAACW VNRIPGSPHK

351 ATGASKPCIL GAGYYY*
```

```
          m121-1/a121-1 ORFs 121-1 and 121-1.a showed a 96.4%
                       identity in 366 aa overlap 10         20         30         40         50         60
m121-1.pep  METQLYIGIMSGTSMDGADAVLIRMDGGKWLGAEGHAFTPYPGRLRRQLLDLQDTGADEL
            |||||||||||||||||||||||||||||||||||||||||||||||:|||||||||||
a121-1      METQLYIGIMSGTSMDGADAVLIRMDGGKWLGAEGHAFTPYPGRLRRKLLDLQDTGADEL
                 10         20         30         40         50         60

70         80         90        100        110        120
m121-1.pep  HRSRILSQELSRLYAQTAAELLCSQNLAPSDITALGCHGQTVRHAPEHGYSIQLADLPLL
            ||||:|||||||||||||||||||||||||||||||||||||||||||:||:||||||||
a121-1      HRSRMLSQELSRLYAQTAAELLCSQNLAPSDITALGCHGQTVRHAPEHSYSVQLADLPLL
                 70         80         90        100        110        120

130        140        150        160        170        180
m121-1.pep  AERTRIFTVGDFRSRDLAAGGQGAPLVPAFHEALFRDNRETRAVLNIGGIANISVLPPDA
            ||||:|||||||||||||||||||||||||||||||||:|||||||||||||||||||||
a121-1      AERTQIFTVGDFRSRDLAAGGQGAPLVPAFHEALFRDDRETRAVLNIGGIANISVLPPDA
                130        140        150        160        170        180
```

-continued

```
          m121-1/a121-1 ORFs 121-1 and 121-1.a showed a 96.4%
                        identity in 366 aa overlap 190        200        210        220        230        240
m121-1.pep   PAFGFDTGPGNMLMDAWTQAHWQLPYDKNGAKAAQGNILPQLLDRLLAHPYFAQPHPKST
             ||||||||||||||| ||||||||||||||||||||||||||||||||||||||||||||
a121-1       PAFGFDTGPGNMLMDAWMQAHWQLPYDKNGAKAAQGNILPQLLDRLLAHPYFAQPHPKST
                  190        200        210        220        230        240

250        260        270        280        290        300
m121-1.pep   GRELFALNWLETYLDGGENRYDVLRTLSRFTAQTVCDAVSHAAADARQMYICGGGIRNPV
             |||||||||||||||||||||||||||||||||||| |||||||||||||||||||||||
a121-1       GRELFALNWLETYLDGGENRYDVLRTLSRFTAQTVFDAVSHAAADARQMYICGGGIRNPV
                  250        260        270        280        290        300

310        320        330        340        350        360
m121-1.pep   LMADLAECFGTRVSLHSTADLNLDPQWVEAAXFAWLAACWINRIPGSPHKATGASKPCIL
             ||||||||||||||||||||:|||||||||||||   :||||   :||| |||||||||||
a121         LMADLAECFGTRVSLHSTAELNLDPQWVEAAAFAWMAACWVNRIPGSPHKATGASKPCIL
                  310        320        330        340        350        360 m121-1.pep   XAGYYYX   SEQ ID NO:1007
             ||||||
a121         GAGYYYX   SEQ ID NO:1009
```

128 and 128-1

The following partial DNA sequence was identified in *N. meningitidis* <SEQ ID 1010>:

```
m128.seq (partial)
    1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTGCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCAC

1 TACGCCAGCG AAAAACTGCG CGAAGCCAAA TACGCGTTCA GCGAAACCGA 51 wGTCAAAAAA TAyTTCCCyG TCGGCAAwGT ATTAAACGGA CTGTTCGCCC

101 AAmTCAAAAA ACTmTACGGC ATCGGATTTA CCGAAAAAAC yGTCCCCGTC

151 TGGCACAAAG ACGTGCGCTA TTkTGAATTG CAACAAAACG GCGAAmCCAT

201 AGGCGGCGTT TATATGGATT TGTACGCACG CGAAGGCAAA CGCGGCGGCG

251 CGTGGATGAA CGACTACAAA GGCCGCCGCC GTTTTTCAGA CGGCACGCTG

301 CAAyTGCCCA CCGCCTACCT CGTCTGCAAC TTCGCCCCAC CCGTCGGCGG

351 CAGGGAAGCC CGCyTGAGCC ACGACGAAAT CCTCATCCTC TTCCACGAAA

401 CCGGACACGG GCTGCACCAC CTGCTTACCC AAGTGGACGA ACTGGGCGTA

451 TCCGGCATCA ACGGCGTAkA ATGGGACGCG GTCGAACTGC CCAGCCAGTT

501 TATGGAAAAT TTCGTTTGGG AATACAATGT CTTGGCACAA mTGTCAGCCC

551 ACGAAGAAAC CGGCgTTCCC yTGCCGAAAG AACTCTTsGA CAAAwTGCTC

601 GCCGCCAAAA ACTTCCAAsG CGGCATGTTC yTsGTCCGGC AAwTGGAGTT

651 CGCCCTCTTT GATATGATGA TTTACAGCGA AGACGACGAA GGCCGTCTGA
```

```
                              -continued
 701  AAAACTGGCA ACAGGTTTTA GACAGCGTGC GCAAAAAAGT CGCCGTCATC

751  CAGCCGCCCG AATACAACCG CTTCGCCTTG AGCTTCGGCC ACATCTTCGC

801  AGGCGGCTAT TCCGCAGCTn ATTACAGCTA CGCGTGGGCG GAAGTATTGA

851  GCGCGGACGC ATACGCCGCC TTTGAAGAAA GCGACGATGT CGCCGCCACA

901  GGCAAACGCT TTTGGCAGGA AATCCTCGCC GTCGGGnAT CGCGCAGCGG 951  nGCAGAATCC TTCAAAGCCT TCCGCGGCCG CGAACCGAGC ATAGACGCAC

1001  TCTTGCGCCA CAGCGGTTTC GACAACGCGG TCTGA
```

This corresponds to the amino acid sequence <SEQ ID 1011; ORF 128>:

```
m128.pep (partial)
   1 MTDNALLHLG EEPRFDQIKT EDIKPALQTA IAEAREQIAA IKAQTHTGWA

51 NTVEPLTGIT ERVGRIWGVV SHLNCVADTP ELRAVYNELM PEITVFFTEI

101 GQDIELYNRF KTIKNSPEFD TLSPAQKTKL NH
//
   1 YASEKLREAL YAFSETXVKK YFPVGXVLNG LFAQXKKLYG IGFTEKTVPV

51 WHKDVRYXEL QQNGEXIGGV YMDLYAREGK RGGAWMNDYK GRRRFSDGTL

101 QLPTAYLVCN FAPPVGGREA RLSHDEILIL FHETGHGLHH LLTQVDELGV

151 SGINGVXWDA VELPSQFMEN FVWEYNVLAQ XSAHEETGVP LPKELXDKXL

201 AAKNFQXGMF XVRQXEFALF DMMIYSEDDE GRLKNWQQVL DSVRKKVAVI

251 QPPEYNRFAL SFGHIFAGGY SAAXYSYAWA EVLSADAYAA FEESDDVAAT

301 GKRFWQEILA VGXSRSGAES FKAFRGREPS IDALLRHSGF DNAV*
```

The following partial DNA sequence was identified in *N. gonorrhoeae* <SEQ ID 1012>:

```
g128.seq
   1  atgattgaca acgCActgct ccacttgggc gaagaaccCC GTTTTaatca 51  aatccaaacc gaagACAtca AACCCGCCGT CCAAACCGCC ATCGCCGAAG

101  CGCGCGGACA AATCGCCGCC GTCAAAGCGC AAACGCACAC CGGCTGGGCG

151  AACACCGTCG AGCGTCTGAC CGGCATCACC GAACGCGTCG GCAGGATTTG

201  GGGCGTCGTG TCCCATCTCA ACTCCGTCGT CGACACGCCC GAACTGCGCG

251  CCGTCTATAA CGAACTGATG CCTGAAATCA CCGTCTTCTT CACCGAAATC

301  GGACAAGACA TCGAACTGTA CAACCGCTTC AAAACCATCA AAAATTCCCC

351  CGAATTTGCA ACGCTTTCCC CCGCACAAAA AACCAAGCTC GATCACGACC

401  TGCGCGATTT CGTATTGAGC GGCGCGGAAC TGCCGCCCGA ACGGCAGGCA

451  GAACTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCC

601  GCCGCGCAAA GCGAAGGCAA AACAGGTTAC AAAATCGGCT TGCAGATTCC

651  GCACTACCTT GCCGTTATCC AATACGCCGG CAACCGCGAA CTGCGCGAAC

701  AAATCTACCG CGCCTACGTT ACCCGTGCCA GCGAACTTTC AAACGACGGC
```

```
 751 AAATTCGACA ACACCGCCAA CATCGACCGC ACGCTCGAAA ACGCATTGAA

801 AACCGccaaa cTGCTCGGCT TTAAAAATTA CGCCGAATTG TCGCTGGCAA

851 CCAAAATGGC GGACACGCCC GAACAGGTTT TAAACTTCCT GCACGACCTC

901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA ATACGCATT CAGCGAAACC

1051 GAAGTCAAAA AATACTTCCC CGTCGGCAAA GTTCTGGCAG GCCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACtaca AAGGCCGCCG CCGCTTTGCC GACGgcacGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AacCGGCCAC GGACTGCACC ACCTGCTTAC CCAAGTGGAC GAACTGGGCG

1451 TGTCCGGCAT CAAcggcgtA GAATGGGACG CGGTCGAACT GCCCAGCCAG

1501 TTTATGGAAA ACTTCGTTTG GAATACAAT GTATTGGCAC AAATGTCCGC

1551 CCACGAAGAA AccgGCGAGC CCCTGCCGAA AGAACTCTTC GACAAAATGC

1601 TcgcCGCCAA AAACTTCCAG CGCGGTATGT TCCTCGTCCG GCAAATGGAG

1651 TTCGCCCTCT TCGATATGAT GATTTACAGT GAAAGCGACG AATGCCGTCT

1701 GAAAAACTGG CAGCAGGTTT TAGACAGCGT GCGCAAAGAA GTcGCCGTCA

1751 TCCAACCGCC CGAATACAAC CGCTTCGCCA ACAGCTTCGG CCacatctTC

1801 GCcggcGGCT ATTCCGCAGG CTATTACAGC TACGCATGGG CCGAAGTCCt 1851 cAGCACCGAT GCCTACGCCG CCTTTGAAGA AAGcGACGac gtcGCCGCCA 1901 CAGGCAAACG CTTCTGGCAA GAAAtccttg ccgtcggcgg ctCCCGCAGC 1951 gcgGCGGAAT CCTTCAAAGC CTTCCGCGGA CGCGAACCGA GCATAGACGC 2001 ACTGCTGCGC CAaagcggtT TCGACAACGC gGCttgA
```

This corresponds to the amino acid sequence <EQ ID 1013; ORF 128.ng>:

```
g128.pep
   1 MIDNALLHLG EEPRFNQIQT EDIKPAVQTA IAEARGQIAA VKAQTHTGWA

51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV EWDAVELPSQ
```

```
501 FMENFVWEYN VLAQMSAHEE TGEPLPKELF DKMLAAKNFQ RGMFLVRQME

551 FALFDMMIYS ESDECRLKNW QQVLDSVRKE VAVIQPPEYN RFANSFGHIF

601 AGGYSAGYYS YAWAEVLSTD AYAAFEESDD VAATGKRFWQ EILAVGGSRS

651 AAESFKAFRG REPSIDALLR QSGFDNAA*
```

---

ORF 128 shows 91.7% identity over a 475 aa overlap with a predicted ORF (ORF 128.ng) from *N. gonorrhoeae*:
m128/g128

```
                  10         20         30         40         50         60
g128.pep  MIDNALLHLGEEPRFNQIQTEDIKPAVQTAIAEARGQIAAVKAQTHTGWANTVERLTGIT
          ||||||||||||||| :||||||||:|||||||||   |||:||||||||||||| ||||
m128      MTDNALLHLGEEPRFDQIKTEDIKPALQTAIAEAREQIAAIKAQTHTGWANTVEPLTGIT
                  10         20         30         40         50         60

70         80         90        100        110        120
g128.pep  ERVGRIWGVVSHLNSVVDTPELRAVYNELMPEITVFFTEIGQDIELYNRFKTIKNSPEFA
          ||||||||||||||| :| |||||||||||||||||||||||||||||||||||||||||:
m128      ERVGRIWGVVSHLNCVADTPELRAVYNELMPEITVFFTEIGQDIELYNRFKTIKNSPEFD
                  70         80         90        100        110        120

130        140        150        160        170        180
g128.pep  TLSPAQKTKLDHDLRDFVLSGAELPPERQAELAKLQTEGAQLSAKFSQNVLDATDAFGIY
          ||||||||||:|
m128      TLSPAQKTKLNH
                 130
                                    //

340        350        360
g128.pep                                   YAGEKLREAKYAFSETEVKKYFPVGKVLAG
                                           ||:|||||||||||||||| ||||||| ||
m128                                       YASEKLREAKYAFSETEVKKYFPVGXVLNG
                                                  10         20         30

370        380        390        400        410        420
g128.pep  LFAQIKKLYGIGFAEKTVPVWHKDVRYFELQQNGKTIGGVYMDLYAREGKRGGAWMNDYK
          ||||:|||||||||:|||||||||||||:|||||||::|||||||||||||||||||||
m128      LFAQXKKLYGIGFTEKTVPVWHKDVRYXELQQNGEXIGGVYMDLYAREGKRGGAWMNDYK
                  40         50         60         70         80         90

430        440        450        460        470        480
g128.pep  GRRRFADGTLQLPTAYLVCNFAPPVGGKEARLSHDEILTLFHETGHGLHHLLTQVDELGV
          |||||:||||||||||||||||||||||:|||||||||||:|||||||||||||||||||
m128      GRRRFSDGTLQLPTAYLVCNFAPPVGGREARLSHDEILILFHETGHGLHHLLTQVDELGV
                 100        110        120        130        140        150

490        500        510        520        530        540
g128.pep  SGINGVEWDAVELPSQFMENFVWEYNVLAQMSAHEETGEPLPKELFDKMLAAKNFQRGMF
          ||||||:|||||||||||||||||||||||| ||||||:|||||| ||| ||||||| ||
m128      SGINGVXWDAVELPSQFMENFVWEYNVLAQXSAHEETGVPLPKELXDKXLAAKNFQXGMF
                 160        170        180        190        200        210

550        560        570        580        590        600
g128.pep  LVRQMEFALFDMMIYSESDECRLKNWQQVLDSVRKEVAVIQPPEYNRFANSFGHIFAGGY
           |||| ||||||||||||||:|||||||||||||||| ||||||||||||||:|||||||
m128      XVRQXEFALFDMMIYSEDDEGRLKNWQQVLDSVRKKVAVIQPPEYNRFALSFGHIFAGGY
                 220        230        240        250        260        270

610        620        630        640        650        660
g128.pep  SAGYYSYAWAEVLSTDAYAAFEESDDVAATGKRFWQEILAVGGSRSAAESFKAFRGREPS
          || :|||||||||||:||||||||||||||||||||||||||| |||:|||||||||||
m128      SAAXYSYAWAEVLSADAYAAFEESDDVAATGKRFWQEILAVGXSRSGAESFKAFRGREPS
                 280        290        300        310        320        330

670        679
g128.pep  IDALLRQSGFDNAAX    SEQ ID NO: 1013
          ||||||:|||||:|
m128      IDALLRHSGFDNAVX    SEQ ID NO: 1011
                 340
```

The following partial DNA sequence was identified in *N. meningitidis* <SEQ ID 1014>:

```
a128.seq
     1 ATGACTGACA ACGCACTGCT CCATTTGGGC GAAGAACCCC GTTTTGATCA
    51 AATCAAAACC GAAGACATCA AACCCGCCCT GCAAACCGCC ATTGCCGAAG
   101 CGCGCGAACA AATCGCCGCC ATCAAAGCCC AAACGCACAC CGGCTGGGCA
   151 AACACTGTCG AACCCCTGAC CGGCATCACC GAACGCGTCG GCAGGATTTG
   201 GGGCGTGGTG TCGCACCTCA ACTCCGTCAC CGACACGCCC GAACTGCGCG
   251 CCGCCTACAA TGAATTAATG CCCGAAATTA CCGTCTTCTT CACCGAAATC
   301 GGACAAGACA TCGAGCTGTA CAACCGCTTC AAAACCATCA AAAACTCCCC
   351 CGAGTTCGAC ACCCTCTCCC ACGCGCAAAA AACCAAACTC AACCACGATC
   401 TGCGCGATTT CGTCCTCAGC GGCGCGGAAC TGCCGCCCGA ACAGCAGGCA
   451 GAATTGGCAA AACTGCAAAC CGAAGGCGCG CAACTTTCCG CCAAATTCTC
   501 CCAAAACGTC CTAGACGCGA CCGACGCGTT CGGCATTTAC TTTGACGATG
   551 CCGCACCGCT TGCCGGCATT CCCGAAGACG CGCTCGCCAT GTTTGCCGCT
   601 GCCGCGCAAA GCGAAGGCAA AACAGGCTAC AAAATCGGTT TGCAGATTCC
   651 GCACTACCTC GCCGTCATCC AATACGCCGA CAACCGCAAA CTGCGCGAAC
   701 AAATCTACCG CGCCTACGTT ACCCGCGCCA GCGAGCTTTC AGACGACGGC
   751 AAATTCGACA ACACCGCCAA CATCGACCGC ACGCTCGAAA ACGCCCTGCA
   801 AACCGCCAAA CTGCTCGGCT TCAAAAACTA CGCCGAATTG TCGCTGGCAA
   851 CCAAAATGGC GGACACCCCC GAACAAGTTT TAAACTTCCT GCACGACCTC
   901 GCCCGCCGCG CCAAACCCTA CGCCGAAAAA GACCTCGCCG AAGTCAAAGC
   951 CTTCGCCCGC GAAAGCCTCG GCCTCGCCGA TTTGCAACCG TGGGACTTGG
  1001 GCTACGCCGG CGAAAAACTG CGCGAAGCCA AATACGCATT CAGCGAAACC
  1051 GAAGTCAAAA AATACTTCCC CGTCGGCAAA GTATTAAACG GACTGTTCGC
  1101 CCAAATCAAA AAACTCTACG GCATCGGATT TACCGAAAAA ACCGTCCCCG
  1151 TCTGGCACAA AGACGTGCGC TATTTTGAAT TGCAACAAAA CGGCGAAACC
  1201 ATAGGCGGCG TTTATATGGA TTTGTACGCA CGCGAAGGCA AACGCGGCGG
  1251 CGCGTGGATG AACGACTACA AAGGCCGCCG CCGTTTTTCA GACGGCACGC
  1301 TGCAACTGCC CACCGCCTAC CTCGTCTGCA ACTTCACCCC GCCCGTCGGC
  1351 GGCAAAGAAG CCCGCTTGAG CCATGACGAA ATCCTCACCC TCTTCCACGA
  1401 AACCGGACAC GGCCTGCACC ACCTGCTTAC CCAAGTCGAC GAACTGGGCG
  1451 TATCCGGCAT CAACGGCGTA GAATGGGACG CAGTCGAACT GCCCAGTCAG
  1501 TTTATGGAAA ATTTCGTTTG GGAATACAAT GTCTTGGCGC AAATGTCCGC
  1551 CCACGAAGAA ACCGGCGTTC CCCTGCCGAA AGAACTCTTC GACAAAATGC
  1601 TCGCCGCCAA AAACTTCCAA CGCGGAATGT TCCTCGTCCG CCAAATGGAG
  1651 TTCGCCCTCT TTGATATGAT GATTTACAGC GAAGACGACG AAGGCCGTCT
  1701 GAAAAACTGG CAACAGGTTT TAGACAGCGT GCGCAAAGAA GTCGCCGTCG
  1751 TCCGACCGCC CGAATACAAC CGCTTCGCCA ACAGCTTCGG CCACATCTTC
  1801 GCAGGCGGCT ATTCCGCAGG CTATTACAGC TACGCGTGGG CGGAAGTATT
  1851 GAGCGCGGAC GCATACGCCG CCTTTGAAGA AAGCGACGAT GTCGCCGCCA
```

-continued

```
1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 1015; ORF 128.a>:

```
a128.pep
   1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
```

| m128/a128 ORFs 128 and 128.a showed a 66.0% identity in 677 aa overlap |
|---|

```
                   10         20         30         40         50         60
m128.pep   MTDNALLHLGEEPRFDQIKTEDIKPALQTAIAEAREQIAAIKAQTHTGWANTVEPLTGIT
           |||||||||||||||||||||||||||||||||||||||||||||||||||||||||||
a128       MTDNALLHLGEEPRFDQIKTEDIKPALQTAIAEAREQIAAIKAQTHTGWANTVEPLTGIT
                   10         20         30         40         50         60

70         80         90        100        110        120
m128.pep   ERVGRIWGVVSHLNCVADTPELRAVYNELMPEITVFFTEIGQDIELYNRFKTIKNSPEFD
           ||||||||||||||| :||||||:||||||||||||||||||||||||||||||||||||
a128       ERVGRIWGVVSHLNSVTDTPELRAAYNELMPEITVFFTEIGQDIELYNRFKTIKNSPEFD
                   70         80         90        100        110        120

130
m128.pep   TLSPAQKTKLNH------------------------------------------------
           ||| ||||||||
a128       TLSHAQKTKLNHDLRDFVLSGAELPPEQQAELAKLQTEGAQLSAKFSQNVLDATDAFGIY
                  130        140        150        160        170        180 m128.pep   ------------------------------------------------------------
a128       FDDAAPLAGIPEDALAMFAAAAQSEGKTGYKIGLQIPHYLAVIQYADNRKLREQIYRAYV
                  190        200        210        220        230        240 m128.pep   ------------------------------------------------------------
a128       TRASELSDDGKFDNTANIDRTLENALQTAKLLGFKNYAELSLATKMADTPEQVLNFLHDL
                  250        260        270        280        290        300
```

-continued m128/a128 ORFs 128 and 128.a showed a 66.0%
identity in 677 aa overlap

```
                                        140        150
m128.pep  ---------------------------------YASEKLREAKYAFSETXVKKYFPVGX
                                           ||:||||||||||||| |||||||||
a128      ARRAKPYAEKDLAEVKAFARESLGLADLQPWDLGYAGEKLREAKYAFSETEVKKYFPVGK
             310       320       330       340       350       360

160       170       180       190       200       210
m128.pep  VLNGLFAQXKKLYGIGFTEKTVPVWHKDVRYXELQQNGEXIGGVYMDLYAREGKRGGAWM
          |||||||| |||||||||||||||||||||| ||||||| ||||||||||||||||||||
a128      VLNGLFAQIKKLYGIGFTEKTVPVWHKDVRYFELQQNGETIGGVYMDLYAREGKRGGAWM
             370       380       390       400       410       420

220       230       240       250       260       270
m128.pep  NDYKGRRRFSDGTLQLPTAYLVCNFAPPVGGREARLSHDEILILFHETGHGLHHLLTQVD
          |||||||||||||||||||||||||||:||||:||||||||||||| |||||||||||||
a128      NDYKGRRRFSDGTLQLPTAYLVCNFTPPVGGKEARLSHDEILTLFHETGHGLHHLLTQVD
             430       440       450       460       470       480

280       290       300       310       320       330
m128.pep  ELGVSGINGVXWDAVELPSQFMENFVWEYNVLAQXSAHEETGVPLPKELXDKXLAAKNFQ
          |||||||||| ||||||||||||||||||||||| |||||||||||||| || ||||||
a128      ELGVSGINGVEWDAVELPSQFMENFVWEYNVLAQMSAHEETGVPLPKELFDKMLAAKNFQ
             490       500       510       520       530       540

340       350       360       370       380       390
m128.pep  XGMFXVRQXEFALFDMMIYSEDDEGRLKNWQQVLDSVRKKVAVIQPPEYNRFALSFGHIF
           |||  ||| |||||||||||||||||||||||||||||:|::|:|||||||||:|||||
a128      RGMFLVRQMEFALFDMMIYSEDDEGRLKNWQQVLDSVRKEVAVVRPPEYNRFANSFGHIF
             550       560       570       580       590       600

400       410       420       430       440       450
m128.pep  AGGYSAAXYSYAWAEVLSADAYAAFEESDDVAATGKRFWQEILAVGXSRSGAESFKAFRG
          |||||:| ||||||||||||||||||||||||||||||||||||| |||:|||||||||
a128      AGGYSAGYYSYAWAEVLSADAYAAFEESDDVAATGKRFWQEILAVGGSRSAAESFKAFRG
             610       620       630       640       650       660

460       470
m128.pep  REPSIDALLRHSGFDNAVX   SEQ ID NO: 1011
          ||||||||||||||||||:
a128      REPSIDALLRHSGFDNAAX   SEQ ID NO: 1015
             670
```

Further work revealed the DNA sequence identified in *N. meningitidis* <SEQ ID 1016>:

```
m128-1.seq
   1  ATGACTGACA ACGCACTGCT CCATTTGGGC GAAGAACCCC GTTTTGATCA

51  AATCAAAACC GAAGACATCA AACCCGCCCT GCAAACCGCC ATCGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTCCGTCGC CGACACGCCC GAACTGCGCG

251  CCGTCTATAA CGAACTGATG CCCGAAATCA CCGTCTTCTT CACCGAAATC

301  GGACAAGACA TCGAGCTGTA CAACCGCTTC AAAACCATCA AAAATTCCCC

351  CGAATTCGAC ACCCTCTCCC CCGCACAAAA AACCAAACTC AACCACGATC

401  TGCGCGATTT CGTCCTCAGC GGCGCGGAAC TGCCGCCCGA ACAGCAGGCA

451  GAACTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCC

601  GCCGCGCAAA GCGAAAGCAA AACAGGCTAC AAAATCGGCT TGCAGATTCC

651  ACACTACCTC GCCGTCATCC AATACGCCGA CAACCGCGAA CTGCGCGAAC
```

-continued

```
 701 AAATCTACCG CGCCTACGTT ACCCGCGCCA GCGAACTTTC AGACGACGGC

751 AAATTCGACA ACACCGCCAA CATCGACCGC ACGCTCGCAA ACGCCCTGCA

801 AACCGCCAAA CTGCTCGGCT TCAAAAACTA CGCCGAATTG TCGCTGGCAA

851 CCAAAATGGC GGACACGCCC GAACAAGTTT AAACTTCCT GCACGACCTC

901 GCCCGCCGCG CCAAACCCTA CGCCGAAAAA GACCTCGCCG AAGTCAAAGC

951 CTTCGCCCGC GAAAGCCTGA ACCTCGCCGA TTTGCAACCG TGGGACTTGG

1001 GCTACGCCAG CGAAAAACTG CGCGAAGCCA ATACGCGTT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCGCCCC ACCCGTCGGC

1351 GGCAGGGAAG CCCGCCTGAG CCACGACGAA ATCCTCATCC TCTTCCACGA

1401 AACCGGACAC GGGCTGCACC ACCTGCTTAC CCAAGTGGAC GAACTGGGCG

1451 TATCCGGCAT CAACGGCGTA GAATGGGACG CGGTCGAACT GCCCAGCCAG

1501 TTTATGGAAA ATTTCGTTTG GGAATACAAT GTCTTGGCAC AAATGTCAGC

1551 CCACGAAGAA ACCGGCGTTC CCCTGCCGAA AGAACTCTTC GACAAAATGC

1601 TCGCCGCCAA AAACTTCCAA CGCGGCATCT TCCTCGTCCG GCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAAAA GTCGCCGTCA

1751 TCCAGCCGCC CGAATACAAC CGCTTCGCCT TGAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 1017; ORF 128-1>:

```
m128-1.pep.
   1 MTDNALLHLG EEPRFDQIKT EDIKPALQTA IAEAREQIAA IKAQTHTGWA

51 NTVEPLTGIT ERVGRIWGVV SHLNSVADTP ELRAVYNELM PEITVFFTEI

101 GQDIELYNRF KTIKNSPEFD TLSPAQKTKL NHDLRDFVLS GAELPPEQQA

151 ELAKLQTEGA QLSAKFSQNV LDATDAFGIY FDDAAPLAGI PEDALAMFAA

201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG
```

```
451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV*
```

The following partial DNA sequence was identified in *N. gonorrhoeae* <SEQ ID 1018>:

```
g128-1.seq (partial)
    1 ATGATTGACA ACGCACTGCT CCACTTGGGC GAAGAACCCC GTTTTAATCA

51 AATCAAAACC GAAGACATCA AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG

201 GGGCGTCGTG TCCCATCTCA ACTCCGTCGT CGACACGCCC GAACTGCGCG

251 CCGTCTATAA CGAACTGATG CCTGAAATCA CCGTCTTCTT CACCGAAATC

301 GGACAAGACA TCGAACTGTA CAACCGCTTC AAAACCATCA AAAATTCCCC

351 CGAATTTGCA ACGCTTTCCC CCGCACAAAA AACCAAGCTC GATCACGACC

401 TGCGCGATTT CGTATTGAGC GGCGCGGAAC TGCCGCCCGA ACGGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAGGCAA AACAGGTTAC AAAATCGGCT TGCAGATTCC

651 GCACTACCTT GCCGTTATCC AATACGCCGG CAACCGCGAA CTGCGCGAAC

701 AAATCTACCG CGCCTACGTT ACCCGTGCCA GCGAACTTTC AAACGACGGC

751 AAATTCGACA ACACCGCCAA CATCGACCGC ACGCTCGAAA ACGCATTGAA

801 AACCGCCAAA CTGCTCGGCT TTAAAAATTA CGCCGAATTG TCGCTGGCAA

851 CCAAAATGGC GGACACGCCC GAACAGGTTT TAAACTTCCT GCACGACCTC

901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG CCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACTACA AAGGCCGCCG CCGCTTTGCC GACGGCACGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AACCGGCCAC GGACTGCACC ACCTGCTTAC CCAAGTGGAC GAACTGGGCG

1451 TGTCCGGCAT CAACGGCGTA AAA
```

This corresponds to the amino acid sequence <SEQ ID 1019; ORF 128-1.ng>:

```
g128-1.pep (partial)
  1 MIDNALLHLG EEPRFNQIKT EDIKPAVQTA IAEARGQIAA VKAQTHTGWA

51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV K
```

--- m128-1/g128-1 ORFs 128-1 and 128-1.ng showed a 94.5% identity in 491 aa overlap

```
                   10         20         30         40         50         60
g128-1.pep MIDNALLHLGEEPRFNQIKTEDIKPAVQTAIAEARGQIAAVKAQTHTGWANTVERLTGIT
           ||||||||||||||||:||||||||||||:|||||||:||||:|||||||||||:||||
m128-1     MTDNALLHLGEEPRFDQIKTEDIKPALQTAIAEAREQIAAIKAQTHTGWANTVEPLTGIT
                   10         20         30         40         50         60

70         80         90        100        110        120
g128-1.pep ERVGRIWGVVSHLNSVVDTPELRAVYNELMPEITVFFTEIGQDIELYNRFKTIKNSPEFA
           ||||||||||||||||:|||||||||||||||||||||||||||||||||||||||||
m128-1     ERVGRIWGVVSHLNSVADTPELRAVYNELMPEITVFFTEIGQDIELYNRFKTIKNSPEFD
                   70         80         90        100        110        120

130        140        150        160        170        180
g128-1.pep TLSPAQKTKLDHDLRDFVLSGAELPPERQAELAKLQTEGAQLSAKFSQNVLDAYDAFGIY
           |||||||||:||||||||||||||||::||||||||||||||||||||||||||||||
m128-1     TLSPAQKTKLNHDLRDFVLSGAELPPEQQAELAKLQTEGAQLSAKFSQNVLDAYDAFGIY
                   130        140        150        160        170        180

190        200        210        220        230        240
g128-1.pep FDDAAPLAGIPEDALAMFAAAAQSEGKTGYKIGLQIPHYLAVIQYAGNRELREQIYRAYV
           |||||||||||||||||||||||||:|||||||||||||||||||||:||||||||||
m128-1     FDDAAPLAGIPEDALAMFAAAAQSESKTGYKIGLQIPHYLAVIQYADNRELREQIYRAYV
                   190        200        210        220        230        240

250        260        270        280        290        300
g128-1.pep TRASELSNDGKFDNTANIDRTLENALKTAKLLGFKNYAELSLATKMADTPEQVLNFLHDL
           |||||||:||||||||||||||||:||:|||||||||||||||||||||||||||||
m128-1     TRASELSDDGKFDNTANIDRTLANALQTAKLLGFKNYAELSLATKMADTPEQVLNFLHDL
                   250        260        270        280        290        300

310        320        330        340        350        360
g128-1.pep ARRAKPYAEKDLAEVKAFAREHLGLADPQPWDLSYAGEKLREAKYAFSETEVKKYFPVGK
           |||||||||||||||||||||:|||:||||||:||:|||||||||||||||||||||
m128-1     ARRAKPYAEKDLAEVKAFARESLNLADLQPWDLGYASEKLREAKYAFSETEVKKYFPVGK
                   310        320        330        340        350        360

370        380        390        400        410        420
g128-1.pep VLAGLFAQIKKLYGIGFAEKTVPVWHKDVRYFELQQNGKTIGGVYMDLYAREGKRGGAWM
           ||:|||||||||||||||:|||||||||||||||||||:|||||||||||||||||||
m128-1     VLNGLFAQIKKLYGIGFTEKTVPVWHKDVRYFELQQNGETIGGVYMDLYAREGKRGGAWM
                   370        380        390        400        410        420

430        440        450        460        470        480
g128-1.pep NDYKGRRRFADGTLQLPTAYLVCNFAPPVGGKEARLSHDEILTLFHETGHGLHHLLTQVD
           ||||||||:|||||||||||||||||||||||:|||||||||:||||||||||||||
m128-1     NDYKGRRRFSDGTLQLPTAYLVCNFAPPVGGREARLSHDEILILFHETGHGLHHLLTQVD
                   430        440        450        460        470        480
```

-continued

| m128-1/g128-1 ORFs 128-1 and 128-1.ng showed a 94.5% identity in 491 aa overlap |
|---|

```
                    490
g128-1.pep  ELGVSGINGVK
            |||||||||| :
m128-1      ELGVSGINGVEWDAVELPSQFMENFVWEYNVLAQMSAHEETGVPLPKELFDKMLAAKNFQ
                    490       500       510       520       530       540 g128-1.pep  SEQ ID NO: 1019 m128-1      SEQ ID NO: 1017
```

The following DNA sequence was identified in *N. meningitidis* SEQ ID 1020>:

```
a128-1.seq
    1 ATGACTGACA ACGCACTGCT CCATTTGGGC GAAGAACCCC GTTTTGATCA
   51 AATCAAAACC GAAGACATCA AACCCGCCCT GCAAACCGCC ATTGCCGAAG
  101 CGCGCGAACA AATCGCCGCC ATCAAAGCCC AAACGCACAC CGGCTGGGCA
  151 AACACTGTCG AACCCCTGAC CGGCATCACC GAACGCGTCG GCAGGATTTG
  201 GGGCGTGGTG TCGCACCTCA ACTCCGTCAC CGACACGCCC GAACTGCGCG
  251 CCGCCTACAA TGAATTAATG CCCGAAATTA CCGTCTTCTT CACCGAAATC
  301 GGACAAGACA TCGAGCTGTA CAACCGCTTC AAAACCATCA AAAACTCCCC
  351 CGAGTTCGAC ACCCTCTCCC ACGCGCAAAA AACCAAACTC AACCACGATC
  401 TGCGCGATTT CGTCCTCAGC GGCGCGGAAC TGCCGCCCGA ACAGCAGGCA
  451 GAATTGGCAA AACTGCAAAC CGAAGGCGCG CAACTTTCCG CCAAATTCTC
  501 CCAAAACGTC CTAGACGCGA CCGACGCGTT CGGCATTTAC TTTGACGATG
  551 CCGCACCGCT TGCCGGCATT CCCGAAGACG CGCTCGCCAT GTTTGCCGCT
  601 GCCGCGCAAA GCGAAGGCAA AACAGGCTAC AAAATCGGTT TGCAGATTCC
  651 GCACTACCTC GCCGTCATCC AATACGCCGA CAACCGCAAA CTGCGCGAAC
  701 AAATCTACCG CGCCTACGTT ACCCGCGCCA GCGAGCTTTC AGACGACGGC
  751 AAATTCGACA ACACCGCCAA CATCGACCGC ACGCTCGAAA ACGCCCTGCA
  801 AACCGCCAAA CTGCTCGGCT TCAAAAACTA CGCCGAATTG TCGCTGGCAA
  851 CCAAAATGGC GGACACCCCC GAACAAGTTT TAAACTTCCT GCACGACCTC
  901 GCCCGCCGCG CCAAACCCTA CGCCGAAAAA GACCTCGCCG AAGTCAAAGC
  951 CTTCGCCCGC GAAAGCCTCG GCCTCGCCGA TTTGCAACCG TGGGACTTGG
 1001 GCTACGCCGG CGAAAAACTG CGCGAAGCCA AATACGCATT CAGCGAAACC
 1051 GAAGTCAAAA AATACTTCCC CGTCGGCAAA GTATTAAACG GACTGTTCGC
 1101 CCAAATCAAA AAACTCTACG GCATCGGATT TACCGAAAAA ACCGTCCCCG
 1151 TCTGGCACAA AGACGTGCGC TATTTTGAAT GCAACAAAA CGGCGAAACC
 1201 ATAGGCGGCG TTTATATGGA TTTGTACGCA CGCGAAGGCA AACGCGGCGG
 1251 CGCGTGGATG AACGACTACA AAGGCCGCCG CCGTTTTTCA GACGGCACGC
 1301 TGCAACTGCC CACCGCCTAC CTCGTCTGCA ACTTCACCCC GCCCGTCGGC
 1351 GGCAAAGAAG CCCGCTTGAG CCATGACGAA ATCCTCACCC TCTTCCACGA
 1401 AACCGGACAC GGCCTGCACC ACCTGCTTAC CCAAGTCGAC GAACTGGGCG
```

```
1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCCTGCCGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT CGACAACGC GGCTTGA
```

This corresponds to the amino acid sequence <SEQ ID 1021; ORF 128-1.a>:

```
a128-1.pep
  1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAX LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWN NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
```

| m128-1/a128-1 ORFs 128-1 and 128-1.a showed a 97.8% identity in 677 aa overlap | | | | | |
|---|---|---|---|---|---|
| | 10 | 20 | 30 | 40 | 50  60 |
| a128-1.pep | MTDNALLHLGEEPRFDQIKTEDIKPALQTAIAEAREQIAAIKAQTHTGWANTVEPLTGIT | | | | |
| | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | | | | |
| m128-1 | MTDNALLHLGEEPRFDQIKTEDIKPALQTAIAEAREQIAAIKAQTHTGWANTVEPLTGIT | | | | |
| | 10 | 20 | 30 | 40 | 50  60 |
| | 70 | 80 | 90 | 100 | 110  120 |
| a128-1.pep | ERVGRIWGVVSHLNSVTDTPELRAAYNELMPEITVFFTEIGQDIELYNRFKTIKNSPEFD | | | | |
| | \|\|\|\|\|\|\|\|\|\|\|\|\|\|\|\|\|\|\|:\|\|\|\|\|\|\|\|:\|\|\|\|\|\|\|\|\|\|\|\|\|\|\|\|\|\|\|\|\|\|\|\|\|\|\|\|\|\| | | | | |
| m128-1 | ERVGRIWGVVSHLNSVADTPELRAVYNELMPEITVFFTEIGQDIELYNRFKTIKNSPEFD | | | | |
| | 70 | 80 | 90 | 100 | 110  120 |

```
            m128-1/a128-1 ORFs 128-1 and 128-1.a showed a 97.8%
                         identity in 677 aa overlap 130       140       150       160       170       180
a128-1.pep  TLSHAQKTKLNHDLRDFVLSGAELPPEQQAELAKLQTEGAQLSAKFSQNVLDAYDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDAYDAFGIY
                    130       140       150       160       170       180

190       200       210       220       230       240
a128-1.pep  FDDAAPLAGIPEDALAMFAAAAQSEGKTGYKIGLQIPHYLAVIQYAGNRKLREQIYRAYV
            ||||||||||||||||||||||||:|||||||||||||||||||||||||:|||||||||
m128-1      FDDAAPLAGIPEDALAMFAAAAQSESKTGYKIGLQIPHYLAVIQYAGNRELREQIYRAYV
                    190       200       210       220       230       240

250       260       270       280       290       300
a128-1.pep  TRASELSDDGKFDNTANIDRTLENALQTAKLLGFKNYAELSLATKMADTPEQVLNFLHDL
            |||||||||||||||||||||||| |||||||||||||||||||||||||||||||||||
m128-1      TRASELSDDGKFDNTANIDRTLANALQTAKLLGFKNYAELSLATKMADTPEQVLNFLHDL
                    250       260       270       280       290       300

310       320       330       340       350       360
a128-1.pep  ARRAKPYAEKDLAEVKAFARESLGLADLQPWDLGYAGEKLREAKYAFSETEVKKYFPVGK
            |||||||||||||| ||||||||:|||||||||||||| |||||||||||||||||||||
m128-1      ARRAKPYAEKDLAECKAFARESLNLADLQPWDLGYASEKLREAKYAFSETEVKKYFPVGK
                    310       320       330       340       350       360

370       380       390       400       410       420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                    370       380       390       400       410       420

430       440       450       460       470       480
a128-1.pep  NDYKGRRRFSDGTLQLPTAYLVCNFTPPVGGKEARLSHDEILTLFHETGHGLHHLLTQVD
            |||||||||||||||||||||||||:||||:|||||||||||||||||||||||||||||
m128-1      NDYKGRRRFSDGTLQLPTAYLVCNFAPPVGGREARLSHDEILTLFHETGHGLHHLLTQVD
                    430       440       450       460       470       480

490       500       510       520       530       540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                    490       500       510       520       530       540

550       560       570       580       590       600
a128-1.pep  RGMFLVRQMEFALFDMMIYSEDDEGRLKNWQQVLDSVRKEVAVVRPPEYNRFANSFGHIF
            |||||||||||||||||||||||||||||||||||||||:|||::|||||||||:|||||
m128-1      RGMFLVRQMEFALFDMMIYSEDDEGRLKNWQQVLDSVRKKVAVIQPPEYNRFALSFGHIF
                    550       560       570       580       590       600

610       620       630       640       650       660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                    610       620       630       640       650       660

670       679
a128-1.pep  REPSIDALLRHSGFDNAAX    SEQ ID NO: 1021
            ||||||||||||||||||:
m128-1      REPSIDALLRHSGFDNAVX    SEQ ID NO: 1017
                    670
```

206

The following partial DNA sequence was identified in *N. meningitidis* <SEQ ID 1022>:

```
m206.seq
   1 ATGTTTCCCC CCGACAAAAC CCTTTTCCTC TGTCTCAGCG CACTGCTCCT

51 CGCCTCATGC GGCACGACCT CCGGCAAACA CCGC

```
    -continued
201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 1023; ORF 206>:

```
m206.pep..
  1 MFPPDKTLFL CLSALLLASC GTTSGKHRQP KPKQTVRQIQ AVRISHIDRT

51 QGSQELMLHS LQLIGTPYKW GGSSTATGFD CSGMIQFVYK NALNVKLPRT

101 ARDMAAASRK IPDSRXKAGD LVFFNTGGAH RYSHVGLYIG NGEFIHAPSS

151 GKTIKTEKLS TPPYAKNYLG AHTFFTE*
```

The following partial DNA sequence was identified in *N. gonorrhoeae* <SEQ ID 1024>:

```
g206.seq
  1 atgttttccc ccgacaaaac ccttttcctc tgtctcggcg cactgctcct 51 cgcctcatgc ggcacgacct ccggcaaaca ccgccaaccg aaacccaaac 101 agacagtccg gcaaatccaa gccgtccgca tcagccacat cggccgcaca 151 caaggctcgc aggaactcat gctccacagc ctcggactca tcggcacgcc 201 ctacaaatgg ggcggcagca gcaccgcaac cggcttcgac tgcagcggca 251 tgattcaatt ggtttacaaa aacgccctca acgtcaagct gccgcgcacc 301 gcccgcgaca tggcggcggc aagccgcaaa atccccgaca gccgcctcaa 351 ggccggcgac atcgtattct tcaacaccgg cggcgcacac cgctactcac 401 acgtcggact ctacatcggc aacggcgaat tcatccatgc ccccggcagc 451 ggcaaaacca tcaaaaccga aaaactctcc acaccgtttt acgccaaaaa 501 ctaccttgga gcgcatacgt tttttacaga atga
```

This corresponds to the amino acid sequence <SEQ ID 1025; ORF 206.ng>:

```
g206.pep
  1 MFSPDKTLPL CLGALLLASC GTTSGKHRQP KPKQTVRQIQ AVRISHIGRT

51 QGSQELNLHS LGLIGTPYKW GGSSTATGFD CSGMIQLVYK NALNVKLPRT

101 ARDMAAASRK IPDSRLKAGD IVFFNTGGAH RYSHVGLYIG NGEFIRAPGS

151 GKTIKTEKLS TPFYAKNYLG ARTFFTE*
```

ORF 206 shows 96.0% identity over a 177 aa overlap with a predicted ORF
(ORF 206.ng) from *N. gonorrhoeae*:
m206/g206

```
              10        20        30        40        50        60
m206.pep  MFPPDKTLFLCLSALLLASCGTTSGKHRQPKPKQTVRQIQAVRISHIDRTQGSQELMLHS
          ||  ||||||||| :||||||||||||||||||||||||||||||| ||||||||||||
g206      MFSPDKTLFLCLGALLLASCGTTSGKHRQPKPKQTVRQIQAVRISHIGRTQGSQELMLHS
              10        20        30        40        50        60

70        80        90       100       110       120
m206.pep  LGLIGTPYKWGGSSTATGFDCSGMIQFVYKNALNVKLPRTARDMAAASRKIPDSRXKAGD
          ||||||||||||||||||||||||||| :||||||||||||||||||||||||||| |||
g206      LGLIGTPYKWGGSSTATGFDCSGMIQLVYKNALNVKLPRTARDMAAASRKIPDSRLKAGD
              70        80        90       100       150       120

130       140       150       160       170
m206.pep  LVFFNTGGAHRYSHVGLYIGNGEFIHAPSSGKTIKTEKLSTPFYAKNYLGAHTFFTEX
          :||||||||||||||||||||||||||||:|||||||||||||||||||||||||||
g206      IVFFNTGGAHRYSHVGLYIGNGEFIHAPSGKTIKTEKLSTPFYAKNYLGAHTFFTE
             130       140       150       160       170 m206.pep  SEQ ID NO: 1023 g206      SEQ ID NO: 1025
```

The following partial DNA sequence was identified in *N. meningitidis* <SEQ ID 1026>:

```
a206.seq
    1 ATGTTTCCCC CCGACAAAAC CCTTTTCCTC TGTCTCAGCG CACTGCTCCT

51 CGCCTCATGC GGCACGACCT CCGGCAAACA CCGCCAACCC AAACCCAAAC

101 AGACAGTCCG GCAAATCCAA GCCGrCCGCA TCAGCCACAT CGACCGCACA

151 CAAGGCTCGC AGGAACTCAT CCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 1027; ORF 206.a>:

```
a206.pep
    1 MFPPDKTLFL CLSALLLASC GTTSGKHRQP KPKQTVRQIQ AVRISHIDRT

51 QGSQELNLHS LGLIGTPYKW GGSSTATGFD CSGMIQFVYK NALNVKLPRT

101 ARDMAAASRK IPDSRLKAGD LVFFWFGGAH RYSHVGLYIG NGEFIHAPSS

151 GKTIKTEKLS TPFYAKNYtG AHTFFTE*
```

| m206/a206 ORFs 206 and 206.a showed a 99.4% identity in 177 aa overlap |
|---|

```
                 10        20        30        40        50        60
m206.pep  MFPPDKTLFLCLSALLLASCGTTSGKHRQPKPKQTVRQIQAVRISHIDRTQGSQELMLHS
          ||||||||||||||||||||||||||||||||||||||||||||| |||||||||||||
a206      MFPPDKTLFLCLSALLLASCGTTSGKHRQPKPKQTVRQIQAVRISHIGRTQGSQELMLHS
                 10        20        30        40        50        60

70        80        90       100       110       120
m206.pep  LGLIGTPYKWGGSSTATGFDCSGMIQFVYKNALNVKLPRTARDMAAASRKIPDSRXKAGD
          |||||||||||||||||||||||||||||||||||||||||||||||||||||| ||||
a206      LGLIGTPYKWGGSSTATGFDCSGMIQFVYKNALNVKLPRTARDMAAASRKIPDSRLKAGD
                 70        80        90       100       150       120

130       140       150       160       170
m206.pep  LVFFNTGGAHRYSHVGLYIGNGEFIHAPSSGKTIKTEKLSTPFYAKNYLGAHTFFTEX
          |||||||||||||||||||||||||||||||||||||||||||||||||||||||||
a206      LVFFNTGGAHRYSHVGLYIGNGEFIHAPSSGKTIKTEKLSTPFYAKNYLGAHTFFTEX
                130       140       150       160       170 m206.pep  SEQ ID NO: 1023 a206      SEQ ID NO: 1027
```

The following partial DNA sequence was identified in *N. meningitidis* <SEQ ID 1028>:

```
m287.seq
    1 ATGTTTAAAC GCAGCGTAAT CGCAATGGCT TGTATTTTTG CCCTTTCAGC

51 CTGCGGGGGC GGCGGTGGCG GATCGCCCGA TGTCAAGTCG CCGGACACGC

101 TGTCAAAACC TGCCGCCCCT GTTGTTTCTG AAAAAGAGAC AGAGGCAAAG

151 GAAGATGCGC CACAGGCAGG TTCTCAAGGA CAGGGCGCGC CATCCGCACA

201 AGGCAGTCAA GATATGGCGG CGGTTTCGGA AGAAAATACA GGCAATGGCG

251 GTGCGGTAAC AGCGGATAAT CCCAAAAATG AAGACGAGGT GGCACAAAAT

301 GATATGCCGC AAAATGCCGC CGGTACAGAT AGTTCGACAC CGAATCACAC

351 CCCGGATCCG AATATGCTTG CCGGAAATAT GGAAAATCAA GCAACGGATG

401 CCGGGGAATC GTCTCAGCCG GCAAACCAAC CGGATATCGC AAATGCGGCG

451 GACGGAATGC AGGGGGACGA TCCGTCGGCA GGCGGGCAAA ATGCCGGCAA

501 TACCGCTCCC CAAGGTGCAA ATCAAGCCGG AAACAATCAA GCCGCCGGTT

551 CTTCAGATCC CATCCCCGCG TCAAACCCTG CACCTGCGAA TGGCGGTAGC

601 AATTTTGGAA GGGTTGATTT GGCTAATGGC GTTTTGATTG ACGGGCCGTC

651 GCAAAATATA ACGTTGACCC ACTGTAAAGG CCATTCTTGT AGTGGCAATA

701 ATTTCTTGGA TGAAGAAGTA CAGCTAAAAT CAGAATTTGA AAAATTAAGT

751 GATGCAGACA AAATAAGTAA TTACAAGAAA GATGGGAAGA ATGATAAATT

801 TGTCGGTTTG GTTGCCGATA GTGTGCAGAT GAAGGGAATC AATCAATATA

851 TTATCTTTTA TAAACCTAAA CCCACTTCAT TTGCGCGATT TAGCCGTTCT

901 GCACGGTCGA GGCGGTCGCT TCCGGCCGAG ATCCCGCTGA TTCCCGTCAA

951 TCAGGCGGAT ACGCTGATTG TCGATGGGGA AGCGGTCAGC CTGACGGGGC

1001 ATTCCGGCAA TATCTTCGCG CCCGAAGGGA ATTACCGGTA TCTGACTTAC

1051 GGGGCGGAAA AATTGCCCGG CGGATCGTAT GCCCTTCGTG TTCAAGGCGA

1101 ACCGGCAAAA GGCGAAATCC TTGCGGGCGC GGCCGTGTAC AACGGCGAAG
```

```
-continued
1151 TACTGCATTT CCATACGGAA AACGGCCGTC CGTACCCGAC CAGGGGCAGG

1201 TTTGCCGCAA AAGTCGATTT CGGCAGCAAA TCTGTGGACG GCATTATCGA

1251 CAGCGGCGAT GATTTGCATA TGGGTACGCA AAAATTCAAA GCCGCCATCG

1301 ATGGAAACGG CTTTAAGGGG ACTTGGACGG AAAATGGCAG CGGGGATGTT

1351 TCCGGAAAGT TTTACGGCCC GGCCGGCGAG GAAGTGGCGG GAAAATACAG

1401 CTATCGCCCG ACAGATGCGG AAAAGGGCGG ATTCGCCGTG TTTCCCGGCA

1451 AAAAGAGCA GGATTGA
```

This corresponds to the amino acid sequence <SEQ ID 1029; ORF 287>:

```
m287.pep
   1 MFKRSVIAMA CIPALSACGG GGGGSPDVKS ADTLSKPAAP VVSEKETEAR

51 EDAPQAGSQG OGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGAIQAGNNQ AAGSSDPIPA SNPAPPNGGS

201 NFCRVDLANG VLIOGPSQNI TLTHCKGDSC SGNNFLDEEV OLKSEFEKLS

251 DADKISNYKK DGKNDKFVGL VADSVQNKGI NQYIIFYKPK PTSFARFRRS

301 AASRRSLPAE MPLIPVNQAD TLIVDGEAVS LTGHSGHIFA PEGNYRYLTY

351 GAEKLPGGSY ALRVQGEPAK GENLAGAAVY NGEVLHEHTE NGRPYPTRGR

401 FAAKVDFGSK SVOGIIDSGD DLHHGTQKFK AAIDGNGFKG TWTENGSGDV

451 SGKFYGPAGE EVAGKYSYRP TDAEKGGFGV FAGXKEQD*
```

The following partial DNA sequence was identified in N. gonorrhoeae <SEQ ID 1030>:

```
g287.seq
   1 atgtttaaac gcagtgtgat tgcaatggct tgtattttc ccctttcagc 51 ctgtgggggc ggcggtggcg gatcgcccga tgtcaagtcg gcggacacgc 101 cgtcaaaacc ggccgccccc gttgttgctg aaaatgccgg ggaaggggtg 151 ctgccgaaag aaaagaaaga tgaggaggca gcgggcggtg cgccgcaagc 201 cgatacgcag gacgcaaccg ccggagaagg cagccaagat atggcggcag 251 tttcggcaga aaatacaggc aatggcggtg cggcaacaac ggacaacccc 301 aaaaatgaag acgcggggc gcaaaatgat atgccgcaaa atgccgccga 351 atccgcaaat caaacaggga acaaccaacc cgccggttct tcagattccg 401 cccccgcgtc aaaccctgcc cctgcgaatg gcggtagcga ttttggaagg 451 acgaacgtgg gcaattctgt tgtgattgac ggaccgtcgc aaaatataac 501 gttgacccac tgtaaaggcg attcttgtaa tggtgataat ttattggatg 551 aagaagcacc gtcaaaatca gaatttgaaa aattaagtga tgaagaaaaa 601 attaagcgat ataaaaaaga cgagcaacgg gagaattttg tcggtttggt 651 tgctgacagg gtaaaaaagg atggaactaa caaatatatc atcttctata 701 cggacaaacc acctactcgt tctgcacggt cgaggaggtc gcttccggcc 751 gagattccgc tgattcccgt caatcaggcc gatacgctga ttgtggatgg
```

```
 801 ggaagcggtc agcctgacgg ggcattccgg caatatcttc gcgcccgaag 851 ggaattaccg gtatctgact tacggggcgg aaaaattgcc cggcggatcg 901 tatgccctcc gtgtgcaagg cgaaccggca aaaggcgaaa tgcttgttgg 951 cacggccgtg tacaacggcg aagtgctgca tttccatatg gaaaacggcc 1001 gtccgtaccc gtccggaggc aggtttgccg caaaagtcga tttcggcagc 1051 aaatctgtgg acggcattat cgacagcggc gatgatttgc atatgggtac 1101 gcaaaaattc aaagccgcca tcgatggaaa cggctttaag gggacttgga 1151 cggaaaatgg cggcggggat gtttccggaa ggttttacgg cccggccggc 1201 gaggaagtgg cgggaaaata cagctatcgc ccgacagatg ctgaaagggg 1251 cggattcggc gtgtttgccg gcaaaaaaga tcgggattga
```

This corresponds to the amino acid sequence <SEQ ID 1031; ORF 287.ng>:

```
g287.pep
  1 MFKRSVIAMA CIFPLSACGG GGGGSPDVKS ADTPSKPAAP VVAENAGEGV

51 LPKEKKDEEA AGGAPQADTQ DATAGEGSQD MAAVSAENTG NGGAATTDNP

101 KNEDAGAQND HPQNAAESAN QTGNNQPAGS SDSAPASNPA PANGGSDFGR

151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHN ENGRPYPSGG RFAAKVDFGS

351 KSVDGIIDSG DDLHMGTQKF KAAIDGNGEK GTWTENGGGD VSGREYGPAG

401 FEVAGKYSYR PTDAEKGGFG VFAGKKDRD*
```

```
              m287/g287 ORFs 287 and 287.ng showed a 70.1%
                       identity in 499 aa overlap 10        20        30        40              49
m287.pep   MFKRSVIAMACIFALSACGGGGGSPDVKSADTLSKPAAPVVSE----------KETEA
           ||||||||||||| ||||||||| |||||||||| |||||| :|          |: ||
g287       MFRSVIAAMACIFPLSACGGGGGSPDVKSADTPAAPVVPVVAENAGEGVLPKEKKDEEA
              10        20        30        40        50        60

50        60        70        80        90       100       109
m287.pep   KEDAPQAGSQGQGAPSAQGSQDMAAVSEENTGNGGAVTADNPKNEDEVAQNDMPQNAAGT
           ||||  :|   | :::|||||||||||| :||||||||||||::|||||   |||||||
g287       AGGAPQADTQD--ATAGEGSQDMAAVSAENTGNGGAATTDNPKNEDAGAQNDMPQNAA--
              70        80        90       100       110

110       120       130       140       150       160       169
m287.pep   DSSTPNHTPDPNMLAGNMENQATDAGESSQPANQPDMANAADGMQGDDPSAGGQNAGNTA g287       ------------------------------------------------------------

170       180       190       200       210       220       229
m287.pep   AQGANQAGNNQAAGSSDPIPASNPAPANGGSNFGRVDLANGVLIDGPSQNITLTHCKGDS
           ::|||:|||| ||||| |||||||||||||:|| ::::|:|::||||||||||||||||
g287       -ESANQTGNNQPAGSSDSAPASNPAPANGGSDFGRTNVGNSVVIDGPSQNITLTHCKGDS
              120       130       140       150       160       170
```

-continued m287/g287 ORFs 287 and 287.ng showed a 70.1% identity in 499 aa overlap

```
             230       240       250       260       270       280       289
m287.pep    CSGNNFLDEEVQLKSEFEKLSDADKISNYKKDGKNDKFVGLVADSVQMKGINQYIIFYKP
            |:|:||||||:  |||||||| :||: |||| : ::||||||| |:  | |:|||||
g287        CNGDNLLDEEAPSKSEFEKLSDEEKIKRYKKDEQRENFVGLVADRVKKDGTNKYIIFYTD
              180       190       200       210       220       230

290       300       310       320       330       340       349
m287.pep    KPTSFARFRRSARSRRSLPAEMPLIPVNQADTLIVDGEAVSLTGHSGNIFAPEGNYRYLT
            || :      |||||||||||:|||||||||||||||||||||||||||||||||||||
g287        KPPT-----RSARSRRSLPAEIPLIPVNQADTLIVDGEAVSLTGHSGNIFAPEGNYRYLT
                 240       250       260       270       280       290

350       360       370       380       390       400       409
m287.pep    YGAEKIPGGSYALRVQGEPAKGEMLAGAAVYNGEVLHFHTENGRPYPTRGRFAAKVDFGS
            |||||:||||||||||||||||||||:|:||||||||||| |||||||: ||||||||||
g287        YGAEKLPGGSYALRVQGEPAKGEMLVGTAVYNGEVLHFHMENGRPYPSGGRFAAKVDFGS
                 300       310       320       330       340       350

410       420       430       440       450       460       469
m287.pep    KSVDGIIDSGDDLHMGTQKFKAAIDGNGFKGTWTENGSGDVSGKFYGPAGEEVAGKYSYR
            ||||||||||||||||||||||||||||||||||||:|||||:|||||||||||||||
g287        KSVDGIIDSGDDLHMGTQKFKAAIDGNGFKGTWTENGGGDVSGRFYGPAGEEVAGKYSYR
                 360       370       380       390       400       410

470       480       489
m287.pep    PTDAEKGGFGVFAGKKEQDX  SEQ ID NO: 1029
            |||||||||||:||||::||
g287        PTDAEKGGFGVGAGKKDRDX  SEQ ID NO: 1031
                 420       430
```

The following partial DNA sequence was identified in *N. meningitidis* <SEQ ID 1032>:

```
a287.seq
      1 ATGTTTAAAC GCAGTGTGAT TGCAATGGCT TGTATTGTTG CCCTTTCAGC

51 CTGTGGGGGC GGCGGTGGCG GATCGCCCGA TGTTAAGTCG GCGGACACGC

101 TGTCAAAACC TGCCGCCCCT GTTGTTACTG AAGATGTCGG GGAAGAGGTG

151 CTGCCGAAAG AAAAGAAAGA TGAGGAGGCG GTGACTGGTG CGCCGCAAGC

201 CGATACGCAG GACGCAACCG CCGGAAAAGG CGGTCAAGAT ATGGCGGCAG

251 TTTCGGCAGA AAATACAGGC AATGGCGGTG CGGCAACAAC GGATAATCCC

301 GAAAATAAAG ACGAGGGACC GCAAAATGAT ATGCCGCAAA ATGCCGCCGA

351 TACAGATAGT TCGACACCGA ATCACACCCC TGCACCGAAT ATGCCAACCA

401 GAGATATGGG AAACCAAGCA CCGGATGCCG GGGAATCGGC ACAACCGGCA

451 AACCAACCGG ATATGGCAAA TGCGGCGGAC GGAATGCAGG GGGACGATCC

501 GTCGGCAGGG GAAAATGCCG GCAATACGGC AGATCAAGCT GCAAATCAAG

551 CTGAAAACAA TCAAGTCGGC GGCTCTCAAA ATCCTGCCTC TTCAACCAAT

601 CCTAACGCCA CGAATGGCCG CAGCGATTTT GGAAGGATAA ATGTAGCTAA

651 TGGCATCAAG CTTGACAGCG GTTCGGAAAA TGTAACGTTG ACACATTGTA

701 AAGACAAAGT ATGCGATAGA GATTTCTTAG ATGAAGAAGC ACCACCAAAA

751 TCAGAATTTG AAAAATTAAG TGATGAAGAA AAAATTAATA AATATAAAAA

801 AGACGAGCAA CGAGAGAATT TTGTCGGTTT GGTTGCTGAC AGGGTAGAAA

851 AGAATGGAAC TAACAAATAT GTCATCATTT ATAAAGACAA GTCCGCTTCA

901 TCTTCATCTG CGCGATTCAG GCGTTCTGCA CGGTCGAGGC GGTCGCTTCC
```

```
 951 GGCCGAGATG CCGCTGATTC CCGTCAATCA GGCGGATACG CTGATTGTCG

1001 ATGGGGAAGC GGTCAGCCTG ACGGGGCATT CCGGCAATAT CTTCGCGCCC

1051 GAAGGGAATT ACCGGTATCT GACTTACGGG GCGGAAAAAT TGTCCGGCGG

1101 ATCGTATGCC CTCAGTGTGC AAGGCGAACC GGCAAAAGGC GAAATGCTTG

1151 CGGGCACGGC CGTGTACAAC GGCGAAGTGC TGCATTTCCA TATGGAAAAC

1201 GGCCGTCCGT CCCCGTCCGG AGGCAGGTTT GCCGCAAAAG TCGATTTCGG

1251 CAGCAAATCT GTGGACGGCA TTATCGACAG CGGCGATGAT TTGCATATGG

1301 GTACGCAAAA ATTCAAAGCC GTTATCGATG GAAACGGCTT TAAGGGGACT

1351 TGGACGGAAA ATGGCGGCGG GGATGTTTCC GGAAGGTTTT ACGGCCCGGC

1401 CGGCGAAGAA GTGGCGGGAA AATACAGCTA TCGCCCGACA GATGCGGAAA

1451 AGGGCGGATT CGGCGTGTTT GCCGGCAAAA AAGAGCAGGA TTGA
                                                20
```

This corresponds to the amino acid sequence <SEQ ID 1033; ORF 287.a>:

```
a287.pep
   1 MFKRSVIAMA CIVALSACGG GGGGSPDVKS ADTLSKPAAP VVTEDVGEEV

51 LPKEKKDEEA VSGAPQADTQ DATAGKGGQD MAAVSAENTG NGGAATTDNP

101 ENKDEGPQND MPQNAADTDS STPNHTPAPN MPTRDMGNQA PDAGESAQPA

151 NQPDMANAAD GMQGDDPSAG ENAGNTADQA ANQAENNQVG GSQNPASSTN

201 PNATNGGSDF GRINVANGIK LDSGSENVTL THCKDKVCDR DFLDEEAPPK

251 SEFEKLSDEE KINKYKKDEQ RENFVGLVAD RVEKNGTNKY VIIYKDKSAS

301 SSSARFRRSA RSRRSLPAEM PLIPVNQADT LIVDGEAVSL TGHSGNIFAP

351 EGNYRYLTYG AEKLSGGSYA LSVQGEPAKG EMLAGTAVYN GEVLHFHMEN

401 GRPSPSGGRF AAKVDFGSKS VDGIIDSGDD LHMGTQKFKA VIDGNGFKGT

451 WTENGGGDVS GRFYGPAGEE VAGKYSYRPT DAEKGGFGVF AGKKEQD*
```

```
             m287/a287 ORFs 287 and 287.a showed a 77.2%
                       identity in 501 aa overlap 10         20         30         40              49
m287.pep   MFKRSVIAMACIFALSACGGGGGGSPDVKSADTLSKPAAPVVSE-----------KETEA
           ||||||||||||  |||||||||||||||||||||||||||||:           |: ||
a287       MFKRSVIAMACIVALSACGGGGGGSPDVKSADTLSKPAAPVVTEDVGEEVLPKEKKDEEA
                  10         20         30         40         50         60

50         60         70         80         90        100        109
m287.pep   KEDAPQAGSQGQGAPSAQGSQDMAAVSEENTGNGGAVTADNPKNEDEVAQNDMPQNAAGT
             ||||  :|   :::|:||||||||||||||||||  |||||  |||  :|||||||| 
a287       VSGAPQADTQ--DATAGKGGQDMAAVSAENTGNGGAATTDNPENKDEGPQNDMPQNAADT
                  70         80         90        100        110

110        120        130        140        150        160        169
m287.pep   DSSTPNHTPDPNMIAGNMENQATDAGESSQPANQPDMANAADGMQGDDPSAGGQNAGNTA
           ||||||||||  |  : :|  |||  ||||:||||||||||||||||||||||  :||||||
a287       DSSTPNHTPAPNMPTRDMGNQAPDAGESAQPANQPDMANAADGMQGDDPSAG-ENAGNTA
                 120        130        140        150        160        170

170        180        190        200        210        220        229
m287.pep   AQGANQAGNNQAAGSSDPIPASNPAPANGGSNFGRVDLANGVLIDGPSQNITLTHCKGDS
           |:||| |||:::|::  ::||  :||||:|||:::|||  :|: |:|:||||||||
a287       DQAANGAENNQVGGSQNPASSTNPNATNGGSDFGRINVANGIKLDSGSENVTLTHCKDKV
                 180        190        200        210        220        230
```

-continued

| m287/a287 ORFs 287 and 287.a showed a 77.2% identity in 501 aa overlap |
|---|

```
              230        240        250        260        270        280     289
m287.pep   CSGNNFLDEEVQLKSEFEKLSDADKISNYKKDGKNDKFVGLVADSVQMKGINQYIIFYKP
           |: :||||:  |||||||||| :||::||||  : ::||||||| |: :| |:|:|:||
a287       CD-RDFLDEEAPPKSEFEKLSDEEKINKYKKDEQRENFVGLVADRVEKNGTNKYVIIYKD
              240        250        260        270        280        290

290        300        310        320        330        340
m287.pep   KP--TSFARFRRSARSRRSLPAEMPLIPVNQADILIVDGEAVSLTGHSGNIFAPEGNYRY
           |  :| ||||||||||||||||||||||||||||||||||||||||||||||||||||||
a287       KSASSSSARFRRSARSRRSLPAEMPLIPVNQADILIVDGEAVSLTGHSGNIFAPEGNYRY
              300        310        320        330        340        350

350        360        370        380        390        400
m287.pep   LTYGAEKLPGGSYALRVQGEPAKGEMLAGAAVYNGEVLHFHTENGRPYPTRGRFAAKVDF
           ||||||||| ||||||| |||||||||||||:|||||||||| |: |||||||||||||
a287       LTYGAEKLSGGSYALSVQGEPAKGEMLAGTAVYNGEVLHFHMENGRPSPSGGRFAAKVDF
              360        370        380        390        400        410

410        420        430        440        450        460
m287.pep   GSKSVDGIIDSGDDLHMGTQKFKAAIDGNGFKGTWTENGSGDVSGKFYGPAGEEVAGKYS
           ||| ||||||||||||||||||||| |||||||||||||  |||| |||||||||||||
a287       GSK-VDGIIDSGDDLHMGTQKFKAVIDGNGFKGTWTENGGGDVSGRFYGPAGEEVAGKYS
              420        430        440        450        460        470

470        480     489
m287.pep   YRPTDAEKGGFGVGAGKKEQDX    SEQ ID NO: 1029
           ||||||||||||| ||||||||
a287       YRPTDAEKGGFGFAGKKEQDEX    SEQ ID NO: 1033
```

406

The following partial DNA sequence was identified in *N. meningitidis* <SEQ ID 1034>:

```
m406.seq
    1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TTGCGGTCGA CAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAATTGCTC ATCAAACCAA AAACCAATGC GTTTGAAGCT

751 GCCTATAAAG AAAATTACGC ATTGTGGATG GGGCCGTATA AAGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC
```

```
-continued
901 AGTCATGAGG GGTATGGATA CAGCGATGAA GTAGTGCGAC AACATAGACA

951 AGGACAACCT TGA
```

This corresponds to the amino acid sequence <SEQ ID 1035; ORF 406>:

```
m406.pep
    1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

The following partial DNA sequence was identified in *N. gonorrhoeae* <SEQ ID 1036>:

```
g406.seq
    1 ATGCGGGCAC GGCTGCTGAT ACCTATTCTT TTTTCAGTTT TTATTTTATC

51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AGTAAGCAA

801 AGGAATCAAA CCGACGGAAG GATTGATGGT CGATTTCTCC GATATCCAAC

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 1037; ORF 406.ng>:

```
g406.pep
    1 MRARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

```
              ORF 406.ng shows 98.8% identity over a 320
                    aa overlap with a predicted ORF
                    (ORF406.a) from N. gonorrhoeae.
                               g406/m406

10         20         30         40         50         60
g406.pep  MRARLLIPILFSVFILSACGTLTGIPSHGGGKRFAVEQELVAASARAAVKDMDLQALHGR
          |:||||||||||||||||||||||||||||||||||||||:|||||||||||||||||||
m406      MQARLLIPILFSVFILSACGTLTGIPSHGGGKRFAVEQEFLVAASARAAVKDMDLQALHGR
                  10         20         30         40         50         60

70         80         90        100        110        120
g406.pep  KVALYIATMGDQGSGSLTGGRYSIDALIRGEYINSPAVRTDYTYPRYETTAETTSGGLTG
          |||||||||||||||||||||||||||||||||||||||||:|||||||||||||||||||
m406      KVALYIATMGDQGSGSLTGGRYSIDALIRGEYINSPAVRTFYTYPRYETTAETTSGGLTG
                  70         80         90        100        110        120

130        140        150        160        170        180
g406.pep  LTTSLSTLNAPALSRTQSDGSGSRSSLGLNIGGMGDYRNETLTTNPRDTAFLSHLVQTVF
          |||||||||||||||||||||||||:|||||||||||||||||||||||||||||||||||
m406      LTTSLSTLNAPALSRTQSDGSGSKSSLGLNIGGMGDYRNETLTTNPRDTAFLSHLVQTVF
                 130        140        150        160        170        180

190        200        210        220        230        240
g406.pep  FLRGIDVVSPANADTDVFINIDVFGTIRNRTEMHLYNAFTLKAQTKLEYFAVDRTNKKLL
          |||||||||||||||:||||||||||||||||||||||:|||||||||||||||||||||
m406      FLRGIDVVSPANADIDVFINIDVFGTIRNRTEMHLYANETLKAQTKLEYFAVDRTNKKLL
                 190        200        210        220        230        240

250        260        270        280        290        300
g406.pep  IKPKTNAFEAAYKENYALWMGPYKVSKGIKPTEGLMVDFSDIQPYGNHTGNSAPSVEADN
          ||||||||||||||||||||||||||||||||||||||||||:|||||||||||||||||
m406      IKPKTNAFEAAYKENYALWMGPYKVSKGIKPTEGLMVDFSDIRPYGNHTGNSAPSVEADN
                 250        260        270        280        290        300

310        320
g406.pep  SHEGYGYSDEAVRQHRQGQPX     SEQ ID NO: 1037
          ||||||||||:||||||||||
m406      SHEGYGYSDEVVRQHRQGQPX     SEQ ID NO: 1035
                 310        320
```

The following partial DNA sequence was identified in N. meningitidis <SEQ ID 1038>:

```
a406.seq
    1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA
```

```
                        -continued
251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CGCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACGGATGT GTTTATTAAC

601 ATCGACGTAT TCGGAACGAT ACGAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGACCGTATA AAGTAAGCAA

801 AGGAATTAAA CCGACAGAAG GATTAATGGT CGATTTCTCC GATATCCAAC

851 CATACGGCAA TCATATGGGT AACTCTGCCC CATCCGTAGA GGCTGATAAC

901 AGTCATGAGG GGTATGGATA CAGCGATGAA GCAGTGCGAC GACATAGACA

951 AGGGCAACCT TGA
```

This corresponds to the amino acid sequence <SEQ ID 1039; ORF 406.a>:

```
a406.pep
  1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHMG NSAPSVEADN

301 SHEGYGYSDE AVRRHRQGQP *
```

| m406/a406 ORFs 406 and 406.a showed a 98.8% identity in 320 aa overlap |
|---|

```
                  10         20         30         40         50         60
m406.pep  MQARLLIPILFSVFILSACGTLTGIPSHGGGKRFAVEQELVAASARAAVKDMDLQALHGR
          ||||||||||||||||||||||||||||||||||||||||||||||||||||||||||||
a406      MQARLLIPILFSVFILSACGTLTGIPSHGGGKRFAVEQELVAASARAAVKDMDLQALHGR
                  10         20         30         40         50         60

70         80         90        100        110        120
m406.pep  KVALYIATMGDQGSGSLTGGRYSIDALIRGEYINSPAVRTDYTYPRYETTAETTSGGLTG
          |||||||||||||||||||||||||||||||||||||||||||||||||||| |||||||
a406      KVALYIATMGDQGSGSLTGGRYSIDALIRGEYINSPAVRTDYTYPRYETTATTTSGGLTG
                  70         80         90        100        110        120

130        140        150        160        170        180
m406.pep  LTTSLSTLNAPALSRTQSDGSGSKSSLGLNIGGMGDYRNETLTTNPRDTAFLSHLVQTVF
          ||||||||||||||||||||||||||||||||||||||||||||||||||||||||||||
a406      LTTSLSTLNAPALSRTQSDGSGSKSSLGLNIGGMGDYRNETLTTNPRDTAFLSHLVQTVF
                 130        140        150        160        170        180
```

-continued

```
          m406/a406 ORFs 406 and 406.a showed a 98.8%
                 identity in 320 aa overlap 190       200       210       220       230       240
m406.pep    FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
a406        FLRGIDVVSPANADTDVFINIDVFGTIRNRTEMHLYNAETLKAQTKLEYFAVDRTNKKLL
                     190       200       210       220       230       240

250       260       270       280       290       300
m406.pep    IKPKTNAFEAAYKENYALWMGPYKVSKGIKPTEGLMVDFSDIRPYGNHTGNSAPSVEADN
            ||||||||||||||||||||||||||||||||||||||||||:||||| ||||||||||| 
a406        IKPKTNAFEAAYKENYALWMGPYKVSKGIKPTEGLMVDFSDIQPYGNHMGNSAPSVEADN
                     250       260       270       280       290       300

310       320
m406.pep    SHEGYGYSDEVVRQHRQGQPX  SEQ ID NO: 1035
            ||||||||||||||||||||
a406        SHEGYGYSDEVVRQHRQGQPX  SEQ ID NO: 1039
                     310       320
```

The following partial DNA sequence was identified in *N. meningitidis* <SEQ ID 1040>:

```
m726.seq
    1 ATGACCATCT ATTTCAAAAA CGGCTTTTAC GACGACACAT TGGGCGGCAT

51 CCCCGAAGGC GCGGTTGCCG TCCGCGCCGA AGAATACGCC GCCCTTTTGG

101 CAGGACAGGC GCAGGGCGGG CAGATTGCCG CAGATTCCGA CGGCCGCCCC

151 GTTTTAACCC CGCCGCGCCC GTCCGATTAC CACGAATGGG ACGGCAAAAA

201 ATGGAAAATC AGCAAAGCCG CCGCCGCCGC CCGTTTCGCC AAACAAAAAA

251 CCGCCTTGGC ATTCCGCCTC GCGGAAAAGG CGGACGAACT CAAAAACAGC

301 CTCTTGGCGG GCTATCCCCA AGTGGAAATC GACAGCTTTT ACAGGCAGGA

351 AAAAGAAGCC CTCGCGCGGC AGGCGGACAA CAACGCCCCG ACCCCGATGC

401 TGGCGCAAAT CGCCGCCGCA AGGGGCGTGG AATTGGACGT TTTGATTGAA

451 AAAGTTATCG AAAAATCCGC CCGCCTGGCT GTTGCCGCCG GCGCGATTAT

501 CGGAAAGCGT CAGCAGCTCG AAGACAAATT GAACACCATC GAAACCGCGC

551 CCGGATTGGA CGCGCTGGAA AAGGAAATCG AAGAATGGAC GCTAAACATC

601 GGCTGA
```

This corresponds to the amino acid sequence <SEQ ID 1041; ORF 726>:

```
m726.pep
    1 MTIYFKNGFY DDTLGGIPEG AVAVRAEEYA ALLAGQAQGG QIAADSDGRP

51 VLTPPRPSDY HEWDGKKWKI SKAAAAARFA KQKTALAFRL AEKADELKNS

101 LLAGYPQVEI DSFYRQEKEA LARQADNNAP TPMLAQIAAA RGVELDVLIE

151 KVIEKSARLA VAAGAIIGKR QQLEDKLNTI ETAPGLDALE KEIEEWTLNI

201 G*
```

The following partial DNA sequence was identified in *N. meningitidis* <SEQ ID 1042>:

```
m907-2.seq
    1 ATGAGAAAAC CGACCGATAC CCTACCCGTT AATCTGCAAC GCCGCCGCCT
   51 GTTGTGTGCC GCCGGTGCGT TGTTGCTCAG TCCTCTGGCG CACGCCGGCG
  101 CGCAACGTGA GGAAACGCTT GCCGACGATG TGGCTTCCGT GATGAGGAGT
  151 TCTGTCGGCA GCGTCAATCC GCCGAGGCTG GTGTTTGACA ATCCGAAAGA
  201 GGGCGAGCGT TGGTTGTCTG CCATGTCGGC ACGTTTGGCA AGGTTCGTCC
  251 CCGAGGAGGA GGAGCGGCGC AGGCTGCTGG TCAATATCCA GTACGAAAGC
  301 AGCCGGGCCG GTTTGGATAC GCAGATTGTG TTGGGGCTGA TTGAGGTGGA
  351 AAGCGCGTTC CGCCAGTATG CAATCAGCGG TGTCGGCGCG CGCGGCCTGA
  401 TGCAGGTTAT GCCGTTTTGG AAAAACTACA TCGGCAAACC GGCGCACAAC
  451 CTGTTCGACA TCCGCACCAA CCTGCGTTAC GGCTGTACCA TCCTGCGCCA
  501 TTACCGGAAT CTTGAAAAAG GCAACATCGT CCGCGCGCTT GCCCGCTTTA
  551 ACGGCAGCTT GGGCAGCAAT AAATATCCGA ACGCCGTTTT GGGCGCGTGG
  601 CGCAACCGCT GGCAGTGGCG TTGA
```

This corresponds to the amino acid sequence <SEQ ID 1043; ORF 907-2>:

```
m907-2.pep
    1 MRKPTDTLPV NLQRRRLLCA AGALLLSPLA HAGAQREETL ADDVASVMRS
   51 SVGSVNPPRL VFDNPKEGER WLSAMSARLA REVPEEEERR RLLVNIQYES
  101 SRAGLDTQIV LGLIEVESAF RQYAISGVGA RGLMQVMPFW KNYIGKPAHN
  151 LFDIRTNLRY GCTILRHYRN LEKGNIVRAL ARFNGSLGSN KYPNAVLGAW
  201 RNRWQWR*
```

The following partial DNA sequence was identified in *N. meningitidis* <SEQ ID 1044>:

```
m953.seq
    1 ATGAAAAAAA TCATCTTCGC CGCACTCGCA GCCGCCGCCA TCAGTACTGC
   51 CTCCGCCGCC ACCTACAAAG TGGACGAATA TCACGCCAAC GCCCGTTTCG
  101 CCATCGACCA TTTCAACACC AGCACCAACG TCGGCCGTTT TTACGGTCTG
  151 ACCGGTTCCG TCGAGTTCGA CCAAGCAAAA CGCGACGGTA AAATCGACAT
  201 CACCATCCCC ATTGCCAACC TGCAAAGCGG TTCGCAACAC TTTACCGACC
  251 ACCTGAAATC AGCCGACATC TTCGATGCCG CCCAATATCC GGACATCCGC
  301 TTTGTTTCCA CCAAATTCAA CTTCAACGGC AAAAAACTGG TTTCCGTTGA
  351 CGGCAACCTG ACCATGCACG GCAAAACCGC CCCCGTCAAA CTCAAAGCCG
  401 AAAAATTCAA CTGCTACCAA AGCCCGATGG AGAAAACCGA AGTTTGTGGC
  451 GGCGACTTCA GCACCACCAT CGACCGCACC AAATGGGGCA TGGACTACCT
  501 CGTTAACGTT GGTATGACCA AAAGCGTCCG CATCGACATC CAAATCGAGG
  551 CAGCCAAACA ATAA
```

This corresponds to the amino acid sequence <SEQ ID 1045; ORF 953>:

```
m953.pep
    1 MKKIIFAALA AAAISTASAA TYKVDEYHAN ARFAIDHFNT STNVGGFYGL

51 TGSVEFDQAK RDGKIDITIP IANLQSGSQH FTDHLKSADI FDAAQYPDIR

101 FVSTKFNFNG KKLVSVDGNL TNHGKTAPVK LKAEKFNCYQ SPMEKTEVCG

151 GDFSTTIDRT KWGMDYLVNV GMTKSVRIDI QIEAAKQ*
```

The following partial DNA sequence was identified in *N. meningitidis* <SEQ ID 1046>:

```
orf1-1.seq
       1 ATGAAAACAA CCGACAAACG GACAACCGAA ACACACCGCA AAGCCCCGAA

51 AACCGGCCGC ATCCGCTTCT CGCCTGCTTA CTTAGCCATA TGCCTGTCGT

101 TCGGCATTCT TCCCCAAGCC TGGGCGGGAC ACACTTATTT CGGCATCAAC

151 TACCAATACT ATCGCGACTT TGCCGAAAAT AAAGGCAAGT TTGCAGTCGG

201 GGCGAAAGAT ATTGAGGTTT ACAACAAAAA AGGGGAGTTG GTCGGCAAAT

251 CAATGACAAA AGCCCCGATG ATTGATTTTT CTGTGGTGTC GCGTAACGGC

301 GTGGCGGCAT TGGTGGGCGA TCAATATATT GTGAGCGTGG CACATAACGG

351 CGGCTATAAC AACGTTGATT TTGGTGCGGA AGGAAGAAAT CCCGATCAAC

401 ATCGTTTTAC TTATAAAATT GTGAAACGGA ATAATTATAA AGCAGGGACT

451 AAAGGCCATC CTTATGGCGG CGATTATCAT ATGCCGCGTT TGCATAAATT

501 TGTCACAGAT GCAGAACCTG TTGAAATGAC CAGTTATATG GATGGGCGGA

551 AATATATCGA TCAAAATAAT TACCCTGACC GTGTTCGTAT TGGGGCAGGC

601 AGGCAATATT GGCGATCTGA TGAAGATGAG CCCAATAACC GCGAAAGTTC

651 ATATCATATT GCAAGTGCGT ATTCTTGGCT CGTTGGTGGC AATACCTTTG

701 CACAAAATGG ATCAGGTGGT GGCACAGTCA ACTTAGGTAG TGAAAAAATT

751 AAACATAGCC CATATGGTTT TTTACCAACA GGAGGCTCAT TTGGCGACAG

801 TGGCTCACCA ATGTTTATCT ATGATGCCCA AAAGCAAAAG TGGTTAATTA

851 ATGGGGTATT GCAAACGGGC AACCCCTATA TAGGAAAAAG CAATGGCTTC

901 CAGCTGGTTC GTAAAGATTG GTTCTATGAT GAAATCTTTG CTGGAGATAC

951 CCATTCAGTA TTCTACGAAC CACGTCAAAA TGGGAAATAC TCTTTTAACG

1001 ACGATAATAA TGGCACAGGA AAAATCAATG CCAAACATGA ACACAATTCT

1051 CTGCCTAATA GATTAAAAAC ACGAACCGTT CAATTGTTTA ATGTTTCTTT

1101 ATCCGAGACA GCAAGAGAAC CTGTTTATCA TGCTGCAGGT GGTGTCAACA

1151 GTTATCGACC CAGACTGAAT AATGGAGAAA ATATTTCCTT TATTGACGAA

1201 GGAAAAGGCG AATTGATACT TACCAGCAAC ATCAATCAAG GTGCTGGAGG

1251 ATTATATTTC CAAGGAGATT TTACGGTCTC GCCTGAAAAT AACGAAACTT

1301 GGCAAGGCGC GGGCGTTCAT ATCAGTGAAG ACAGTACCGT TACTTGGAAA

1351 GTAAACGGCG TGGCAAACGA CCGCCTGTCC AAAATCGGCA AAGGCACGCT

1401 GCACGTTCAA GCCAAAGGGG AAAACCAAGG CTCGATCAGC GTGGGCGACG

1451 GTACAGTCAT TTTGGATCAG CAGGCAGACG ATAAAGGCAA AAAACAAGCC
```

```
-continued
1501 TTTAGTGAAA TCGGCTTGGT CAGCGGCAGG GGTACGGTGC AACTGAATGC

1551 CGATAATCAG TTCAACCCCG ACAAACTCTA TTTCGGCTTT CGCGGCGGAC

1601 GTTTGGATTT AAACGGGCAT TCGCTTTCGT TCCACCGTAT TCAAAATACC

1651 GATGAAGGGG CGATGATTGT CAACCACAAT CAAGACAAAG AATCCACCGT

1701 TACCATTACA GGCAATAAAG ATATTGCTAC AACCGGCAAT AACAACAGCT

1751 TGGATAGCAA AAAAGAAATT GCCTACAACG GTTGGTTTGG CGAGAAAGAT

1801 ACGACCAAAA CGAACGGGCG GCTCAACCTT GTTTACCAGC CCGCCGCAGA

1851 AGACCGCACC CTGCTGCTTT CCGGCCGAAC AAATTTAAAC GGCAACATCA

1901 CGCAAACAAA CGGCAAACTG TTTTTCAGCG GCAGACCAAC ACCGCACGCC

1951 TACAATCATT TAAACGACCA TTGGTCGCAA AAGAGGGCA TTCCTCGCGG

2001 GGAAATCGTG TGGGACAACG ACTGGATCAA CCGCACATTT AAAGCGGAAA

2051 ACTTCCAAAT TAAAGGCGGA CAGGCGGTGG TTTCCCGCAA TGTTGCCAAA

2101 GTGAAAGGCG ATTGGCATTT GAGCAATCAC GCCCAAGCAG TTTTTGGTGT

2151 CGCACCGCAT CAAAGCCACA CAATCTGTAC ACGTTCGGAC TGGACGGGTC

2201 TGACAAATTG TGTCGAAAAA ACCATTACCG ACGATAAAGT GATTGCTTCA

2251 TTGACTAAGA CCGACATCAG CGGCAATGTC GATCTTGCCG ATCACGCTCA

2301 TTTAAATCTC ACAGGGCTTG CCACACTCAA CGGCAATCTT AGTGCAAATG

2351 GCGATACACG TTATACAGTC AGCCACAACG CCACCCAAAA CGGCAACCTT

2401 AGCCTCGTGG GCAATGCCCA AGCAACATTT AATCAAGCCA CATTAAACGG

2451 CAACACATCG GCTTCGGGCA ATGCTTCATT TAATCTAAGC GACCACGCCG

2501 TACAAAACGG CAGTCTGACG CTTTCCGGCA ACGCTAAGGC AAACGTAAGC

2551 CATTCCGCAC TCAACGGTAA TGTCTCCCTA GCCGATAAGG CAGTATTCCA

2601 TTTTGAAAGC AGCCGCTTTA CCGGACAAAT CAGCGGCGGC AAGGATACGG

2651 CATTACACTT AAAAGACAGC GAATGGACGC TGCCGTCAGG CACGGAATTA

2701 GGCAATTTAA ACCTTGACAA CGCCACCATT ACACTCAATT CCGCCTATCG

2751 CCACGATGCG GCAGGGGCGC AAACCGGCAG TGCGACAGAT GCGCCGCGCC

2801 GCCGTTCGCG CCGTTCGCGC CGTTCCCTAT TATCCGTTAC ACCGCCAACT

2851 TCGGTAGAAT CCCGTTTCAA CACGCTGACG GTAAACGGCA AATTGAACGG

2901 TCAGGGAACA TTCCGCTTTA TGTCGGAACT CTTCGGCTAC CGCAGCGACA

2951 AATTGAAGCT GGCGGAAAGT TCCGAAGGCA CTTACACCTT CGCGGTCAAC

3001 AATACCGGCA ACGAACCTGC AAGCCTCGAA CAATTGACGG TACTGGAAGG

3051 AAAAGACAAC AAACCGCTGT CCGAAAACCT TAATTTCACC CTGCAAAACG

3101 AACACGTCGA TGCCGGCGCG TGGCGTTACC AACTCATCCG CAAAGACGGC

3151 GAGTTCCGCC TGCATAATCC GGTCAAAGAA CAAGAGCTTT CCGACAAACT

3201 CGGCAAGGCA GAAGCCAAAA ACAGGCGGA AAAAGACAAC GCGCAAAGCC

3251 TTGACGCGCT GATTGCGGCC GGGCGCGATG CCGTCGAAAA GACAGAAAGC

3301 GTTGCCGAAC CGGCCCGGCA GGCAGGCGGG GAAAATGTCG GCATTATGCA

3351 GGCGGAGGAA GAGAAAAAAC GGGTGCAGGC GGATAAAGAC ACCGCCTTGG

3401 CGAAACAGCG CGAAGCGGAA ACCCGGCCGG CTACCACCGC CTTCCCCCGC

3451 GCCCGCCGCG CCCGCCGGGA TTTGCCGCAA CTGCAACCCC AACCGCAGCC
```

-continued

```
3501 CCAACCGCAG CGCGACCTGA TCAGCCGTTA TGCCAATAGC GGTTTGAGTG

3551 AATTTTCCGC CACGCTCAAC AGCGTTTTCG CCGTACAGGA CGAATTAGAC

3601 CGCGTATTTG CCGAAGACCG CCGCAACGCC GTTTGGACAA GCGGCATCCG

3651 GGACACCAAA CACTACCGTT CGCAAGATTT CCGCGCCTAC CGCCAACAAA

3701 CCGACCTGCG CCAAATCGGT ATGCAGAAAA ACCTCGGCAG CGGGCGCGTC

3751 GGCATCCTGT TTTCGCACAA CCGGACCGAA AACACCTTCG ACGACGGCAT

3801 CGGCAACTCG GCACGGCTTG CCCACGGCGC CGTTTTCGGG CAATACGGCA

3851 TCGACAGGTT CTACATCGGC ATCAGCGCGG GCGCGGGTTT TAGCAGCGGC

3901 AGCCTTTCAG ACGGCATCGG AGGCAAAATC CGCCGCCGCG TGCTGCATTA

3951 CGGCATTCAG GCACGATACC GCGCCGGTTT CGGCGGATTC GGCATCGAAC

4001 CGCACATCGG CGCAACGCGC TATTTCGTCC AAAAAGCGGA TTACCGCTAC

4051 GAAAACGTCA ATATCGCCAC CCCCGGCCTT GCATTCAACC GCTACCGCGC

4101 GGGCATTAAG GCAGATTATT CATTCAAACC GGCGCAACAC ATTTCCATCA

4151 CGCCTTATTT GAGCCTGTCC TATACCGATG CCGCTTCGGG CAAAGTCCGA

4201 ACACGCGTCA ATACCGCCGT ATTGGCTCAG GATTTCGGCA AAACCCGCAG

4251 TGCGGAATGG GGCGTAAACG CCGAAATCAA AGGTTTCACG CTGTCCCTCC

4301 ACGCTGCCGC CGCCAAAGGC CCGCAACTGG AAGCGCAACA CAGCGCGGGC

4351 ATCAAATTAG GCTACCGCTG GTAA
```

This corresponds to the amino acid sequence <SEQ ID 1047; ORF orf1-1>:

```
orf1-1.pep
      1 MKTTDKRTTE THRKAPKTGR IRFSPAYLAI CLSFGILPQA WAGHTYFGIN

51 YQYYRDFAEN KGKFAVGAKD IEVYNKKGEL VGKSMTKAPM IDFSVVSRNG

101 VAALVGDQYI VSVAHNGGYN NVDEGAEGRN PDQHRFTYKI VKRNNYRAGT

151 KGHPYGGDYH MPRLHKFVTD AEPVEMTSYM DGRKYIDQNN YPDRVRIGAG

201 RQYWRSDEDE PNNRESSYHI ASAYSWLVGG NTFAQNGSGG GTVNLGSEKI

251 KHSPYGFLPT GGSFGDSGSP MFIYDAQKQK WLIVGVLQTG NPYIGKSNGF

301 QLVRKDWFYD EIFAGDTHSV FYEPRQNGKY SFNDDNNGTG KINAKHEHNS

351 LPNRLKTRTV QLFNVSLSET AREPVYHAAG GVNSYRPRLN NGENISFIDE

401 GKGELILTSN INQGAGGLYF QGDFTVSPEN NETWQGAVH ISEDSTVTWK

451 VNGVANDRLS KIGKCTLHVQ AKGENQGSIS VGDGTVILDQ QADDKGKKQA

501 FSEIGLVSGR GTVQLNADNQ FNPDKLYFGF RGGRLDLNGH SLSFHRIQNT

551 DEGAMIVNHN QDKESTVTIT GNKDIATTGN NNSLDSKKEI AYNGWFGEKD

601 TTKTNGRLNL VYQPAAEDRT LLLSGGTNLN GNITQTNGKL FFSGRPTPHA

651 YNHLNDHWSQ KEGIPRGEIV WDNDWINRTF KAENFQIKGG QAVVSRNVAK

701 VKGDWHLSNH AQAVFGVAPH QSHTICTRSD WTGLTNCVEK TITDDKVIAS

751 LTKTDISGNV DLADHAHLNL TGLATLNGNL SANGDTRYTV SHNATQNGNL

801 SLVGNAQATF NQATLNGNTS ASGNASFNLS DHAVQNGSLT LSGNAKANVS

851 HSALNGNVSL ADKAVFHFES SRFTGQISGG KDTALHLKDS EWTLPSGTEL
```

```
-continued
 901 GNLNLDNATI TLNSAYRHDA AGAQTGSATD APRRRSRRSR RSLLSVTPPT

951 SVESRFNTLT VNGKLNGQGT FRFMSELFGY RSDKLKLAES SEGTYTLAVN

1001 NTGNEPASLE QLTVVEGKDN KPLSENLNFT LQNEHVDAGA WRYQLIRKDG

1051 EFRLHNPVKE QELSDKLGKA EAKKQAEKDN AQSLDALIAA GRDAVEKTES

1101 VAEPARQAGG ENVGIMQAEE EKKRVQADKD TALAKQREAE TRPATTAFPR

1151 ARRARRDLPQ LQPQPQPQPQ RDLISRYNAS GLSEFSATLN SVFAVQDELD

1201 RVFAEDRRNA VWTSGIRDTK HYRSQDFRAY RQQTDLRQIG MQKNLGSGRV

1251 GILFSHNRTE NTFDDGIGNS ARLAHGAVFG QYGIDRFYIG ISAGAGFSSG

1301 SLSDGIGGKI RRRVLHYGIQ ARYRAGFGGF GIEPHIGATR YFVQKADYRY

1351 ENVNIATPGL AFNRYRAGIK ADYSFKPAQH ISITPYLSLS YTDAASGKVR

1401 TRVNTAVLAQ DFGKTRSAEW GVNAEIKGFT LSLHAAAAKG PQLEAQHSAG

1451 IKLGYRW*
```

The following partial DNA sequence was identified in *N. meningitidis* <SEQ ID 1048>:

```
orf46-2.seq
   1 TTGGGCATTT CCCGCAAAAT ATCCCTTATT CTGTCCATAC TGGCAGTGTG

51 CCTGCCGATG CATGCACACG CCTCAGATTT GGCAAACGAT TCTTTTATCC

101 GGCAGGTTCT CGACCGTCAG CATTTCGAAC CCGACGGGAA ATACCACCTA

151 TTCGGCAGCA GGGGGGAACT TGCCGAGCGC AGCGGCCATA TCGGATTGGG

201 AAAAATACAA AGCCATCAGT TGGGCAACCT GATGATTCAA CAGGCGGCCA

251 TTAAAGGAAA TATCGGCTAC ATTGTCCGCT TTTCCGATCA CGGGCACGAA

301 GTCCATTCCC CCTTCGACAA CCATGCCTCA CATTCCGATT CTGATGAAGC

351 CGGTAGTCCC GTTGACGGAT TTAGCCTTTA CCGCATCCAT TGGGACGGAT

401 ACGAACACCA TCCCGCCGAC GGCTATGACG GCCACAGGG CGGCGGCTAT

451 CCCGCTCCCA AAGGCGCGAG GGATATATAC AGCTACGACA TAAAAGGCGT

501 TGCCCAAAAT ATCCGCCTCA ACCTGACCGA CAACCGCAGC ACCGGACAAC

551 GGCTTGCCGA CCGTTTCCAC AATGCCGGTA GTATGCTGAC GCAAGGAGTA

601 GGCGACGGAT TCAAACGCGC CACCCGATAC AGCCCCGAGC TGGACAGATC

651 GGGCAATGCC GCCGAAGCCT TCAACGGCAC TGCAGATATC GTTAAAAACA

701 TCATCGGCGC GGCAGGAGAA ATTGTCGGCG CAGGCGATGC CGTGCAGGGC

751 ATAAGCGAAG GCTCAAACAT TGCTGTCATG CACGGCTTGG GTCTGCTTTC

801 CACCGAAAAC AAGATGGCGC GCATCAACGA TTTGGCAGAT ATGGCGCAAC

851 TCAAAGACTA TGCCGCAGCA GCCATCCGCG ATTGGGCAGT CCAAAACCCC

901 AATGCCGCAC AAGGCATAGA AGCCGTCAGC AATATCTTTA TGGCAGCCAT

951 CCCCATCAAA GGGATTGGAG CTGTTCGGGG AAAATACGGC TTGGGCGGCA

1001 TCACGGCACA TCCTATCAAG CGGTCGCAGA TGGGCGCGAT CGCATTGCCG

1051 AAAGGGAAAT CCGCCGTCAG CGACAATTTT GCCGATGCGG CATACGCCAA

1101 ATACCCGTCC CCTTACCATT CCCGAAATAT CCGTTCAAAC TTGGAGCAGC

1151 GTTACGGCAA AGAAAACATC ACCTCCTCAA CCGTGCCGCC GTCAAACGGC
```

```
-continued
1201 AAAAATGTCA AACTGGCAGA CCAACGCCAC CCGAAGACAG GCGTACCGTT

1251 TGACGGTAAA GGGTTTCCGA ATTTTGAGAA GCACGTGAAA TATGATACGA

1301 AGCTCGATAT TCAAGAATTA TCGGGGGGCG GTATACCTAA GGCTAAGCCT

1351 GTGTTTGATG CGAAACCGAG ATGGGAGGTT GATAGGAAGC TTAATAAATT

1401 GACAACTCGT GAGCAGGTGG AGAAAAATGT TCAGGAAATA AGGAACGGTA

1451 ATATAAACAG TAACTTTAGC CAACATGCTC AACTAGAGAG GGAAATTAAT

1501 AAACTAAAAT CTGCCGATGA AATTAATTTT GCAGATGGAA TGGGAAAATT

1551 TACCGATAGC ATGAATGACA AGGCTTTTAG TAGGCTTGTG AAATCAGTTA

1601 AAGAGAATGG CTTCACAAAT CCAGTTGTGG AGTACGTTGA AATAAATGGA

1651 AAAGCATATA TCGTAAGAGG AAATAATRGG GTTTTTGCTG CAGAATACCT

1701 TGGCAGGATA CATGAATTAA AATTTAAAAA AGTTGACTTT CCTGTTCCTA

1751 ATACTAGTTG GAAAAATCCT ACTGATGTCT TGAATGAATC AGGTAATGTT

1801 AAGAGACCTC GTTATAGGAG TAAATAA
```

This corresponds to the amino acid sequence <SEQ ID 1049; ORF orf46-2>:

```
orf46-2.pep
  1 LGISRKISLI LSILAVCLPM HAHASDLAND SFIRQVLDRQ HFEPDGKYHL

51 FGSRGELAER SGHIGLGKIQ SHQLGNLMIQ QAAIKGNIGY IVRFSDHGHE

101 VHSPFDNHAS HSDSDEAGSP VDGFSLYRIH WDGYEHHPAD GYDGPQGGGY

151 PAPKGARDIY SYDIKGVAQN IRLNLTDNRS TGQRLADRFH NAGSMLTQGV

201 GDGFKRATRY SPELDRSGNA AEAFNGTADI VKNIIGAAGE IVGAGDAVQG

251 ISEGSNIAVM HGLGLLSTEN KMARINDLAD MAQLKDYAAA AIRDWAVQNP

301 NAAQGIEAVS NIFMAAIPIK GIGAVRGKYG LGGITAHPIK RSQMGAIALP

351 KGKSAVSDNF ADAAYAKYPS PYHSRNIRSN LEQRYGKENI TSSTVPPSNG

401 KNVKLADQRH PKTGVPFDGK GFPNFEKHVK YDTKLDIQEL SGGGIPKAKP

451 VFDAKPRWEV DRKLNKLTTR EQVEKNVQEI RNGNINSNFS QHAQLEREIN

501 KLKSADEINF ADGMGKFTDS MNDKAFSRLV KSVKENGFTN PVVEYVEING

551 KAYIVRGNNR VFAAEYLGRI HELKFKKVDF PVPNTSWKNP TDVLNESGNV

601 KRPRYRSK*
```

Using the above-described procedures, the following oligonucleotide primers were employed in the polymerase chain reaction (PCR) assay in order to clone the ORFs as indicated:

Oligonucleotides Used for PCR

TABLE 1

| ORF | Primer | Sequence | Restriction sites |
|---|---|---|---|
| 279 | Forward | CGC<u>GGATCCCATATG</u>-TTGCCTGCAATCACGATT<br><SEQ ID 1050> | BamHI-NdeI |
|  | Reverse | CCCG<u>CTCGAG</u>-TTTAGAAGCGGGCGGCAA<br><SEQ ID 1051> | XhoI |
| 519 | Forward | CGC<u>GGATCCCATATG</u>-TTCAAATCCTTTGTCGTCA<br><SEQ ID 1052> | BamHI-NdeI |

TABLE 1-continued

| ORF | Primer | Sequence | Restriction sites |
|---|---|---|---|
|  | Reverse | CCCG<u>CTCGAG</u>-TTTGGCGGTTTTGCTGC<br><SEQ ID 1053> | XhoI |
| 576 | Forward | CGC<u>GGATCCCATATG</u>-GCCGCCCCCGCATCT<br><SEQ ID 1054> | BamHI-NdeI |
|  | Reverse | CCCG<u>CTCGAG</u>-ATTTACTTTTTTGATGTCGAC<br><SEQ ID 1055> | XhoI |
| 919 | Forward | CGC<u>GGATCCCATATG</u>-TGCCAAAGCAAGAGCATC<br><SEQ ID 1056> | BamHI-NdeI |
|  | Reverse | CCCG<u>CTCGAG</u>-CGGGCGGTATTCGGG<br><SEQ ID 1057> | XhoI |
| 121 | Forward | CGC<u>GGATCCCATATG</u>-GAAACACAGCTTTACAT<br><SEQ ID 1058> | BamHI-NdeI |
|  | Reverse | CCCG<u>CTCGAG</u>-ATAATAATATCCCGCGCCC<br><SEQ ID 1059> | XhoI |
| 128 | Forward | CGC<u>GGATCCCATATG</u>-ACTGAGAACGCACT<br><SEQ ID 1060> | BamHI-NdeI |
|  | Reverse | CCCG<u>CTCGAG</u>-GACCGCGTTGTCGAAA<br><SEQ ID 1061> | XhoI |
| 206 | Forward | CGC<u>GGATCCCATATG</u>-AAACACCGCCAACCGA<br><SEQ ID 1062> | BamHI-NdeI |
|  | Reverse | CCCG<u>CTCGAG</u>-TTCTGTAAAAAAAGTATGTGC<br><SEQ ID 1063> | XhoI |
| 287 | Forward | CCG<u>GAATTC</u><u>TAGCTAGC</u>-CTTTCAGCCTGCGGG<br><SEQ ID 1064> | EcoRI-NheI |
|  | Reverse | CCCG<u>CTCGAG</u>-ATCCTGCTCTTTTTTGCC<br><SEQ ID 1065> | XhoI |
| 406 | Forward | CGC<u>GGATCCCATATG</u>-TGCGGGACACTGACAG<br><SEQ ID 1066> | BamHI-NdeI |
|  | Reverse | CCCG<u>CTCGAG</u>-AGGTTGTCCTTGTCTATG<br><SEQ ID 1067> | XhoI |

Example 2

Expression of ORF 919

The primer described in Table 1 for ORF 919 was used to locate and clone ORF 919. The predicted gene 919 was cloned in pET vector and expressed in *E. coli*. The product of protein expression and purification was analyzed by SDS-PAGE. In panel A) is shown the analysis of 919-His fusion protein purification. Mice were immunized with the purified 919-His and sera were used for Western blot (panel B), FACS analysis (panel C), bactericidal assay (panel D), and ELISA assay (panel E). Symbols: M1, molecular weight marker; PP, purified protein; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 919 is a surface-exposed protein and that it is a useful immunogen. The hydrophilicity plots, antigenic index, and amphipatic regions of ORF 919 are provided in FIG. 10. The AMPSI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9).

The nucleic acid sequence of ORF 919 and the amino acid sequence encoded thereby is provided in Example 1.

Example 3

Expression of ORF 279

Figure 11:
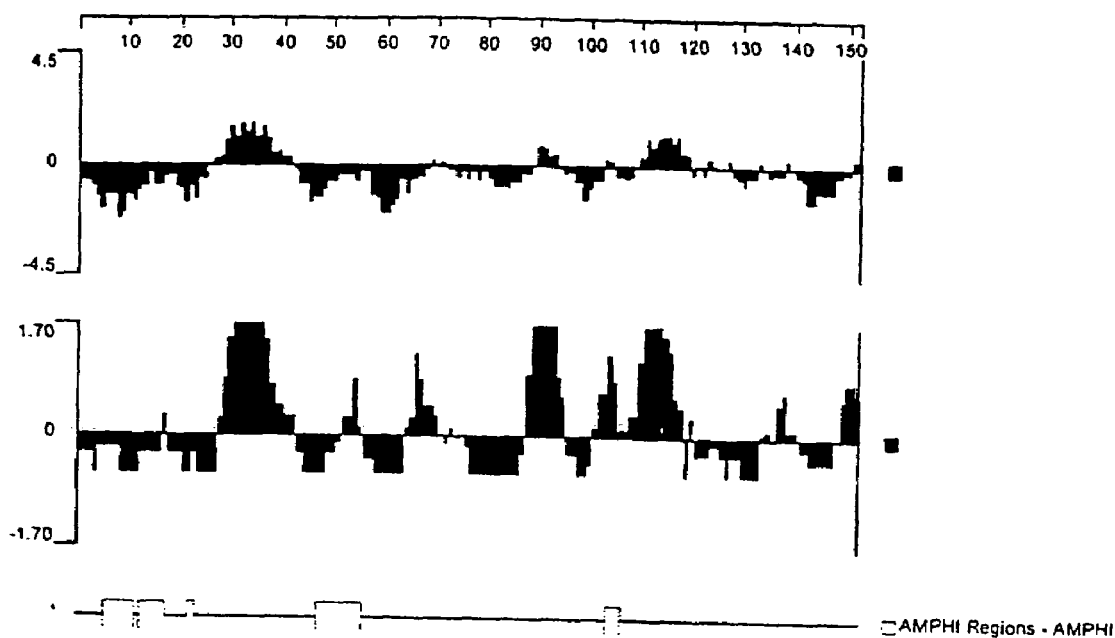
FIG. 11 illustrates the hydrophilicity plot, antigenic index and AMPHI regions of the products of protein expression the predicted ORF 279 as cloned and expressed in E. coli.

The primer described in Table 1 for ORF 279 was used to locate and clone ORF 279. The predicted gene 279 was cloned in pGex vector and expressed in *E. coli*. The product of protein expression and purification was analyzed by SDS-PAGE. In panel A) is shown the analysis of 279-GST purification. Mice were immunized with the purified 279-GST and sera were used for Western blot analysis (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 279 is a surface-exposed protein and that it is a useful immunogen. The hydrophilicity plots, antigenic index, and amphipatic regions of ORF 279 are provided in FIG. 11. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided in Example 1.

Example 4

Expression of ORF 576

Figure 12:
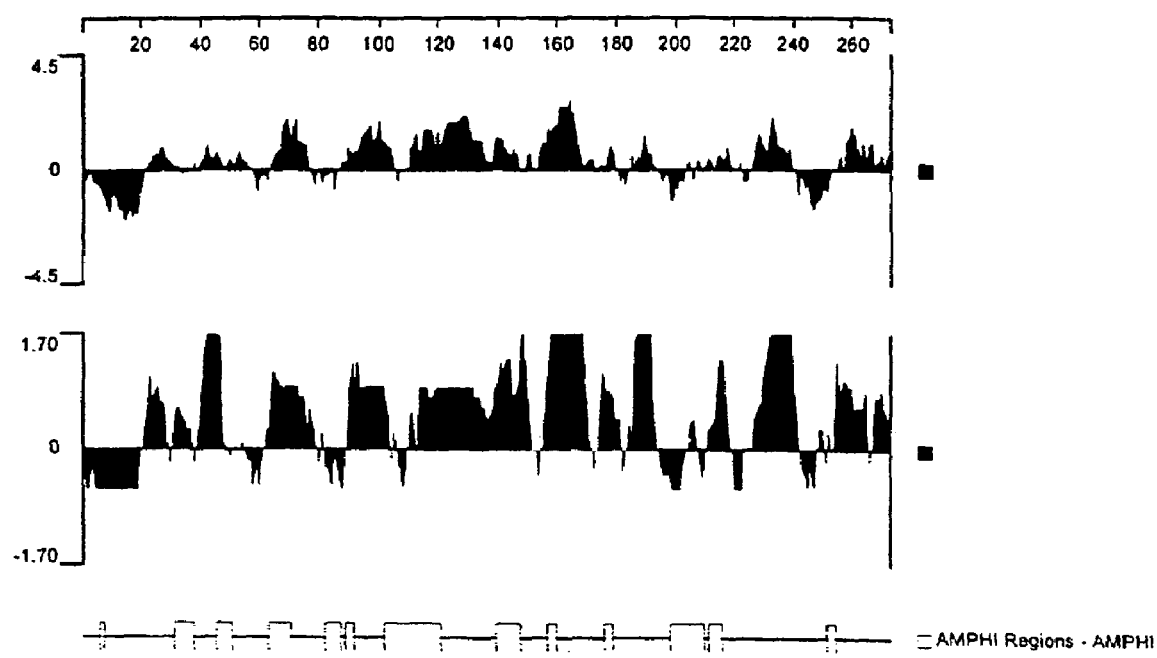
FIG. 12 illustrates the hydrophilicity plot, antigenic index and AMPHI regions of the products of protein expression the predicted ORF 576-1 as cloned and expressed in E. coli.

The primer described in Table 1 for ORF 576 was used to locate and clone ORF 576. The predicted gene 576 was cloned in pgex vector and expressed in *E. coli*. The product of protein purification was analyzed by SDS-PAGE. In panel A) is shown the analysis of 576-GST fusion protein purification. Mice were immunized with the purified 576-GST and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that ORF 576 is a surface-exposed protein and that it is a useful immunogen. The hydrophilicity plots, antigenic index, and amphipatic regions of ORF 576 are provided in FIG. 12. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

Example 5

Expression of ORF 519

Figure 13:
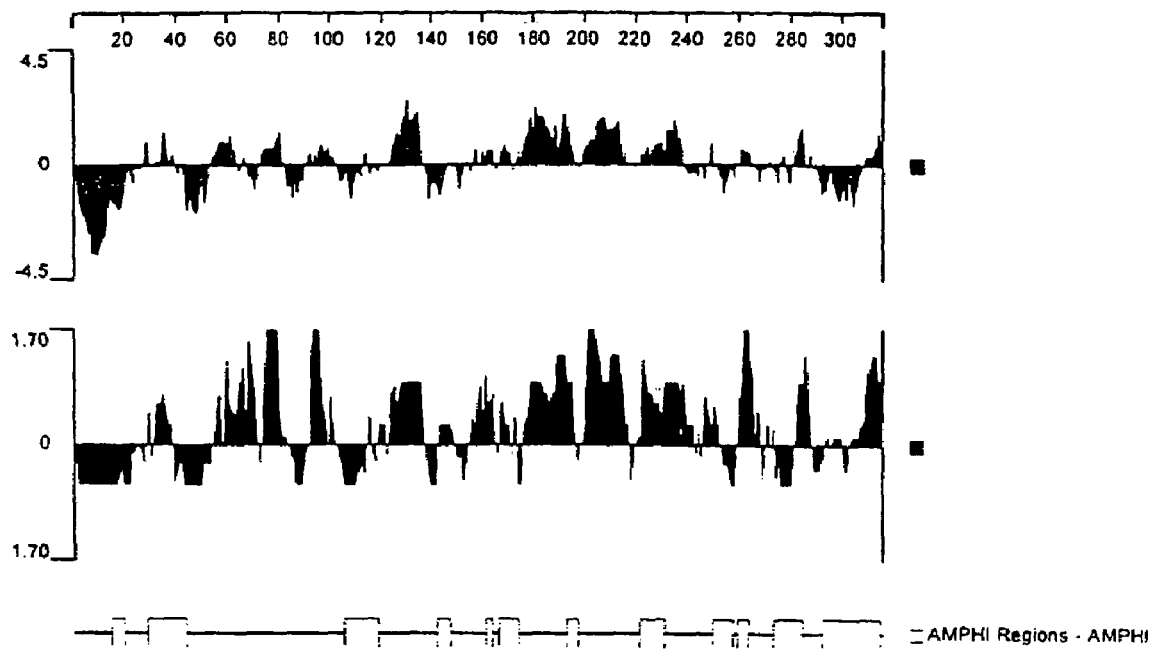
FIG. 13 illustrates the hydrophilicity plot, antigenic index and AMPHI regions of the products of protein expression the predicted ORF 519-1 as cloned and expressed in E. coli.

The primer described in Table 1 for ORF 519 was used to locate and clone ORF 519. The predicted gene 519 was cloned in pET vector and expressed in *E. coli*. The product of protein purification was analyzed by SDS-PAGE. In panel A) is shown the analysis of 519-His fusion protein purification. Mice were immunized with the purified 519-His and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 519 is a surface-exposed protein and that it is a useful immunogen. The hydrophilicity plots, antigenic index, and amphipatic regions of ORF 519 are provided in FIG. 13. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby is provided in Example 1.

Example 6

Expression of ORF 121

Figure 14:
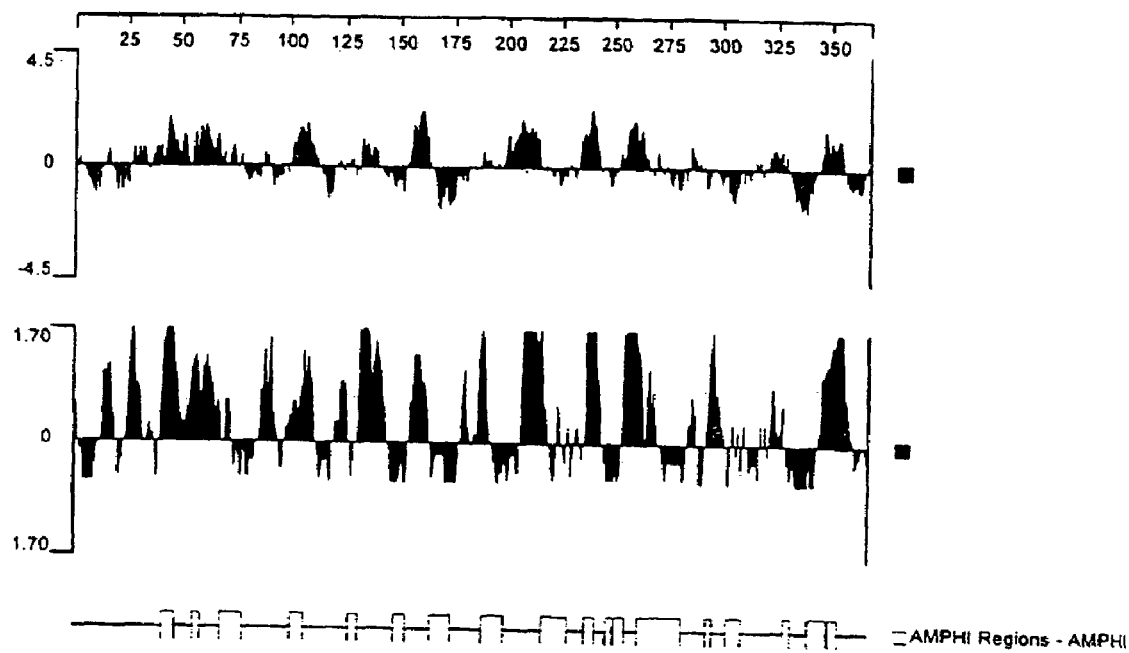
FIG. 14 illustrates the hydrophilicity plot, antigenic index and AMPHI regions of the products of protein expression the predicted ORF 121-1 as cloned and expressed in E. coli.

The primer described in Table 1 for ORF 121 was used to locate and clone ORF 121. The predicted gene 121 was cloned in pET vector and expressed in *E. coli*. The product of protein purification was analyzed by SDS-PAGE. In panel A) is shown the analysis of 121-His fusion protein purification. Mice were immunized with the purified 121-His and sera were used for Western blot analysis (panel B), FACS analysis (panel C), bactericidal assay (panel D), and ELISA assay (panel E). Results show that 121 is a surface-exposed protein. Symbols: M1, molecular weight marker, TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 121 is a surface-exposed protein and that it is a useful immunogen. The hydrophilicity plots, antigenic index, and amphipatic regions of ORF 121 are provided in FIG. 14. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 121 and the amino acid sequence encoded thereby is provided in Example 1.

Example 7

Expression of ORF 128

Figure 15:
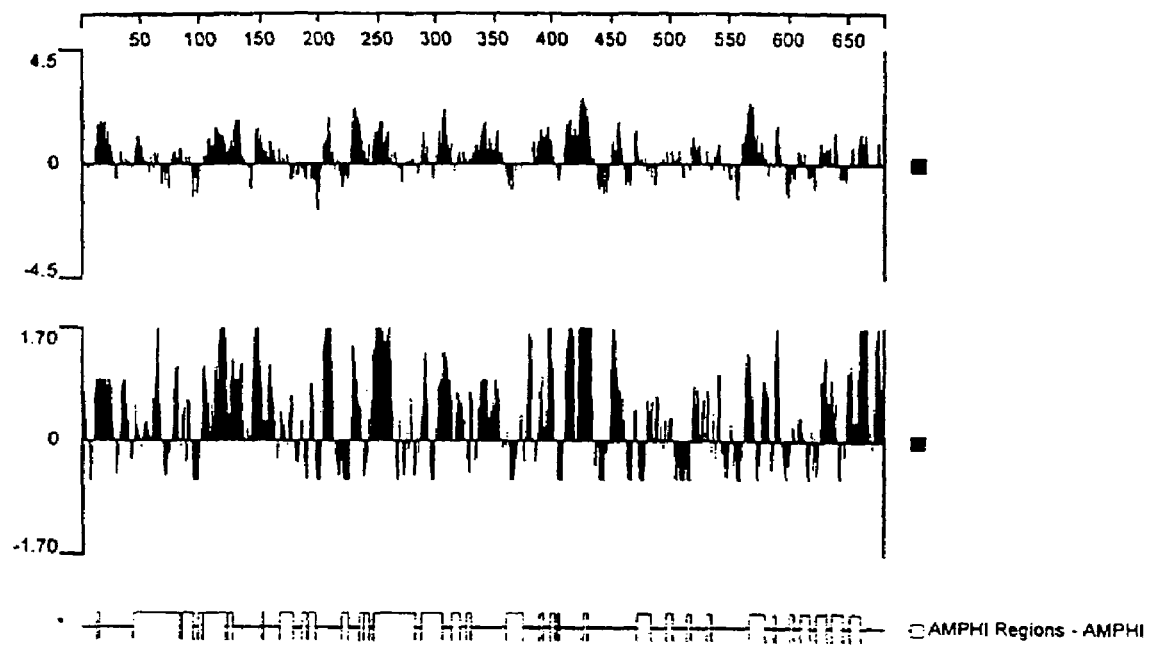
FIG. 15 illustrates the hydrophilicity plot, antigenic index and AMPHI regions of the products of protein expression the predicted ORF 128-1 as cloned and expressed in E. coli.

The primer described in Table 1 for ORF 128 was used to locate and clone ORF 128. The predicted gene 128 was cloned in pET vector and expressed in *E. coli*. The product of protein purification was analyzed by SDS-PAGE. In panel A) is shown the analysis of 128-His purification. Mice were immunized with the purified 128-His and sera were used for Western blot analysis (panel B), FACS analysis (panel C), bactericidal assay (panel D) and ELISA assay (panel E). Results show that 128 is a surface-exposed protein. Symbols: M1, molecular weight marker, TP, *N. meningitides* total protein extract; OMV, *N. meningitidis* outer membrane vesicle preparation. Arrows indicate the position of the main recombinant protein product (A) and the *N. meningitidis* immunoreactive band (B). These experiments confirm that 128 is a surface-exposed protein and that it is a useful immunogen. The hydrophilicity plots, antigenic index, and amphipatic regions of ORF 128 are provided in FIG. 15. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 128 and the amino acid sequence encoded thereby is provided in Example 1.

Example 8

Expression of ORF 206

Figure 16:
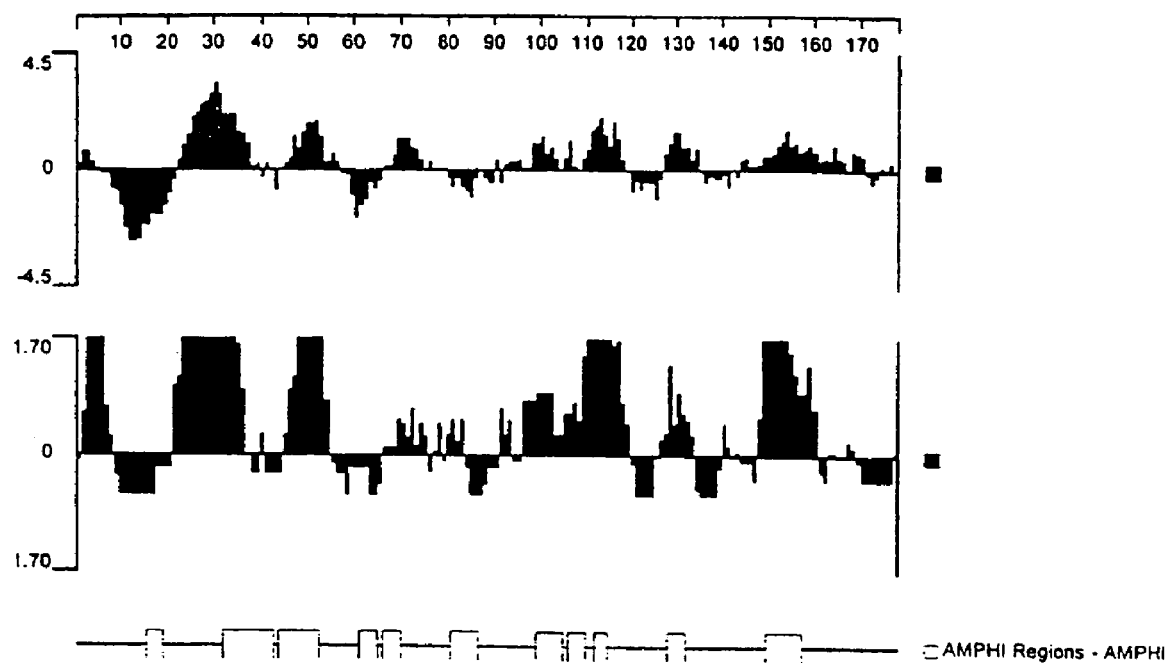
FIG. 16 illustrates the hydrophilicity plot, antigenic index and AMPHI regions of the products of protein expression the predicted ORF 206 as cloned and expressed in E. coli.

The primer described in Table 1 for ORF 206 was used to locate and clone ORF 206. The predicted gene 206 was cloned in pET vector and expressed in *E. coli*. The product of protein purification was analyzed by SDS-PAGE. In panel A) is shown the analysis of 206-His purification. Mice were immunized with the purified 206-His and sera were used for Western blot analysis (panel B). It is worthnoting that the immunoreactive band in protein extracts from meningococcus is 38 kDa instead of 17 kDa (panel A). To gain information on the nature of this antibody staining we expressed ORF 206 in *E. coli* without the His-tag and including the predicted leader peptide. Western blot analysis on total protein extracts from *E. coli* expressing this native form of the 206 protein showed a reactive band at a position of 38 kDa, as observed in meningococcus. We conclude that the 38 kDa band in panel B) is specific and that anti-206 antibodies, likely recognize a multimeric protein complex. In panel C is shown the FACS analysis, in panel D the bactericidal assay, and in panel E) the ELISA assay. Results show that 206 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 206 is a surface-exposed protein and that it is a useful immunogen. The hydrophilicity plots, antigenic index, and amphipatic regions of ORF 519 are provided in FIG. 16. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 206 and the amino acid sequence encoded thereby is provided in Example 1.

Example 9

Expression of ORF 287

Figure 17:
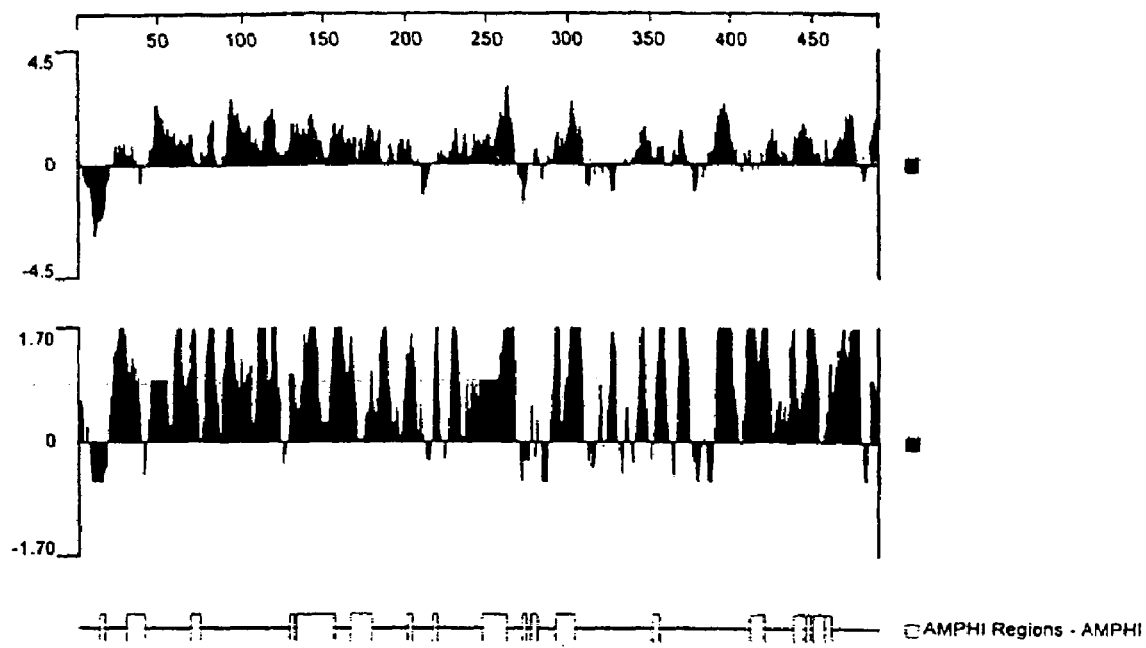
FIG. 17 illustrates the hydrophilicity plot, antigenic index and AMPHI regions of the products of protein expression the predicted ORF 287 as cloned and expressed in E. coli.

The primer described in Table 1 for ORF 287 was used to locate and clone ORF 287. The predicted gene 287 was cloned in pGex vector and expressed in *E. coli*. The product of protein purification was analyzed by SDS-PAGE. In panel A) is shown the analysis of 287-GST fusion protein purification. Mice were immunized with the purified 287-GST and sera were used for FACS analysis (panel B), bactericidal assay (panel C), and ELISA assay (panel D). Results show that 287 is a surface-exposed protein. Symbols: M1, molecular weight marker. Arrow indicates the position of the main recombinant protein product (A). These experiments confirm that 287 is a surface-exposed protein and that it is a useful immunogen. The hydrophilicity plots, antigenic index, and amphipatic regions of ORF 287 are provided in FIG. 17. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 287 and the amino acid sequence encoded thereby is provided in Example 1.

Example 10

Expression of ORF 406

Figure 18:
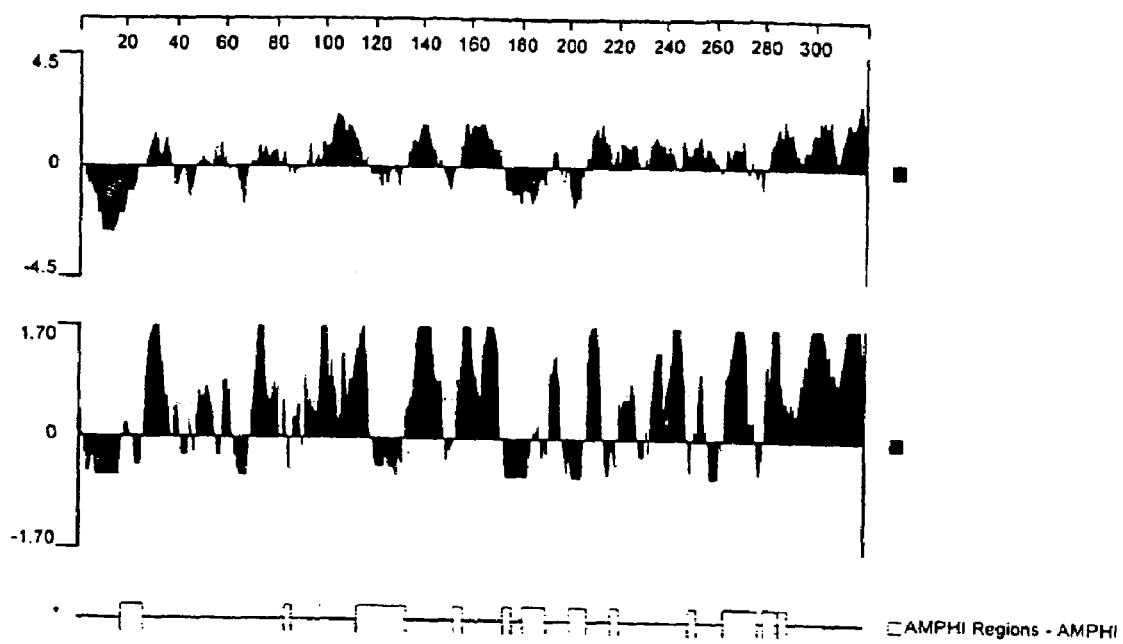
FIG. 18 illustrates the hydrophilicity plot, antigenic index and AMPHI regions of the products of protein expression the predicted ORF 406 as cloned and expressed in E. coli.

The primer described in Table 1 for ORF 406 was used to locate and clone ORF 406. The predicted gene 406 was cloned in pET vector and expressed in *E. coli*. The product of protein purification was analyzed by SDS-PAGE. In panel A) is shown the analysis of 406-His fusion protein purification. Mice were immunized with the purified 406-His and sera were used for Western blot analysis (panel B), FACS analysis (panel C), bactericidal assay (panel D), and ELISA assay (panel E). Results show that 406 is a surface-exposed protein. Symbols: M1, molecular weight marker, TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 406 is a surface-exposed protein and that it is a useful immunogen. The hydrophilicity plots, antigenic index, and amphipatic regions of ORF 406 are provided in FIG. 18. The AMPWH program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 406 and the amino acid sequence encoded thereby is provided in Example 1.

The foregoing examples are intended to illustrate but not to limit the invention.

SEQUENCE LISTING (1068 sequences)

SEQ ID NO: 1 - DNA, 36471 bp, Neisseria meningitidis
gaaaattcagcagcagcaggaagattgccagcatttgcgcggcggttttaaacttaccgacggtggcgacggcaacgctgttccttttgcccatttgcgccatccattcgcgcaatgcggaaatggtaatttccctgccgatgatgatcatggcaaacaaaacataggtccggtcgagtttgaccagtaaaagcaaagagacggcgaccatcagcttgtcggcaacgggatcgaggaaggcgccgaaatccgaggtctgtttccacaaccttgccaaaaatccgtcaaaccagtcggtcaaggcggcaacggcaaaaatgacggcggcggtgagattaatcgtttcctccgcgaaccacggaaaaggcaggtaaaaaagggctgtcaggacaggaatgagcaagaccctcaaccatgtgaggaagatggggagattccaaggcatcggttttctctgtgcagactgtaaagttgtgattataacggttatcctcataacccaaaacgtaaaattgctgcatgggcattcccccgccccgccaatctgttttcacattcttttcaaacgcaggaaaatggcgggcaataaaagcaaaatacccagtttcaggctgaaaacggcaggttgtgccaacacttcgacaaggcggtcttccgtgcgggcaaaatctttattgcttatagacactgccactgttgcggtattccaacagaacgccgtttaaaaaacctttgccgacggtttcgcttaaaacggctctaacctgctccgccctgatggttctgccgatattgccgcctgtgcacaaactgtcgaacccatagcaggaaagccggtaatgctgcccgtctgcatccagtttgattgcccgtccgctgcggttgagggcggtaacggtcaattccgcatattcgaatgttttttcttgttcgtgaaatgccgtcaggtaaggtgcaataaaaacggcggacaacagcagacagcttatggcggcaaaccatacccagcgataatatagtggattaaatttaaaccagtacagcgttgcctcgccttagctcaaagagaacgattctctaaggtgctgaagcaccaagtgaatcggttccgtactatttgtactgtctgcggcttcgtcgccttgtcctgatttaaatttaatccactatatttcacgcttaccccttgtttctcaaatgccgtctgaaataagcggcttaatatattgtttacagtattgggaagcataacagacaaaatgccgtctgaaatattttcagacggcatttcttatccgaaacggattatttttgcgtttcaaccgcttccaatgcacgcagggcataagtgtaagcggcacccgcattcagggcaatggcggttgccaatgcacctgcgatttcgctgtcggtcgcaccggctttggtggcggcggcggcgtgaacactgatgcagctctcacaacgtgtagtaatggcaacggcgatggcaatcagttcgcgtgttttagcatcaagtgcctctgcagctgccgcttgttccaatgcgccgtaggcctgcagcattttaggatgcgccttacccagctcgccgaacgattttttaaccaatgcggtatgttctttccaatctttaaacattttcttttcctttctcttgcgtttaaccctgatacgcgcttgcgtatctgttttcgatgtgcgtattattgcaattattcagttgtgtttctcgtttaatcatctcattttatggttcaaaaagatttatggacattctggacaaactggtcgatttcgcccaattgacgggcagtgtggatgtgcagtgccttttgggcggacaatggtcggtacggcatgaaaccttgcaacgcgaaggattggtacacattgttacatcgggcagcggctatctctgcatcgacggcgaaacttccccgcgtccggtcagtacaggggatattgtatttttcccgcgcggcttgggtcatgtgttgagccacgacggaaaatgcggagaaagtttacaaccggatatgcggcagcacggtgcgtttacggtcaagcagtgcggcaacggacaggatatgagcctgttttgcgcccgtttccgctacgacacccacgccgatttgatgaacgggctgcctgaaaccgtttttctgaacattgcccatccgagtttacagtatgtggtttcaatgctgcaactggaaagcaaaaaacctttgacggggacggtttccatggtcaacgcattgtcgtccgtcctgctggtgcttatcctgcgcgcctatctcgaacaggataaggatgtcgaactctcgggcgtattgaaaggttggcaggacaaacgtttgggacatttaatccaaaaggtgatagacaaaccggaagacgaatggaatgtcgacaaaatggtggcggctgccaatatgtcgcgcgcgcaactgatgcgccgtttcaaaagccgggtcggactcagcccgcacgcctttgtgaaccatatccgcctgcaaaaaggcgcgttgctgctgaaaaaaaacccggattcggttttgtcggtcgcactgtcggtaggctttcagtcggaaacgcacttcggcaaggcgttcaaacggcaatatcacgtttcgccgggtcaataccggaaagaagcgggcaaaaataaatcggggcttcaaacgcaaatgccgtctgaaaaggctttcatacagcatttgcgtaccgcgtcatttcaagggctgcatcttcatcacttccatcaaaaagttggtaaatgcggggttgttgggtttgacatccatatttttccaacgctgctgccagccgcgcaaggcattctggatatacagcttggactgttccgtattgattgcgccccgctggctgtctatcgccgaacgcaggtagatttcatacatactgtcatcgacggcattgcgtccgaccaggcgttttctgaagttgttcagatattgcgccgcctgaaccttggtcattttaccgatacccacctgatagcccaagcgcgtcgcttcatcgctgattttggcaacatccgtccaatgcgaagaggcaaggcggaaaccttttgcaggtgcttccgttttgacggtattgataggattcacggggatttccgtcaatgtgggcacataaatagactggcagccggaaagaactgccgcaatggaaagagggataaggtattttttcatgcccccattataatcaagtttgccttgagaaaacaaattgttcggcaagaaaaataaaatttcggcatcagaagcaggcaaaaacacattccacaagccttgccgcaaggtttacaatccgaccgtccttatcgcaacgaccgtttatggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacamcttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataaaaaatgccgtccgaacatccttcagacggcatatcgggctttatttccccgccttcacatcctgccactggcgcaccataaacttcaatgccgccggctggataggcaccatgataaagctgtttttcaaatcctcctcggttgggaaaatcgtattgtcgtttttaaattcgtcttccatcagctcacgcgcaggcttgctcgaaggcgcgtaagtaacgaaattgccgtttttcgccgacacttccgggtcgaggaagtcgttgatgtatttgtgcgcgttggcgacgtttttcgcatctttcggaatcacgaaagaatccacccaaatccccacgccctctttgggcatcatcacgcggattttttccttgccgcccgcttcttcggcacggcgtttggcgatgttcaaatcgccgccgaaaccgattgttacgcaggtatcgccgcgcgccaaatcatcgataaagccggacgaagtaaagcgtttgatattggggcggtttttcttgagtagggcggttgcctccctgatgtcttccgtattgctgctgttcgggtttttacccaaatagttcaacaccataggatagatttccgccgcgctgtccaaatagctgatgccgcattgcttgagtttggacgtgtattcggggtcgaacaccaaatcccactggttgtccggcagcttgtccgtacccaaagcctttttcacgcgttcggtattgatggcgaaggtatttgtcccccaataaaacggcacggcgtattcgtggccgggatcgaccccgtccatcagcctcatcatttcggggttgaggtgtttataattgggaatcagcgacttatcgattttctgatacgcacctgccttaatctgcctgcccacaaacgcattggacggcgcgacaatgtcgtaaccggacttgcctgtcagcaccttgctttccagcgtttcatcgctgtcgtacacatcataagtaaccttgatgccgtttttcttttcaaaatcggcaacggtttccggatcgacatattccgaccagttgtaaattttcaatacgttttggttttccgccggtgccggtttttcggcaggcggtttgtccgaaccgccgcacgctgcaagcagcaaagcagtcaggacggccaggggcagatgtttggtcattatcattccttgcatatcgggttggagaaagcggccattatagccgatattggcaacagggcttcagacggcattcaaaatcccgccacactcttccgaaaaccgccgcttccatagctagaaacagggatttgcggtaagataccgccgttcgttttccctgcttttaccatgacaagacatttgagagacattgaaaaaattatgaaaacctccgaactgcgccaaaaattcctaaaattttttgaaaccaaaggccacaccgtcgtccgctcttccagcctcgtgccgcacgacgacccgaccctgctgtttaccaacgcgggcatgaaccagtttaaagacgtattcttaggtttcgacaaacgcccgtacagccgcgccaccaccgcgcaaaaatgcgtacgcgcaggcggcaaacacaacgacttggaaaacgtcggctacaccgcccgccaccacaccttctttgaaatgatgggcaacttctccttcggcgactacttcaaacgcgacgccatccacttcgcttgggaatttctgacttcccccgaatggctcaacatccctaaagacaaactgttggcgaccgtttacgcggaagacgacgaagcctacaacatctggttgaacgaaatcggtatgccgtccgagcgcatcgtccgcatcggcgacaacaaaggcgcgaaatacgcatccgacaacttctggcaaatgggcgacaccggcccttgcggcccctgctccgaaattttctacgaccacggcgaagaaatctggggcggcattcccggcagtcccgaagaagacggcgaccgctggatcgaaatttggaactgcgtatttatgcagttcaaccgcgacgaacaaggcaatatgaacccgcttcccaaaccttccgtcgataccggtatgggcttggaacgcatagccgccgtcatgcagcatgttcacagcaactacgaaatcgacttgttccaagacctgctcaaagccgttgcccgcgaaaccggcgcgccgttcagaatggaagaacccagcctgaaagtcatcgccgaccacatccgctcctgctcgttcctgattgcagacggcgtcttgccttccaacgaaggccgcggctacgtattgcgccgcattatccgccgcgccgtgcgccacggttacaaactgggtcaaagcaaaccgttcttccacaaactcgttgccgatttggtcaaagagatgggcggtgcctaccctgaattgaaagaaaaacaagcccaaatcgaagaagcattgaaaaacgaagaaagccgttttgcccaaacgctggaaaccggtatggctttgttggaaaacgcgctggtyaaaggcggcaaaacactcggcggcgaaatcatcttcaaactctacgatacctacggtttcccatacgacttgactgccgacatctgccgcgaacgcaatatcgaaccggacgaagcaggcttcgagcgcgaaatggaagcccaacgcgcacgcgcacgcgccgcccaaagcttcaaagccaacgcccaactgccttatgacggtcaagacaccgagtttaaaggttatagcgaacgccaaaccgaatccaaagtcctcgccctctacaaagacggcgagcaagtcaacgaattgaacgaaggcgacagcggcgcagtcgtcatcgactttaccccgttctatgcagaatccggcggccaagtcggcgatgtcggctatatcttctcaggcgaaaaccgctttgaagtacgcgatacccaaaaaatcaaagcggccgtattcggtcaattcggcgtacaaacttcaggccgtctgaaagtcggcgacagcgttaccgccaaagtggacgacgaaatccgcaatgccaatatgcgcaaccacagcgcaacccacttgatgcacaaagccctgcgcgatgtattgggcagacacgtcgaacaaaaaggctctttggttaccgccgaatccacccgtttcgacatttcccatccccaagcggtaactgccgaagaaattgccgaagtagaacgccgcgtcaacgaagccattttggcgaacgttgccgtcaatgcagccattatgagcatggaagacgcgcaaaaaaccggcgcgatgatgctcttcggcgaaaaatacggcgaagaagtgcgcgtactgcaaatgggcggtttctctaccgaattgtgcggcggcacacacgtttcacgcaccggcgacatcggcctcttcaaaatcatcagcgaaggcggtattgccgcaggcgtgcgccgtatcgaagccatcaccggcctgaacgcactcaaatgggcgcaagagcaagagcgtttggtgaaagacattattgccgaaaccaaagcccaaaccgaaaaagacgtactggcaaaaatccaagcaggcgcggcacacgccaaagcattggaaaaagaattggcacgcgccaaagccgaactcgccgtccacgcaggcgccaaactcttggacgatgcaaaagacttgggcgcagccaaactcgttgccgcccaaatcgaagccgacgcagccgccctgcgcgaaatcgttaccgatttaaccggtaaatccgacaacgccgtgattcttttagcggcagtaaacgacggcaaagtctccctgtgcgccggcgtatccaaaccgttgaccggcaaagtgaaagcaggcgatctggttaaatttgcagccgaacaagtcggcggcaaaggcggcggcagaccagatttggcgcaagccggcggcacggatgccgacaaattgcccgccgtgttggatagcgtgaaagactgggtcggcgcgaagctggtttgatgtgggaaaggcagcctgaaaggtttcaggctgccttttgtgcaaagaggccgtctgaaaggtctcgtttgccgtaggttgggtcgcgacccaacaaattttgtgaagtataaaaatgttggtcatgacccaacctacctgcctttttgtacaaagaggctatctgaaaggccttgtttgccgtatggtgggtcgcgacccagcagatttttattagggtatgacccaagctacttgctacgataaaaaaggatttttaaatgagcattagccttattggactacacattaccatagcaatcattttgttttttactacaaattttatgggaaaaaaatcatctatatttggctattaccaactgtcttttagcgaagaaaatcactctccggcatttaatattttttacagagcatttacccctatattatttatcgttattttttcttgggttgttactagtcttgaaattcccatttctcttgaaaagataaactatgtagtaatttattattttataattagattgttatctgtatttgtttttgagaaaacacacatagttaactggtttaatcaactaacaatacccatactatccataacattatcatttatagtatataacaaaatgattttgcccaaaagttttctacttccatcctcacaagaagtagctactactttttgaatagcgcttggtggttacatatataatatattaaataatgaatcagggcatttaaaatcttataaagaaagaagagtaaattatgtaaaacacatgcacaaaaaatttgaaagttattttggtaaaattatagataaaataatcaaagaggatagttataataatgatgattttttaaccgataagaaaaaagcactaatatattcagttttaatttatgagaattttaataggggactagtttatagatattttgaaaaaaattattttgtactggtagaataaaaacatttggaataatgcaagtaacctcagcagagtacctttccaatgaggaaagtataaaaaaaggcggaaatattcttatggaaaaatacaatgaaaaatataatgaatctattgatggcaataaaactctctataaatcatattatgaatcaagaagagagagtattaaaaactacaacccagatgcaaaatacattaatgaaattgaatcaatttacatgatgcttggagaaatctatccaaatgcaccagacttcatgtcaccacattttgagggggactgctctgagggggaataaaatcattatttattctttattagttattagcaggatttgtcgggcataaatgcccgacctacaaattcaattttttcaaacctctgccaaatattttcatctttgcaaggctgtctgaaaacccaaaccccattttcagacggccttttttcgctaaaatccccataccgttcaatccgaaaacacaggagaatcatcatggaagttaccatctccgccatcatcaatggcgaatttgccgaccaatacggcaagcgcggtagtcagtttaatgaaaacgggatgctgatttaattctatttcctttgaaactaccaataacctgcctccatcataaaactaaaagcaagccgtagcctgcattcccacaaaccgcgtgcgttgccatgtcacacaccctacctgcgggcgacgcaaaccttaagagacctttgcaaaattccccaaaatcccctaaattcccaccaagacatttaggggatttctcatgagcaccttctttcaacaaaccgcccaagccatgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacaataccctgtctgaactgttggaactgattaaccgccaactgaccgaaaaaggtttaaaaatagagaaagcatccgctgccgtcgttgacgccaccattattcagaccgccggcagcaaacagcgtcaggccatagaagttgacgaagaaggacaaatcagcggtcaaaccacaccgagtaaggacagcgatgcccgttggataaagaaaaacggcctctacaaactcggttacaaacaacatacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttgtcgaagacccgttatgtggtcgaacaaagcttcggtacgctgcaccgtaaattccgctatgcccgggcagcctatttcggactgattaaagtgagtgcgcaaagccatctgaaggcgatgtgtttgaacctgttgaaagccgccaacaggctaagtgcgcccgctgccgcctaaaaggcagcccggatgcctgattatcgggtgtccggggaggattaagggggtgtttgggtaaaattaggcggtatttggggcgaaaacagccgaaaacctgtgttgggatttcggttgtcgtgagggaaaggaattttgcaaaggtctccagcagtttgcgcatacatgccgtaacggcaaccttatacggcttaccctcggacagcgggcgttggtggaaatcccgaataagcggttcaaaacgtgtcgctgccacggtagccatatacagtgccttaagcaccgcagaccttccgccaaagcagcggcttttgaatttggcttccccgctcttcctcgggtgcggggcaatgccgaccaaactcgctatccgtttgtgcgacagccgccccaattcaggtagcatcgccatcagcgtagccgtcgttatcgaaccgatgcctttgatttgctccgccacttgggctttgccgtcaaaatgcgtgtgggtgtggtcgtcgatttgtttgtccgattcgtcaatcagccggtcaaaatgggcaatcagttgtttgacgcttccgacttgcgtttcgtgaacctgatgcagacggtttttctcggcagtccgcatatccgccgattggttgcggcggttaaccaaggcttccaacacttcttccgcttctgtgggcgggtggtagggcatggtttgccaatcttctttctgtgccttcatctgtgcgaagaaggcaggcattttggcatctttggcgtcggttttggtcagcgactgcgattgggcaaactgatgcgtctgacgcgggttggcgataatcacggctatgcctgctcggtggatggctttggcggcggggatttcgagacctccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgattcacttggtgcttcagcaccttagagaatcgttctcttcgagctaaggcgaggcaacgtcgtactggtttttgttaattcactatatctgtgcgttacgacggcatgccgtctgaagggtgtttatgtctgcatctaagaaatttccgattcctttgagctatttcagcatcgcgctgggcttgtttgccttggggctgtcgtggcgttacggcgcgtctgtcgggctgctgcccgccttggccgccgaatcgctgcttgcggcggcttcggtcgtctggctcttgctggtggcggcatacctgatcaaaatgtttgcgtaccgaaacgattttttgtctgatttacgcgacttggtgcaatgctgcttcatcagcgcgattccgattaccgctatgctggagggactcgcgctgaagccctatcaggcaggcgcggcggcagtcctgatttatgtcggcgttgccggacagttggctttttcgatgtatcgggcggccggtctgtggcgcggcctgcattccttggaggcgacgacgccgattatttatctgcctacggttgcgacaaactttgtcagcgcgtcatctctggcggcgttggggcatcatgattatgcagctttgtttttcggcgcgggtatgttttcctggctgagcttggaagcctccatcttgggcaggctgcgcacggcggcaccggtcggcacggcggcgcgcggcgtggtcggcatccagcttgcgcccgcctttgtcggctgcggcgcgtattttgccgtcggcggtaaagtcgacggttttgcgttggcattaatcggctacggctgcctgcagcttttgttcttgctgcgcctgacccgctggttttgggaaggtggttttacgatgagcttttggggattttcattcggtttcgcggcaatggcaggatgcggtctgcatctggcggcttccggcgtattgtcgggcttggggctgacgcttgccaccgccggatcggcaggcgtggcgctgctgcttgtcggtacgctgcaccggatagcgacggggcgtttcttggtacgcagctgatgcgttttgccgccttgtcaaaaatgccgtctgaaacgctgggattcagacggcattttttatttcacacccttacaggtagaatttttcgatgactttcaaattgtcgtccaatttgtacaccaacggctgaccggtcgggatttccaagcccataatgtcttcgtcggaaatgccctcgatgtgttttgccagcgcgcgcagggagttgccgtgcgccgccaccaagacgcgtttgccgctcaaaatcgcgggggcgatttggtcttcccaaaacggcaatacgcgctccagcgttactttcaggttttcgccgtcgggtacgacatcggcaggcagatgggcatagcggcggtctttgtgtgcggaaaactcatcgtctttgtccaaaagcggcggcagggtgtcgtagctgcgccgccagatgcggacttgctcgtcgccgtattgttcggcggtttgttttttgtccaggccttgcagttggccgtagtggcgttcgttcagccgccacgttttgatttgcggtacgaacagttggtcggattcttccaaaacgatgttgcaggtcttaatcgcgcgggtcaggacggatgtgaaggcgatgtcgaactcatagccgttttctttcagtttcttgccggcggcggcagcctcggcaagcccctgctcgctcagcttcacgtcgcgccagcctgtaaacaggtttttcgcgttccattcgctttgtccgtggcggataaataccagttccatatcgtctccaatgtgtgaaagtgggaaagccttatttataacatattttcacatttcccgtatttgattcagattcagacacgcgcccactatggtttgccgttttgatttacaataatgtcctttgctttacattccgcatacacaatgaatacgcaagcgcacgccccacataccgattccaatacgctgatgctcggccgatacgccgaacgcgcctatctcgaatacgccatgagcgtggtcaaaggccgcgcgctgcctgaagtttcagacggccagaagcccgtgcagcggcgcattttgtttgccatgcgcgatatgggtttgacggcgggggcgaagccggtgaaatcggcgcgcgtggtcggcgagattttgggtaaataccacccgcacggcgacagttccgcctatgaggcgatggtgcggatggcgcaggattttaccttgcgctatcccttaatcgacggcatcggcaacttcggctcgcgcgacggcgacggggcggcggcgatgcgttacaccgaagcgcggctgacgccgattgcggaattgctgttgtccgaaatcaatcaggggacggtggattttgtgccgaactacgacggcgcgtttgacgaaccgctgcacctgcccgcccgcctgcctatggtgttgctcaacggcgcgtcaggcattgcggtgggcatggcgaccgagattccgccgcacaatttgaacgaagtgacgcaggcggcgattgcgttgttgaaaaagccgacgctggaaaccgccgacctgatgcaatatattcctgcccccgattttgccggcggcggtcaaatcatcacgccggcggacgaattgcgccggatttatgaaaccggcaagggcagcgtgcgcgtgcgtgcgcgttatgaaatcgaaaaattggcgcgcggacagtggcgcgtcatcgtaaccgagctgccgccgaacgccaattccgccaaaatccttgccgaaatcgaagagcaaaccaacccgaaaccgaaagcgggtaagaaacagctcaaccaagaccagctcaataccaaaaagctgatgctggatttaatcgaccgcgtgcgcgacgagtccgacggcgaacatcccgtgcgactggtattcgagccgaaatccagccgcatcgataccgataccttcatcaacacgctgatggcgcaaacttcgctggaaggcaatgtgtcgatgaacttggtgatgatgggtttggacaaccgccccgcgcagaaaaacctgaaaacgattttgcaggaatggctggatttccgcaccgtaaccgtaacacgccgtctgaaattccgtttgaaccaagtggaaaaacggctgcacatcctcgaaggccgtctgaaagtctttctgcacatcgacgaagtgattaaagtcatccgcgaatcagacgacccgaaagccgatttgatggcggcgttcgggctgaccgaaatccaagccgaagacattttggaaatccgcctgcgccagttggcgcgtttggagggtttcaaactcgaaaaagaattgaacgagttgcgcgaggaacaaggccgtctgaacatccttttgagcgacgaaaacgaaaaacgcaagctgattgtcaaagagatgcaggcggatatgaaacaatacggcgacgcgcgacgcacgctggtggaagaggccggacgcgccgtgctgacgcagaccaccgccgacgaacccatcacgctgatcctgtcggaaaaaggctggatacgcagccgcgccggacacaatctcgatttgagccaaaccgcgttcaaagaaggcgactgcctcaaacaaaccctcgaaggcagaacggttttacccgtcgtcatcctcgattcatcgggcagaacctacacgctcgatgccgccgaaatccccggagggcgcggcgacggcgtaccggtttcctccttaatcgagctgcaaaacggcgcgaaacccgttgcgatgttgacaggattgccggaacaacattatttattatcaagcagcagcggctatggcttcatcaccaagctgggcgatatggtcgggcgcgtgaaagcgggcaaagtggtgatgaccgcagacagcggcgaaaccgttttgccgccggttgccgtctatgcctcctcgttcatcaaccccgactgcaaaatcattgccgccaccagtcaaaaccgcgccctcgccttccccatcggcgaattgaaaattatggcgaaaggcaaagggctgcaaatcatcggattaaacgccggcgaatcgatgacgcataccgccgtttcttccgagctggaaatcctgattgaaagcgaaggcaggcgcggcgcggcgcacaaagaccgcatccccatctccctgcttgaggcaaaacgcggcaaaaaaggcagactattgcccatatcgggcagcctgaaacagctttcttcccctaaataaacccggttccgcacatattatggtgatttccaacccccgcgaacttgaaaaactcaaagaccggattcccaatctgatcaacatcatccgcgtcgccatcgtttttccgctgatgattatgcacatcctcgggctggaaaccggcagccgtgcgaacctgcacgcttcgtggacggcgtgggcgttttatgtttggctcgccattgcctgctggctgattttcttttccattatccatccgcattggcaatggcagtcgctgaaaatgccgcgtttcagcgcggtagcggacatcacgatgatcggcgtgctgacctacctgttcggcggcatcgattccggcttcggcatcctgatcctgcccttcgtcgtctgctcctgcctgctcagctacgggcgctaccccctgctctattccagctacgccgccatcctgctgatattcaacgccattgccgacggcgatatcggcaaatacccgctcatatcggatgcccgaaccgcctcggcaaccttcatccttgtcgccgcctcctatctttccgccatcttcacctcactgtcggtcaaatacatcgaccgtgccggaaaactcgcctacgacagccatatcgcctaccaccgcatcaaaggcttgagccaaaccgtactcgaacgcgttcaggaagctgtcgtcgtcatcaatgccgaagggctggcggtgctgttcaaccggaaggcgaaagaccttttccccgcgctcgaaatcggacggcgcgccggtctgtccgattctgccgccgaactgtgggatcaagcctctccgcacactttcgaatacgtcctcggcacacccggcctgaacgccggcatccgcgccgttccggtcaacaaagggtcggacaagctgctcatcctctacatccgcccgcaaagcgaaattcaggcagaagccctgtccgtcaaacttgccgcgctcggacaactgaccgccaacctcgcccacgaaatccgcaacccgatgtccgccatccgccacgccaacgacctgctgcgcgaaaatatggaagcgggggcggcagatccgttcaacgccaaattgtgcaaaatcatcgacggcaacatctgccgcatcgacaaaatgctcgaagacatttcctcgctcaacaagcgcaacaaaaccgaacgcgaaaccatcggcctgataccgttttgggaagaattcaaacaagagttcctgctcggccatcccgatgccgccgactgcatccgtccggacattcaaggcggcagcccgaccgcctatttcgatcccgcccacctgcggcaaattatgtggaacctcgccaacaacgcgtggcggcacagccgcaaacagcccggctcgatttccgtcaccatccgccccgcgcaaaaaaacaccgtctgtatcctctttgccgaccgcccgaagtgcaggaacacctgttcgaacccttttacaccacggcggaaaacggcaccggcctcgggctgtatgtcgcccgcgaactggcgcacgccaatttcggcgatttgacctacctaccggaagccaaatgtttcgaactcacattaccggaaaaaaccaatgactgaactgcaacaccccgtcctcgtcgtcgatgacgaaaccgacattctcgacctgatggaaatgaccctgatgaaaatgggcttgcgcgtccataccgcgtcaggcgttgccgaagccaaaaacaagctcgacagccaacgctattcgctcgtcctgaccgatatgcgtatgccggacggctcggggctggaagtcgtccaacacatcaacagccgcctgctcgatacgccggttgccgtcatcaccgccttcggcaacgccgatcaggcacaggaagcgttgcgttgcggcgcgttcgaccccgataccatgcagatacaggactatctcgaccaaatcgaacgcgacatcatcgaacaaaccctcaaacaaaccgaaggcaaccgcacgcaggccgccaaacgcttgggcatcagcttccgttccatgcgctaccgtatggaacgcctcaacatcggctgacgacaaaacggcatccgcaccatctccgcccacccgaaaaaatgccgtctgaaacggcacgggaaagcgggttcgccccacgcccgaacggacacaaaacaccatgaccgacatccttattgacaacaccgccaccgaaaccgtccgcaccctgatacgggcattcccccttgtgcccgtttcccaaccgcccgaacaaggcagttacctccttgccgaacacgataccgtcagcctcaggcttgtcggggaaaaaagcagcgtcatcgtcgattttgcctccggcgcggcacaataccggcgcacaaaaggcgggggcgaactcatcgccaaagccgtcaaccacaccgcgcaccccaccgtttgggacgcaaccgcaggattggggcgcgacagcttcgtcctcgcctcgctcgggctggccgttaccgccttcgagcaacatcccgccgtcgcctgcctgctttcagacggcatccgccgcgccctcctcaatcccgaaacgcaaaacaccgccgcgcacatcaacctccatttcggcaacgccgccgaacaaatgcccgcacttgtccaaacacaaggcaaacccgacatcgtctatctcgaccccatgtatcccgaacgccgcaaaagtgccgccgttaaaaaagaaatgacctacttccaccggctcgtcggcgaagcgcaagatgaagcggcactcctgcataccgcacgccaaacagcaaaaaaacgcgtcgtcgtcaaacgcccccgcctcggcgaacaccttgccggacaagaccctgcctaccaatacacaggcaaaagcacccgcttcgacgtttacctgccctacgggacggacaagggataacgcccataaaacaagacaccgaaaaatttgccgttcttatgcaaacgagaaaccggtttttgcgtttcgactgttttggataagtcatcacaccttaaagtttgtcattcccacagaagtgggaatccgattcattcagttttatagtggtttaaatttaaaccactatagttgttttcgagtttcaggcaacttccaaaccgtcattcccacggaagtgggaatctagaaatgaaaggcaacaggaatttatcgtaaatgactgaaaccgaacggactagattcccgcctacgcgggaatgacggggcgggcagatgccgtctgaaattccgtcattcccgtgaaaacgggaatctagaacttctgatttttcagacgacttttgaacattgccgccacccaatgatctggattcccacctgcgcgggaatgacgaggtttcaggttgctgtttttaagttgctgtttcgggttgctgttttttatggaaatgacaaggttttagattgcgagaatttatccgctcctccgtcattcccacggaagtgggaatccagaaatgaaaagcaacaggaatttatcataaatgaccgaaaccgaacggactagatttccgactgcgcgggaatgacggggcgggaggatgccgtctgaaattccgtcattcccgtgaaaacgggaatctagaacttctgatttttcagacgacttttgaacattgccgctacccaatgatttggattcccgcctgcgcgggaatgacgatgtaaaattatccgggattcaaaaagacaggctttcacatccgtgggaatgactgcggaaagatgatttttatagtggattaacaaaaatcaggacaaggcgacgaagccgcagacagtacaaatagtacggcaaggcgaggcaacgccgtactggtttttgttaatccactatattttgtcataaaaatccgcaccttaatcagttggcggttaaatcaaacttttagggtgcagattactttttatgatttcagacagcattttgacaggcggcagcctatttcggcaataccaaaaacttaatcagcagttctttgaatacaaaaccgaacacgcccaagcccaaaaccaaaaacaaaatggcgatgccgaatttgcctgctttggactccttgcccaaattccaaacgataaaacccaaaaaaataatcaagccggtcaggcagattttcaacgcccaatcggcaaaaaccgcttcatccatatttttttcctattgttgatgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtagtacacggcttgaacctgcggctgcgcttgcagccattgtgcgattttcagggcgttgtcgaactgtttttccatacgcagcgacagggtttccacgccgctcaacaactgccacgcattaaacggcgacatcgccagcccgcaagagttgcaatacatggcgacctgcgccaacaactcttccgaacccgccaacacgccgcccatcacacgcccgtgtccgtctatggctttggtcgcggaggaaacggaaatatccgcaccgtgtttcaaaggctgcgagccgacgggcgacagcaggctgttgtccaccaccaagagcgcgccgatgccgtgcgccaattccgccaaggcttccaagtcggccacttcgcctaaggggttggacggcgtttccaaaaacagcagtttggtattggctttgacggcggctttccattcgtttatatcagtcggcgacacgtggctcacttcgatgccgaatttggcaacgatgttattgataaagccgacggtcgtgccgaacaggctgcggctggaaatcacatggtcgcccgcctgcaaaaaggtgaaaaacgccgcctgaatcgcagacatacccgccgaagtggcgaccgcgcgttccgcaccttccaaagcggcgatgcgtttttcaaaggcggctgtggtcgggttggcggtacgggtataagtgaaccctttgattttttttgaaaacaaatcggcagcgtgttgggcgttgtcccacatgaagctgctggtcagaaacaatgcctgattgtgttcgcggtattcggtttgttctttgccgccgcgtatggcgagcgtttgcggatggagttttttgctcatcggtgattcctcggttttgtccgttcggcaacggagcgtgcgcccgttgtttaatttgttaatattttgcgcctgttctatgatgctttcaagtcggatgagaatgcaaatgccgtctgaaacggctttcagacggcatggcaatcagcgtttgtattttaactcgtacttgatgtcgttgaggattttgcggacatcgtgttccaacacgtcttcgactaccgcccccgcctgctcgtgcagcatctgctggagctgataggtgaaaaccgccatctgcttttgcaccgccgttcggatgatgccgttgacggtatcggtcagatgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgccttcaacacacgggctcggctctcatcgtccagtttcggcacaggcgcgtccgttccggtttcagaggggcgggacagcggcgcgtaagtcggcactgccttcatacggcgcgtctgacgcaggttttccaaacgtttttcccaattcggctctttattcgcatccattttcggcttccggttcttaatctttgcaagcagacaaacccgcgcccaaagcgcggtttgatataatggcgcattttaacagattcgcgaggatacatcatgggcagcatcgaacagcgtttggaatatctggaagaggcgaacgacgtgctgcgtatgcagaaccacgtcctgtccaccgcattcaaagccttaatccgcgcccttcccgccgaaaccgccgaaatcgcggtcgagtcgattcagcttgcttttgaggacgccttggcagaattgagctatgaggacagcccgcatacggatttgttccacgacgttacttatgcgtttttccgtgaaaaagaacgttaattttatgttaaactgattttttaggctttttgattaccgaaaggaattttgatgaatatgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataagcccgcccgtccgaacacaatgccgtctgaagccctttcagacggcattgttcatcaatcggcctacaatgaactgcctgctgatttctccctaccgcaaagcaacaggcaaagattacaaatatcaaaatccgagtaaaacagtattttattaaaacaaattgataatcaagagattagaattatgtattgtctttaccgtacaaacgctggcactatttcaacctgataaaaaacagccttcaaaaaggttgtttaaaacagcagcagacacttaccgccacaaccttgaaaaggaacacaatcatgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttgaggcgccatgccgtctgaacacaaaatctgccttcagacggcatttccgcccccggttgcggtacaatccaccatttcatcactcggcgacccacaccgtgaaaatcctcattttaggcaacggacaggtaggttctaccgtcgcacaaaaccttgccgccatacccaacaacgacgtaaccgttatcgacatcgacgaaaaagcattgcaggaaacaggcagccgcctcgatgtccaaaccgttttcggcaacggcgcatcccccttcacattagaacgcgccggcgcggaagatgccgacttgctgctcgcgctctcccgcagcgacgaaaccaacatcgtcgcctgcaaagttgccgccgacctgttcaacatccccggccgcatcgcgcgcgtccgttccagcgaatacctcgaatacctcagccccaagctcgaaaacaacgaaaacggcagcctttccatattcggcataaccgaaaccatcagccccgaacagctcgttaccgaacagcttgccggcctgatagactgcccgggcgcattgcaggttttacgttttgcagacgaccgcgtgcggatggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataaaccgccccattccggacatattgccgccaagcggtatggaagcggaaataatggtaggtgggcttcagacggcatccgccctccccgtcattcccgcgtaagcgggcatccagaccttgggatagcggcaatattcaaaggttataaaagacccgtcattcccgcgcaggcgggaatccagaccttgggatagcggcaatattcaaaggttatctgaaaatttagaggttctagattcccgctttcgcgggaatgacgaaaagttgcgggaatccagaacgtcgggcaacggcaatattcaaaagccgtctgaaaatttaaaagttctagattcccgctttcgcgggaatgacgaagtttcagacggcatcgcccgcctgttttgatatagcggcacccccccgacaaaaaaacaatccggaacgcatctgaccgttccggcttgttttcaggcgaatccgccgcatcagaacatactgcgcacgcccatattgacctgccaagtctagcgcatcgtgtgcatcgaagacctttgcgcctcaaaataaagctgccttccgttgtcggcattaccacgcaaaaaaatgaattgcttgatattccaatgttttttatatgtttttatattgtgatgcgatcagacaaacgcccccctgacatttgtttagacggcatcgtattgctaaatttctataagtatgtataatgtccgtttccacgcgcccatcgtctagaggcctaggacactgccctttcacggcggcaaccggggttcgaatccccgtgggcgtgccaattcaaaaacctgcttgtttcaagcaggttttttattatgagtcgtcattcccgcaatttttcgtcattcccgcaaaagcgggaatctagagcgtagggttgaagaaaccgttttatccgataagtttccgtgccgacaggtctggattmccgcctgcgcgggaaggacggcagagggtggacgatgccgtctgaagcctgacaaagcatttgatgccgtctgaaacttcgtcattcccgcaaaagcgggaatctagagcgtagggttgaagaaaccgttttatccgataagtttccgtgccgacaggtctggattcccgctttcgtaggaatgacggaattttaggtttctgtttttgtggaaatgacgaataaagcgtgccggtttatgctcgccgcaacacgcggttcagacggcattgctctcttttttcattatcagtgggtgtagcaactgtatttttcaccccgtcgggcaaaaatacagttgctacgatgcaccccgccgccctgccctgtgccttgtcctgcaatacggcatataatgcaccacaaacccccgcgctgcggttttcagacggcatcgccgtgcttttttacaggcattagccctttttatcggacgcaatattaaggaggaacaaatgaaaagctcttttgtgcaaacgcttaccatcgccggttcggattcgggcggcggtgcgggcattcaggcggatttgaaaacatttcagatgcgcggcgtgttcggaacgtgcgtcatcaccgccgttaccgcgcaaaataccttgggcgtgtcggcggttcatctcgtcccgaccgaaaccatcaccgcacaaatccaagcaatcagggaagacttcgacatccgcgcctacaaaatcggtatgctcggcacggcggaaatcatcgaatgcgttgccgacaagctgaaacactgcagctttggcaggcgcgtactcgaccctgtgatgattgccaaaggcggtgcgccgctgttgcaggattccgccgttgcggcactgacgcgcctgctgcttcccgatacggatgtattgacccccaacctgcccgaagcggaagctctgaccggcgtgcatattgaaaaccgtaaagatgcggaacgtgcggcaaaaatcctgcttgattacggtgtcaaaaatgtcgttatcaaaggcggacatttgaacggcagcacaagcggacgctgcacggattggctgtttacacaaaatgaaacgctggaattcgacagcccgcgctttccgaccgcccacacgcacggcacgggctgcacgttttccgcctgcatcaccgccgagttggcaaaaggctcggacgtttgcgaagccgtacagactgccaaggcctacatcacggcggcaatctcaaaccctttggaaatcggcgcaggacacggcccggtcaatcattgggcgtatcgggactaaccgtaaaaatgccgtctgaaacaaaatgttcagacggcatttttgaggattattcaggctttttcgccagcatcgttacaaatttaaaccgtatcggattgccgttttcgtctttggcatgcatagaacccaattcttctttatattcgaccagttcccaatcccgataataatccttcagctcgccctctttaaatttaaaagggaacggcatcggacaggggaaatccgccgtatccattgccgatacaatcaagttgtacccgcccgccgccgtatgcgcctgcatatcggcaatcacgtcgggtacgcgctgcggcatcaggaacatcagcaccactgttgccacaatataatcaaactcgccctgcaaggcggcggcgttcaaatcatattccagcgtgcggacgttcaaaccctccgcctctgccagctccgccacgtttgccaaggcggcgggattgtgatcgactgcagtaacttcaaaccccttcaaaccgagaaacagcgcgttgcgcccctgtccgcagcccatatccaacgccctgcccgccggtacggtatcccgtgccgccgcgaccgcagaatgcgtggcactcatcccgtattttttgtgaaaatagtctgccgccgcgcaatacagcgacaaacggatttcggcatcgtccgttttcggtttgacagaaaacacctgctgcggcgcaaacacacaatcgccgccgtctgccgaccaaacttctgccgacccgtccggtgcacgaacttcgacatcgccctgcaacacattcaggcagacccactccccttcctcagacgaatagcccgacaacaaaacttccggcaggttttccactttccatacaggcatctgtccgaaacaaaacaactcgccactttgacccactatccgctccttcawattcaaaaataaagttgcacattatatgcctattttaatccgccgcaatctttcagacggcacggcgcgcaaaccgcttataatcacgccggacaccacacaaaggcacaataatgaaccaaaccgtttacctttacaccgacggcgcgtgcaaaggcaatcccggcgcgggcggctggggcgtgttaatgcgctacggtagccacgaaaaagaacttttcggcggcgaagcgcaaaccaccaacaaccgcatggaactgactgccgtcatcgaaggactgaaatcgctcaaacgccgctgcaccgtcatcatctgcaccgactcgcaatacgtcaaaaatggcatggaaaactggatacacggttggaagcgcaacggctggaaaaccgcctccaaacagcccgtcaaaaacgacgacttgtggaaagaactcgacgctctagtcggacggcatcaagtcagttggacttgggtgaaaggacacgcgggacacgccgaaaacgaacgcgccgacgatttggcaaaccgtggcgcagcgcagttttcctgactgccgctccggcaaaaatgccgtctgaaaccgctaatgggcttcagacggcatcgtcctccaccgtcattcccgcgcaagcgggaatccaaaccgtcgggcaacggcaatattcaaagattatctgaaagtttgaagttctagattcccgttttcacgggaatgacgaaaagttgcaagaatgacggagtttcaggcggcatccgaccgccccgtcattcccgcgaaagcgggaatctaaaaacccaacgctgcaagatttatcagaaacaactgaaaccgaacggactggattcccgcctgcgcgggaatgacgggattttagtaaccgtagcaaccgcctgcgcgacggctaaggggcttcagcaaccgtagcaactgcctgtgtgggaatgacggacaatgggcttcagacggcatctcttgcctgccgctaaaacagtttgccgcacaactgttcaaacgcgtccgatatgtttcaacacacaggacgacacataaagcacctccctatgtgtcgtcctgatttggaaggggttacaccccctcccaaataaagtctgatcctgccgccctaaagggcggggtttcaaccgaaaaggaaatacgatgaagtggtacaattagcggcaatgcggacagacaaattaaactatagtggattaaatttaaaccagtacggcgttgcctcgccttagctcaaagagaacgattctctaaggtgctgaagcaccaagtgaatcggttctgtactatttgtactgtctgcggcttcgttgccttgtcctgatttttgttaatccgctatatcagaaattaccctaccgttttttaaacactttcaggaataaggaaaaatgaccgcccaaccctgccccatctgcacggcgcaaaatgaagacgttttgctgcaaacccccaacctccgcgtcatcgccgtccataacgacagcggttcgcctgcattctgccgcgtcatttggcgtaagcatattgccgaaatgaccgacctttcggcagcggaacgcggcgaattgatggaaatggtgtacaaagtcgaagccgctatgcgccaagtgttccggccggcaaaaatcaacctcgccagcttgggcaatgtcgtgccgcacctgcattggcatattatcgcccgctttgaaaacgatgcgtctttccccgcgccgatttgggcaaaccccgtccggaaacacggtatgaccctgccgcaagattggacggaacagcttaaaaagctgctttaagcccgccgatgccgtctgaaaccgtatgaaagggaaattatgaccgaaccgacctcccgccgccgttttctgaaaacctgcaccgccgctgccggcgcggggctgcttcaggcttgcggcacatccgccacatccgttccgccccttccctcttcccattccgttgtgaaagcccgaaccgtgcctctccaaacgccacgccgtcaaagttcggacggcaaccttctgcgcgttgtcgcttcgtcaggatttgccgaagacaccaaccgcgtcaacacagccttaacccgcctttacaatgtcggttttaccgtaaccaaccaacaggcgggcagccgccgtttccaacggtttgccggcacggacacgcaacgtgccgccgatttccaagaggtcgcttccggccgcgtcgccacgcctaaagtgctgatgggtttgcgcggcggttacggtgcggcgcggattctgccgcatatcgattttgcttcgctcggcgcaaggatgcgcgaacacggcacgctctttttcggattcagcgacgtatgcgccgtccagctggcattgttggcaaaaggcaatatgatgagttttgccggcccgatggcttatagcgattttggcaaacccgcccccggtgcgtttacgatggatgcctttatcaagggtgcaacccaaaaccgcctgaccgttgatgttccttatatccaacgcgccgatgtcgaaaccgaaggcatattgtggggcggcaacttaagcgtcctcgcctcgctcgccggcacgccttatatgcccgacatcgacggcggcattttgttcctcgaagatgtcggcgaacagccctaccgcatcgaacgtatgctcaatacgctgtatctttcgggtattttgaagaaacagcgcgccatcgtgttcggcaatttccgtatggaaaaaattcgagatgtctatgatccgtcttatgatttttctgccgttgccaaccatgtttcgcgcacggcgaaaatccccgtgctgacgggcttcccgttcggacacattgccgacaaaatcactttccctctaggcgcgcacgcccgaatccgtatgaacggaaacagcggttattcggtcgcgtttgaaggctaccccacactcgatgcgtccgccctgactttggataccctgctcccaccgccggatttgcccatcttccccgaaagcggtgttgccgatatttcggaataaacccgcaaacggacaaatgccgtctgaagccttcagacggcatttcccaagacggcggcagattacagcaatgcccgaatatcggcttcgatttcttcgggcgtaacactaggcgcaaaacgctcgaccacttcgccgtcgcggttgacgaggaatttggtaaagttccatttgatgtcgccttcgtcgcgcttctctcccaaagctgcgagcttcaacacgaaatctttaaacagatgattgcctttatcttgcggtttgacggatttcaggtaggcatacaagggcgcggtatttgctccattgacttcgattttgtcgaaaatcttaaacttcgtgccaaacttcatcatacacacttgggcaatttctccgctgctttcgggagcctgttcgcggaactggttgcacggaaaatccaaaatctccaagccttctgcggtatattgtgcatacagcttctgcaaagcctcgtattgcggggtcagaccgcaacgcgttgccgtgttgacaatcagcagaaccttgccgcgatagcctgacaaatcaaccgcattgccttctgcatctttcatttgaaaatcgtaaatacccatttttatccttatctgatgtaaaccgatgccatctgaaacgtgcttcagacggcatgaaagcagcaattgtatagccgattaaaataaaaaatccacatccttttccattcccgtcccaatccgcaataaaaaactgcacccgaaaacgggtgcagttgctcatttcataccgcaaaacttatttgtcgcggccgaatacgattttagtggcttggatggcgacacagattgcaccgccgataaagaccaagtcagctgccgtacgtacccaacgcaaggtatcgaggatttccatttgcaggaactcttcgctgcgggcataccacagaccgtgcgtgatggaggcgtatgcctgaatcgcgccgacaggcagcaggctgatggcaatcataccggccaagccgccgttgagcagccagaagccccaagtcatcagtttgtcgtcaaactgcgcgttcggtttcaaataacgggcaaccagcaatacgaagcccaatgccaagaaaccgtacacaccaaacaaggcggcgtgcgcgtgaacggcagaagtgttcaaaccttggatatagaacagggaaatcggcggattgatcaggaagccgaatacgccggcaccgatcatattccaaaaggcgactgccacgaagcacatcagcggccaacgcaggcgtttcgcccagtcggacaggtgttggtaagaccagtgttcgtatgcttcacggcccagcaacaccagcggcacgacttccaaagcggagaagcaggcaccgattgccatagaggcggaggtagagccggagaagtacaggtggtgcagcgtgcccggaacgccgcccaacataaagatggcggcagcggccaaagtggaggcagtggcggtactgcggcggacaaagcccatattgtagaagacaaaggcaaaggcggcagtggcaaatacttcgaagaagccttctacccacaggtgaaccacccaccaacgccagtattccataacggcaatcggggatttttcgccatagaacaggcctggtgcgtagaatacgcccacaccgaccatagaagctacgaagatagccaacaggtttttgtccacgcctttttctttaaaggcggaaaccgtgcaacgcaacatcaggaacagccataacagcagaccgaccatcaaaaggagttgccagaaacgtcccaaatcgaggtattcgtaaccttggtgtccgaaccagaagttaaattccgggggaaggatgtgcgtcaacgcgaagaagttgcccgcgtaagaaccgccgaccacgatgaagagggcgatatagaggaagtttacgccggcacgttggaacttgggatctttaccgccgttgacaatcggcgcgaggaacaaacctgccgtcaaaaagccggttgcaatccagaagatggcggattggatgtgccaagtacgggtcagggcgtaggggaaccagtcggacatttcaaagcccaacgcctcgtcaatgccgtagaaaccctggccttcgacggtgtagtgcgcggtcagtccgcccagcaatacttgtaccacaaacagggcgaccgtcaggaagacgtatttgcccaatgctttttgcgaaggggtcagttggattttggaaatcgggtcttcagacggcacttccacttcctcgtgtttggtcaggaaggaataaccccacatcagcaaaccgatgcccatcagcagaagaacaacgctggtgaatgaccacatatagttttcagtggtcggtacgttgttgatcaaaggttcgtgcggccagttgttggtgtaagtaaaattctcgtcaggacggttggtcgaagcagaccaagaagtccagaagaagaagttgaacagtttttcacgcgcttcttggcttggcaatgtattgtttttcattgcaaagtgttcgcgagtggtttggaacttaggatcgtcgctgtacacaccgtggtagtaaggcaggatgctttcgatggctttcacgcgcgtatcgctgatgacgacgctgccgtcttccttcacgcggctttgattgcggtattcgtcggccaggcgtgttttcaagacggcttgttcctcgggggaaacctcgtcgaattttttgccgtaagtctgttgcgcggtcaaatccaaccaggcaaccaactcacgatgcagccagtccgccgtccagtccggagcctgatatgcaccgtgacccaaaatcgaaccgacttccataccgccggtagtctgccatgcagactgacctgccaaaatatcgtctttcgtcatcaagaccttgccggatgcggaaacgacctgttcggggtaaggcggggcttttttgtaaacctcgctgcccatatagccaagaatggtaaagcataccgggtac

SEQ ID NO: 2 - DNA, 35042 bp, Neisseria meningitidis
cgaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctggcaaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaaaggcagcccgcattttgtagaaaaccgcaatgccgtctgaaagcccttcagacggcatttgtttccccaaacgcatcatcctgccgcaagcctatgccaatccgttttatcgcatcggcaactcaaagaaaaatccatttcattcccacgcagggaagccggtttttgatttcggttatttttggttgtttcgggtaatttatgagtcgtcattcccgcaaaagcgggaatcagtttttttaagtttcagccatttccgataaattcctgtggctttagctttccggattcccactttcgtgagaatgacgtggtgcaggtttccgtacggatggattcgtcattcccgcgcaggcgggaatctagaccgttcggtttcggtttttttggttagtgccgcaacattaaatttctagattcccactttcgtgggaatgacggcggagcggtttctgctttttccaataaatgcccccaacctaaaatccgtcattcccgcgcaggcgggaatctagacattcaatgctaaggcaatttatcggaaatgactgaaactcaaaaaactagattcccactttcgtgggaatgacgtggtgcaggtttccgtatggatggattcgtcattcccgcgcaggcgggaatctagtccgttcggtttcggtttttttggctaatgccgcaacattaaatttctagattcccactttcgtgggaatgacggcggagcggttgctgtttttcccaataaatgccccccaacctaaaatccgtcattcccgcgcaggcgggaatctagtccgttcggtttcggtttttttggctagtgccgcaacattaaatttctagattcccactttcgtgggaatgacggcggagcggtttctgcttttcccaataaatgcccccaacctaaaatccgtcattcccgcgcaggcgggaatttagacattcaacgctaaggcaatttatcggaaatgactgaaactcaaaaaactggattccctctttcgtgggaatgacgtagtgcaggtttccgtacggatggattcgtcattcccgcgcaggcgggaatctagacattcaatgctaaggcaatttatcggaaatgactgaaactcaaaaaactggattcccgctttcgtgggaatgacgcgattagagtttcaaaatttattctaaatagctgaaactcaacgcactggattcccgcctgagcgggaatgacgaagtggaagttacccgaaacttaaaacaagcgaaaccgaacgaactggattcccactttcgtgggaatgacggaatgtaggttcgtgggaatgacgggatgcaggtttccgatggatggattcgtcattcccgcgcaggcgggaatctagacattcaacgctaaggcaatttatcggaaatgactgaaactcaaaaaactggattcccacttttgtgggaatgacgcgattagagtttcaaaatttattctaaatagctgaaactcaacgcactggattcccgcctgagcgggaatgacgaatttcaggttgctgtttttggttttctgtttttgtgaaaataatgggattttagcttgtgggtatttaccggaaaaaacagaaaccgctccgccgtcattcccgcgcaggcgggaatctagtccgttcggtttcggtttttttggctagtgccgcaacattaaatttctagattcccactttcgtgggaatgacgggatgtatagtggattaacaaaaaccagtacggcgttgcctcgccttagctcaaagagaacgattgtctaaggtgctgaagcaccaagtgaatcggttccgtactatttgtactgtctgcggcttcgtcgccttgtcctgatttttgttaatccactataaatttaatccactatattttttgttccaaagtcaaaatatgccgtccgaacattcgggcggcagacaaaacggcactgcccgataaaggcagtgccgttgtccgtttcaaaccgtgaaacatcagcccaaattaaaggctttatgcaataccctggttgccagttccatgtatttttcatcaatcaatacggaaactttgatttcggaggtggaaatcatttggatgttgataccctcttcggcgagcgtgcggaagattttggcggctacaccgacgtgcgaacgcatacccaaaccgactgcggagactttgcatacggtgtcgtcgccatcaatagaagccgcgccgatactgtcttggcgttccgacaggatttccaaagtctgcttgtaatcgccgcgcggtacggtaaaggaaaaatcggttgtgccttcgctgccgacattttggataatcatatcgacttcgatgttggcatcggcaaccgcgcctaaaatctgataggcgacgccaggtttgtcgggtacgccgcgcacgttgatgcgggcttggtttttatcgaatgcgataccggttacggcagctctttccatgttgtcgtcctcttcaaaggtaattaaggtgccattgccgccgtcttgcaggctgctcagtacgcgcaggcgcactttgtattttccggcgaattctactgaacggatttgcaaaactttcgaaccgaggcttgccagttcgatcatttcttcaaatgtaaccgtatccatgcggcgcgcttcgggtacgacgcgggggtcggttgtgtaaacgccgtctacgtcggtatagatttggcactcgtcggctttgagcgcggcggcaagcgcgacggcggaagtgtcggaaccgccgcgtccgagcgtggaaatatcgccttcactgctgatgccttggaagccggcaacgatgacgactttgccggcggtaaggtcggcacgcattttttcgtcatcaatgctttcgatgcgggctttggtgtgggcggtatcggttttgagggcgacctgccagcctgtgtagcttttggcatccacgccgatgtctttcaatgccatcgccaaaaggccgatggttacttgttcgccggtagctaagacgacgtccagctcgcgcggatcgggatgctcttgcatttcgtgcgccagtgcgaccagtcggttggtttcgccgctcatggcggatacgacgactacgatgtcgtgtccttcggcgcgggctttggcgacacgtttggctacgtttttgatgcgttcgggcgagcctactgatgtgccgccgtatttatgtacgattaacgccatgtttcgtgctttcttgtgggggttgtcgggcagcttggtttgctggaaaaagggttattattactattttttacatggaattcaagaacggactgcgctttcccgcctgccgtttgacagcggtcagcgaaaaacctgttctttcagattgttgacaaaatgccgtctgaacggttttcagacggcatccggacgacaatcaggcggcggacaacgcattttgctggtgttgcagcagttcgcctatgcctttttgcgccagtgcaaccagtttgcccaattcgtccaaactgaacggcgcgtcttccgccgtcccctgtatttcgatgatttttcccgatgcggtcatgacgatattcacatcactgtcgcaaccggagtcttcgggataatccaaatccaaaagcggcacgccgttcactacgcctactgacacagcggcaacggcttcgcggatggggttttcactcaaaatgccgtctgaaaccagtttgccgacggcgatttgcagcgcgacaaacgcaccggtaatcgaagccgtgcgcgtaccgccgtctgcctgaatcacatcgcagtcaatcaagatttgtcgttcaccgagtttttccatatccacgaccgcgcgcagggaacgcccgatcaaacgttggatttcttgtgtgcgcccggactgtttgcccgccgaagcttcgcggagcatccgggaagcagttgaggcaggcagcatcccgtattccgccgttacccagccttggtttttaccgcgcagaaacggcgggacgttttcatctatggaagcggtacaaatcactttggtattgccgcattcaataaggcacgaaccgtccgtatgcggcaggaaatgaggggtgattttgatatcgcgcaggctgtcggcggcgcgcgagatgcggatgtaatcaggcatactgccctcccgttaaaaacagataaattaaaaagccttaaatatgaaaaatcacatttaaggccttcaaactgaaaatttctacgcctcttcggctttgctgcggataatcaaaagcggcaggtggctttggcgcattaccgtttcggcaaaactgcccattaaaaggtgcatcagcccggtacgtccgtgcgtacccaacaccagcaggtcggcaccgttttcatcggcataatcaaccaaatcctgcgccatttcacgcgcacccttattggcaaccagcaggtgtttgacggtattttccacacccagttcctgggcggtgcgctcggcggcatccaaaacttcgttgccttgcgcgacggcggcggcttcgtagctttcgtgttgcaaaaattcgggggcgagtgccatatattcggcaggattggcaacgtgcaccaaagtcaggcgcgcaccgttgaccccggcaagctcggcggcatgtttcagggcattgatggacgtttcactgccgtcaacggcaacaaccaaatgtttgtacatatcgtattctccttttgcaccgcctcgcggtgccctcttgtcggatgggcgcagggacagtttgcgctgtttcattatagacccgccgtcgggctttatacaacagccgaacagcccgaccgctttccagtataatatgccgcttccgtgcagtcaggcattttttgccggctttcgttcactttttgatttgacgcaatcttgcaggattcgaccatgtccgacaacgctttgacctcttcgcgacgcttcggcggcatcgccagactctacggagactctgccttggcgcacttttcacaggcacacgtctgcgtagtcggcgtgggcggtgtcggctcgtgggcggtcgaggctttggcgcggacgggcatcggacgtttgactttgattgatttggacaacgttgccgaatcgaatgtcaaccgccagctgcacgccctgaccggcgacttcggcaaagcaaaagttaccgccttgcgcgaacgcattacacaaattaatccgcaatgcgaagtgtttgaaattgaagatttcgttaccgaagacaatttgccggaatacttcggaaaaggttttgatttcgtcatcgacgcgatcgaccaagtgcgcgtcaaagcagcaatggcggcttattttgtggaacgcaaacaaccgtttgtcctcagcggcggcgcgggcggacaaaaaaatccggcgttaatccaaaccgccgatttgagccgcgtaacccacgacccgctgcttgccaacctgcgctacaccttgcggaaacgctacggattcagccgcgatacgaaagcaaatatgcgcgtgccttgcgtgtattcgaccgaaaatatcgtgccgccgcagtctagggaggcttgttcggcagatgccgctccgcaaggcttgtcgtgcgccggctacggtgcaagcatgctcgttaccgcttcgttcgggctatattgcgcacaggcggcggtggaacacatcgcagacaaaaaataagcaatgccgtctgaaacaggattcagacggcatttgaacaaactatggttatgatttaagacaacaaaggatacggataaaaaataacataaaatatatgattcctaataatataccaagtatcggagagctatttaatggaattcgttaataatttagttattttttcatttttattactaatgcttattccgatattttttgtagtatatggtatataccataagatacgttatcgcaaaatatgtatcctaagaacaagttttatattattagtggtaatactttgcagtatgtattacatatattgccgttatcttgaccaacaaaaagtagcttattattgcatagatgaacaatgtatttctattgttcatctatacaaagattatggtataaactctcccacatatgcgagaatttacgcaggaaaaatattgtttagatttcaagtaagagctaaaaattacgctgaattacttatggaagatgatatatcaattagtaaaaaaattttggggaataaatttatcatttatgggtcgctacctgtaatatacggtaatgtagataatattgaagtaaaagaagctactggttatatagatagatccagtactgattatattgtctcaagaaacttaaaattcagacatttatattaattaagaggttttagcaagagtgccgtcaaaatatagggcgcatcatcgaattcgcgaaagacaaacgctacgatgaacgtttcaaggatttgaaaaaagaatccataggctatctgaaccggcatcccggtttggtgtccgactacctgaaggcggcaatcaagctgtcggttcagaaaaaccaacatcagcacgcctaaaaccgtattcacaacctgctccttttcaaaacatttgcatttaaaagccgttataatgccgtctgaacatctgcccgaccacattatacgtgaatgtcggcagattgttttcttttgtaaacttatattaaaatccacttaccgattcacgccatgccgcccatccctgccccatctgcaccatccgagcacactgtcgcatgggtattcggccaacccgttaccgatttgccccaggatttgtttattccgcccgatgcattgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaatacgccccaagccgccaccaaaaatcgggagacacgccatatgaccggcatcatacattcgctgcttgacaccgacctctacaaattcactatgctgcaagtggttctgcaccagtttccgcagacgcacagcctttacgaattccgctgccgcaacgcctcgaccgtctatccgcttgccgacatcagggaagacttggaagccgaactcgacgcgctctgccaactacgcttcacccacgacgaactcggctatctgcgctccctgcgtttcattaaaagcgactttgtcgattatctcgaactcttccagctccaacgccgctttgtcgaaatcggcacagacgataaagaccgtctgaacatccgcatcgaaggtccgatgatacaggcgatgttttttgaaatcttcatcctcgccattgtcaacgaactttacttccgccgcctggaaacccctgcagtcatagaagaaggcgaacgccggcttcaagccaaagccgcgcgcctcaaagaaatcgccgccgcacaaaaccccgacgaaccgcccttcctgatttccgacttcggcacgcgccgccgctacaagctcgcgtggcaggaacacgtcatccgcaccctgcttgaagccgcccccggcatcgtacgcggcaccagcaatgtctttctcgccaaaaaactcggcatcacccccatcggcaccatggcgcacgagttcctgcaggcattccaggccctcgacgtacgcctgcggaatttccaaaaggccgcgctcgaaagctgggtgcacgaataccggggcgatttgggcgttgccctgaccgacgtggtcggtatggatgccttcctgcgcgatttcgacctctatttcgccaaacttttcgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaagaccgcttcaaaaccggcttcggcatcggcaccaacctcaccaacgatatggggcatacgcccttgaatatcgtcttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaaaccggcagaaaaagcgcacaattcctgtttctgccgcataaaatcttttaaaataccgcctgatttgaatttaaccgaaagaccgaacttcatgaacctacatcaaaccgtcgaacacgaagccgccgccgcctttgccgccgcaggcatcgccgacagccctattgttttgcagccgaccaaaaacgccgaacacggcgatttccaaatcaacggcgtgatgggtgcggcgaaaaaagccaaacaaaacccgcgcgagttggcgcaaaaggtcgccgaagcattggcggacaacgccgtgattgaaagcgcggaagtcgccggtccgggcttcatcaacctgcgcctgcgccccgaatttctcgcgcaaaacattcagacggccttgaacgacgctcgtttcggcgtggcaaaaaccgacaaaccgcaaaccgtcgttatcgactattcttcgcccaatctggcgaaggaaatgcacgtcggccacctgcgttccagcatcatcggcgacagcatttcgcgcgtgttggcatttatgggcaataccgttatccgtcaaaaccacgtcggcgactggggtacgcagttcggtatgttggtcgcttatttggtcgagcagcaaaaagacaatgccgcgttcgagctggcggatttggagcagttttaccgcgccgccaaagtgcgctttgacgaagaccctgcctttgccgacaccgcacgcgaatacgttgtgaagctgcaaggcggcgatgaaaccgttttggcattgtggaaacagtttgtcgatatttcgctctcgcacgcccaagccgtttacgacacgctgggcttgaagctgcgtcctgaagacgtggcaggcgaatcgaaatacaacgacgatttgcagcccgtggtcgatgatttggttcaaaaaggtctggcggttgaggacgacggcgcgaaagtcgtgttcttggacgaatttaaaaacaaagaaggcgaacccgccgcatttatcgtgcaaaaacaaggcggcggcttcctctacgcctccaccgatttggcgtgcctgcgctaccgcataggccgtctgaaagccgaccgcctgctgtacgtcgtcgaccaccgccaagccctgcacttcgaacaacttttcaccacttcccgcaaagcaggctatctgccggaaaacgtcggcgcggcatttatcggcttcggcaccatgatgggcaaagacggcaagccgttcaaaacgcgcagcggcgacaccgtgaaactggtcgatctgctgaccgaagccgtcgagcgcgccaccgctttggtgaaagaaaaaaatcccgaattgggtgcggacgaagccgctaaaatcggtaaaaccgtcggcatcggcgcagtcaaatacgccgacttgagcaaaaaccgcaccagcgactatgtgttcgactgggatgccatgctctcgtttgaaggcaacaccgccccctatctgcaatacgcctacacccgcgtgcaaagcgtgttccgcaaagcaggcgaatgggatgcaaatgcgccaaccgttttgaccgaaccgctggaaaaacagcttgccgccgagctgctgaaatttgaagacgtactgcaaagcgtggcggacacggcgtatccgcactacctcgccgcctacctctatcaaattgcgaccctgttcagccgcttctacgaagcctgtccgatactcaaagccgaaggcgcaagccgcaacagccgcctgcaactggcaaaactcaccggcgacacgctgaaacaaggcttggatttgctgggcatcgatgtgttggacgtaatgtaaaaccgcaccgcccgattgcggacaacagcctcgccatccttatccgaatctgaaaaaagcggcgcgatacaccgtatccgccgcccctcccaaaatgcgaaacaaacaaacgccaagcaagcaagcaagcaagcaagcaagcaagcaagcaagcaagcaaaaaattataacccccttcctgccgacgcacgcactttccgcgcggcgcattccccttttcccgcccctcaaatccgccttttcttcaggcagggtttcagcccgcctcttttccctgttttcctttccccgacacgcgtgcgctccccctgccgcactgtgctgcactttcgcgcccggacggcatcgttccgccatccggttctctgttttacatacccctgtttcagaaagaaatgcagatgtttcaacacacaggacgacacataaagcaccgccctatgtgttgccctgatttggaaggggttacgcctcccaaataaagtctgatcctgccgccccgaaggacagatgtccgagtggcgaagtttcaaccgaaaaggaaatacgatgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataacaacaatgccgtctgaacgcaccaacagccttcagacggcattttgcagacagaccgacccttcaagcccacttttttcatcatctccgataaattgctttgtatagtggattaacaaaaaccagtacggcgttgcctcgccttagctcaaagagaacgattctctaaggtactgaagcaccaagtgaatcggttccgtactatttgtactgtctgcggcttcgtcgccttgtcctgatttttgttaatccgccataaagaccgtcgggcatctgcagccgtcattcccgcgcaggcgggaatccagaacgtggaatctaaagaaaccgttttacccgataagtttccgcaccgacagacctagattcccgcctgcgcgggaatgacgggattttaggtttctgattttggttttctgtccttgtgggaatgacgggatgtaggttcataggaatgacgtggtgcaggtttccgtatggatggattcgtcgttcccgcgaaagcgggaatccggaaacccaaagccacgggaatttatcggaaaaaccgaaaccgctccgccgtcattcccgcgcaggcgggaatctaggtctgtcggtgcggaaacttatcggataaaacggtttcttcagattttacgttctggattcccactttcgtgggaatgacgggatgtaggttcgtaggaatgacgtggtgcaggtttccgtatggatgggattccctcttgcgtgaggctgacagatgccgtctgaaagactttcagacggcatagctttttctctttgaatttatagtggattaacaaaaatcaggacaaggcggcgagccgcagacagtacagatagtacggaaccgattcactcggtgcttcagcaccttagagaatcgttctctttgagctaaggcgaggcaacgccgtactggtttttgttaatccacgataaatttgccacaaaaaagctgcctcaaatgaatacccgggcagctttttgttgatatgactccaatcagcggtgttgcggattgtaacgtttttccaaacgcaggaatatccagcctaagaaagtcgtcatcaacagataaatcagggcgacggtgtaaagcggttcttcataaaccgaataccggcccgtaatcgtattctgaacatacgccaactccgccacagcaatgaccgacagcagcgagctgtctttcaagagcgtgatgaactcgctcgccaaaggcggcagcatgcggcgcaatgcctgcggcagaatcacatagcgcatcgcctgcggataggtcagccccaaagaacgcgccgcctccatctgtcctttgtctatagactggatgcccgcgcggaaaatctcacagatatacgcccccgagttggcgatcagtgccaaagaaccggcaatcagcggcccgtatccgcgacgcagcgcgattgccgcctcgccgctgaccaaaatgccgtctgaaggatggacgaaaaacggaaaccacacatacgcccaaatcacaatctgcacaaacagcggcgtaccccggaacagcgtaacatacagcagcgaaactttacgcaacgcccacgccagcacgcgcatcggcgcaccggctttttccaagtgaatcaggcgcgccaacgccaacaacagacccaataccgaaccgcccgccgttgccacgaccgtcagccccaaggtcgtcagtgcgccgtaaagaaacatccagcggtattcgtaaataatgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgctcggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtatcgaacacgcgcacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacagggcgacgggaagccatttcatgatttttttaatctgcatatttttcaaatgccgatgccgtctgaacatatcggaatcggatttcagacggcatcttaacgtcaggattacccttggcagggatagatgactttcgcaccctcttccgtccccaaaatcaacacatcggcggcatcgcgggcgaatatgccgttttcgagcacgccggtgattttgttgatttcgtcttccatcgtcagcggctgatcgatattcaagccgtggacatcgacgatttggttgccgtaaaacgtggtgtagccgatacgcagttcgggctgtccgcccatagcgagcagtttgcgcgaaacaagagagcgcgcgctttcgacgacttccacaggcagagggaatttgcccaaacgtgaaacatatttgctttcatccgcaatgcagatgaatttttcggacgcgctggcgacgattttttcgttgaggtgcgcgccgccaccgcctttaatcatttgcagggcgtggttcacttcatccgcaccgtcgatatagaccgccaaccccgatacttcgttcaaagaaacgacgggaatatcgtactgggcaagcagttcgccggattttttggaagtagataccgcgcctttgatttttttgccgctcttacccaaggcttcgatgaaaaagttgatggtcgagccggtaccgatgccgatatattcattttcgggtacgaattcgactgctttttcggcggcgatgcgcttgagttcgtcttgtgtcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctgatgttttgaattgaagttcagacggcatcgagcagcagcctgacgatgtatgcgtcctgcggctgcgtcagtttcaaattgcgcacgtcgccctgtatcagtagcggacgcacacccaatttttccacggcggacgcttcatcggtaatgccgtccaagttttccgcagccaatgcgcggtgcagcagcccggcgcggaaaagctgcggcgtttgcgcctgccaaaggctcgtccgctcgacggttgcactaatgttcccaccgtccgcgcacttgagcgtatcggcaatgggaattgccaaaatcccgccttcggcggcgttgcccgcctgttctatcaaccgcgtcaaagcttcagacggcaggcagcaacgcgcggcatcgtgtaccagaatattgtcggtttccgccgccaaaccggtttccaacagttttgccacaccgttgcggacggtttcggcgcgggtctgtccgccgtttttccacacccgaacctgtggaaatgccgtctgaaccttatcggcaaacgtgtcttcgggcgagacgacaacgacggtcaaatcgacggcctcatgccgttcaaaaatcccaatcgtatgttctaaaacggttttgcttccgatttcgacatattgcttgggtttgtccgcaccgaaacgcgccccgatgccggcggcgggaatcagcgcgatatttttgcgcttcatgcgtccgtcccgccgttttcagacggcacggcttccttgcgccagatacaggcttcgcccaagccgtccaaatattgcccgtgcgccgccaactcgttttcgtccgccctgatgactttcagtttgccgctgcgtttggtttcggtatgcaccacgggtttggtttccattttttcctctgcggccgcacccatcaggtcgaactgccgccgcgtcatagcaagatagacttcgcccaaaagttcgcagtcgatcaatgcgccgtgcaggacgcgcttgctgcggtcgacggaaaaacggttgcacaaggcatccaggctggctttctgcccggggaacatttcgcgcgccatcgccagggtatcggtaacggtacagccgagttcctcaacggtcggcaaccccatccggcggaactccatattgaggaagcccacgtcgaatttggcattgtggataatcagttccgcaccgcgcaggaaatcggcaatctgcctgccgacctctgcaaacggcggcgcgtttttcccttccaaaacctgtatcgtcaagccgtggacgcgtgccgcctcttcgggcatatcgcgctcggggtggacatagaggtgcaggtttttgtcggtcatttggcggttgaccatttccaaaccggcaaactcgaccaagcggtcgccgccgtcggcatacagaccggtggtttcggtatcgaggatgatttggcgtgtcgtcatatcggtgtctttcttctatcttcgtaaattgcttattttttaagcaatgtatttttctgttttcatttcaatgcacaaacccacttattcacagtgtgttcacaacattgggcaggcggattgtgtattttggggacaattttttcagacggcattcaaggttttttcctgattgccgccgcgcctaaaaaccgcctttcgcgcttaatcaaaaataccgacaacggaatattgcccaaagcgacaatcagatacaacaaggaaatgctgtcaaacaaaaacagcaacaccgcgctcaaaacggcagcggaaaccataaaaataccgttaacgatattgttggcggcaacggcgcgggcgcggaaagtctcgctactggcggtttgcagccaggtatagagcggaacggagaaaaatccgccgaaaaagccgatcagcgtcatcaccgccatcacgggatatgcccatccttgcgataaaaaccaaaaaatgccgttcagcccttcaaaacggtgtccgtgcgtcagccacaccaaaaccaagccgcaaaccgtcaaacccaacgcaccaaccgttacccaagccaacatcaggcgttccctgctgaacttggcacacagtaccgaaccggcggcaataccgatggaaaacagagcaagcatcaggttgaaaacattgtcgttgccgcccagatggatttgggtaaaggtcggcagttgcgtggtataaaccgcgccgacaaaccaaaaccacgaaataccgataatggcggtaaaaacgggcttgtgccgcaccgtttcacgcagcagggattttgtgccacggacaatattccactcaatttgtgtatcggcagccttggcgggtacggacggcataaacaggctgccgaccgtgcctccgacggcgaccagcaaaaccagtatcccgacaatataaggcggtacacctgccaccgccgttcccaaaatctgaccgaacaggatggcgacaaacgtacccgattcaatcaggctgttgcccatcatcaactctttgtcgtcgagataatcgggcaggatggcgtatttcagcggcccgaacagcgtcgattgcgcgcccatgcaaaacagacacgccaaaagcagcggggcagaccggatataaaacccgtatgccgccaccgccataatgatcatttccagcaccttgacccaacgcgccaaaacggccttgtcgaatttgttacccaactgccccgacagcgaggaaaacaggaaatacggcaaaataaacagcaacgcgcccaagttcaacatctgtccggcaggcaggaagccgttttgccccaaaccgtaaaacccaatcatcacaaacagcgcggttttgaacacattgtcgttgaacgcgccgagaaactgcgtagcgaaaagaggtgcgaaacggcggcttttaaccagtcccaaaccgccttttttagcgtacatcgttttccctctctttttcaatcagtttacttgtcgaatcatcatccatcaggatgcggtgcgccggcccttccaagtcgtcaaactgcccgtttttgcccgaccaccaaaaaaaccagccgatgacaaacgccaaaataatgctgatgggcaccaatataaacatgctttccatcacatattccctgtcaaatcgttcaaaacaaaagtctgccccgacacggtcagatattcgttacgcaaagttccgacgggagcttcgtcaaaaaacagctcgatacggtctttgaccacgcgccaatattgggggatttccgtctgaccgaacggcgacaggacatgattttccattccgccttcaagtttgacggcaaaacgcccgctttgcggccgtgcttccgattcgtcgtcggcaagcaggatgaaaaagcctatatgccgtcccgattggtcatgaatactgaaataatgcataaatttcccacccgccttttttcagacgacaccaactaaaaacagggcgaatgtaccagtttggacgggaagaatgcaaagaaattctccctcccccagccgaaaacaccggcaaaccgcatatcccccttttttccgtcaaaatgcctgacttccgccattttcacgcaaacgcccgattaagccaagcaattgcaaagattttttgctagaatagcctgcttcttttatcaaccttttcagacggccccactactttcccgcccaggaaggcaaaacggattcggcacgaatccggttagtatccgtgtccgattccaatgccgtctgaaactttccggagtaagaaaatgtcccaaaaattgatcttggttttgaactgcggcagctcgtccctcaaaggcgcggtcctggataacggcagcggcgaagtcctgctcagctgccttgccgaaaaactcaacctgcccgatgcctacatcacattcaaagtaaacggcgaaaaacacaaagtcgatctgtccgcacatcccgaccacaccggcgcggtcgaagccctgatggaagaactcaaagcccacggcctcgacagccgcatcggcgccatcggccaccgcgtcgtcagcggcggcgaactgtacagcgaatccatcctcgttgacgacgaagtcattgccggcatcgaaaaatgcatcccgctcgcccccctgcacaaccccgcccacctcttgggcctgcgtgccgcgcaaagcattttcaaaggcctgcccaacgtcgtcgtattcgatacctccttccaccaaaccatgcccgaagtcgcctacaaatacgccgttccgcaggagttgtatgaaaaatacggcctgcgccgttacggcgcgcacggtaccagctaccgcttcgtcgccgacgaaaccgcgcgcttcctcggcaaagacaaaaaagacctgcgtatggtcattgcccacttgggcaacggcgcgtccattaccgccgtcgccaacggcgaatcgcgcgacaccagtatgggcctgaccccgctggaagggctggtaatgggtacgcgcagcggcgacatcgatccttccgtattcggcttcctcgccgaaaacgccaatatgaccatcgcccaaatcactgaaatgctgaacaaaaaatccggtctgctcggcatttccggcctgtccaacgactgccgcaccattgaagaagaagccgccaaggggcataaaggcgcgaaattggccttggatatgtttatctaccgccttgccaaatacatcggcagtatggcggttgccgcaggcggtttggacgcactggtctttaccggcggcatcggcgaaaactccgacatcatccgcgaacgcgtgatcggctacttgggcttcctcggtctgaacatcgaccaagaagccaacctgaaagcccgcttcggcaacgccggcgtgattaccactgccgacagcaaagccgttgccgtggtcattccgaccaacgaagagctgatgattgcccacgacactgcccgtttgagcggtctgtaaggttttatccgcacacgaactgcctccggaaatggaggcagtttttttatccggctttccatgcttaaacagcactgcctcttttcagacattgacggttgcagccgcttacctgaaccttatagtggattaaatttaaatcagtacggcgttgcctcgccttgccgtactatctgtactgtctgcggcttcgtcgccttgtcctgatttaaatttaatccactataatgattaactattttttaatcatgttattattttccataaaatacatgacattaagatgtttttccacaaaagatacacacaccggcaaacaccggctgtgtttatcttttcttatgcctattttttaatcatcgtatttttatcttttaatttcaatacgcaaactaacttatacacacggttttcacatctttagactgcttccgtgtgtatagtggatattgccgttttcctttctgacaaaaatgccgtctgagaacttcagacggcatttgaaacatcggaatcagcggttttgttcataccactcgataaacttgtctgctttgacaaaacccagcagcggctcgctgcggctgccgtcggagcggacgacaaacacgcccggcggcccgaacagaccgtattctttcaacaacgcctgatgttcgggcgtgttggcggttacgtcgatttggaaaaagcgttccatatcgactgcctgatgcacttccggctgattgagcgtgtaagccgccatttctttgcaggaaatgcaccagtcggcataaaaatccaaaacgacgggtttgtcgggatgttctttcaacgccgtatccatcgctgccttcagcgcggcagtatcggcaaacattttgccgtgttccgaagatttgcctgcttcggctggtggattgagggtcaggaaatggtgcagcgcggtcgttttgccgtttgcgccctgccagccgaaccacgcgccgcctatcagcaatataccgcccaatgcgaatgccacagctttcggacggcgtttctgcctgcgtccgttgaccagcagcataaaggcaggaaccagcatcagcagcgtgtacagcgcgacgacgagataatagggcaagtgcggcgtggcgaggtaaacggcgacggctagcaggatgaagccgaatgcgtatttgacggcattcatccaatcgcctgccttaggcaggatatgcccgccgaacgtgccgatggcaatcagcggaacgccggtgcccaacgccaaagtgtaaagtgccaaaccgcctaaaaccgcatcgcccgtctgaccgatgtagcccaaagcaaatgccagcggcggggcgacgcacggcccgacaatcagcgcggacaatatgcccataataaagacggaaacgattttaccgcctgaaagcctgctgctttgattctgaaaatacgactgcacggcgttgggaagctggatgttgaacagcccgaacatagacagtgccaagacgaccattaaagccgatgccgccaataccacccaagcctgctgcaaccatacggtcagcagtgcgcccgtcagtccggcaacaatgccgaccagcgtataagtcagagccaaaccctgaacataaacgacggacagcacaaacgcccgcgccttgcccgcctttttgtcgccgaccacaatactggaaacaatcggcaacaggggatacatacaggcggtaaaactcaggcccaaaccagcgagaaaaaacgccaaaagattggcgttgagcgtatcccaagacagcttgaaacggctgtcgccgccctcatcccccttcgggggcggcagcgccccgctgccgttttgagaggaaggctgcaaaaagcggtctttggcggatgccggttcgtcggtttgcggatggtaagtgccgttgccgaaaatatcaaactcggtatccacgggcggatagcacacgccggcttcggcacagccctgataggtcaaaaccaatttatacggttcgccgacagcctttgcataaggaaaggcaacctgcgcctcgtgatggtaaaccgtctgcctgccgaaaaactcgtcttccttctcttcgcccttgctgaaagaaggctgtcccaacaaatccgccggatcggtcttgccgacgattttcgcctgatacatatagtatccgtcggcaatcctgaaacggacgttcacaccgtcgtcggcaacggcaagctccggcacgaatgccttttccggcggcagcagatcgttcgcatccagcgcgaaagctcgtccgcacaacatcaaaaatacggcgaacaggcaaatcagttttttcataatcgaatccgtttcagacaaataatttgtctgcattataaatggtaaggttgacggtgggatttaatttatgtaaaacccgccattatccgaacctatttccataaacatcttatcgaacccgccatgtacgatgtcaatacccacgatgtccgccgctttttcgcccgcgtgtggcagcagcggctcaatccgctgcaactgagcgcactggaacagaaagccctccgcattgtcgaagcccatcccgaataccaccgttatctcgaacgcatcgaagaccatctggacaccgactggctgcccgaaaacggcgaaagcaaccccttcctgcatatgtcgctgcatctgtccgtccaagaacaggcgggcatagaccagccgcacggcatacgcgcaatccacgacaccctgtgcgccaaacgcggctggctggaagccgaacacgaaatgatggaggcactggcggaaacactgtggacggcgcaacgctacggcaccggtttggatgtcaatttctacatgacccgactgcgcaaactcatcggcttgggtgcagaagatcaagccagattgaacccgcatgaaatcgcctgaccataccaaccgcctgcaaaatgccgtctgaagcggaacaacccctttcagacggcattcattttcccccaatcatttccacaacgcctttttcagcataatcaaccaatccttcttatccaaaacggggcgttgtgcaaacacatcgtatcggcacgcgtccagtttctgcaaaatcaactgcgcccccaacacaatcatacggagttccaaaccgatacgcccattcagttcccttgccaaaggcgaacccgccttcagcatacggaacgcacgccgacactcatacgccatcagccgctgaaacgccgcatccgcccgtcctgccgcgatctgttcctcagaaacaccgaatttcaacaaatcgtcctgcggaatataaaccctgcctttttgccaatccacagccacatcctgccaaaaattcaccagttgcaaagccgtacagatgccgtcgctttgcgccacgcacaccgcatccgttttcccgtacaaagccagcataatgcgtccgacagggttggcggaacgccgacaataatcggccagctcgccgaaatttccataccttgttttaaccacatcctgagaaaatgcagaaagcaaatcataaaacggctgcaaatccaaaccgaacggcacaaccgcctcggcatccaatcgtgcaatcaaaggatgcgccgaccggccgcccgatgccaacacgtccaactcgcgctgcaaaccctccaaccccgccaacctggcttcagacggcatactgccctcgtccgccatatcgtccgccgtccgtgcaaacgcgtacaccgcgtgaaccggcttcctcaacctgcgcggcaaaatcagcgaaccgacgggaaaattctcataatgcccaaccgacataccttctccatccatcaaacaaaatgccgtctgaaacggaacaaacccttttcagacggcatcagatacctccaagctgccggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaacacaaccgccgcgccggccgattaccgttaacctgttcataaactgtacagcacatatttcaatgtaaatctttgttattttattgcggtgtaacttttttacaacattcttaaaaccattccgacctgtctgccgactttcccaatccgccttaataaatcatacaagatactgaaattatattaatctctataatatttatccctatcgaatttttaacagcaaaaccgttttacaggatttatcaatccgcccgccagaaaacttttcattcaaacctttttcccatctgtacgacattgcaatcccttattccatagtgcataattacgcaaattcagcgatgaatttccaacccggtttgtagtatggtcgataaagacctatttgtttcaataatttaaattggttctaaaggttactaaaatgaaaaaatccctgtttgccgctgctttgttgtctttggttctggcagcctgcggcggtgaaaaagccgctgaagctcccgctgctgaagcacctgccgccgaagctcccgctactgaagcacctgccgccgaagctcccgctgctgaagcacctgccgccgaagctcctgctgctgaagctgccgctaccgaagcacctgccgctgaagctgccgctaccgaagcacctgccgctgaagctgccgctaccgaagcacctgccgctgaagctcctgctgccgaagctgcaaaataagcattttccgcttgcaaaaaagcaggatacgttcagtatcctgcttttttgatttttcagacggcatcagattcccttcctcaatcttctccctacccttccgacaaacatgcttgaccttcataccgaattttcccgactcctaccggcagatgaaattgccgaaccttctccgacgcttttaaaagaccagcgcaaccgctttacgtctgcaccagacatcattttgcagccgctcagcgttaaaagcgtgcaaaccattatgcgtttctgccaccaacaccgtattccggttacgccgcaaggcggcaatactggtttgtgcggcgcggcagtatcggaaaacggcgtattgctgaacctttccaaactcaaccgcatccgcagcatcaatttgtcagacaactgcataaccgtcgaagcaggttccgtactccaaaccgtccaacaggcagccgaagcctcaaacaggctgttcccactcagtctcgccagcgaaggctcgtgccaaatcggcggcaacatcgcctgcaatgccggaggtttgaacgtattgcgttacggcacgatgcgcgacctggttatcggtttggaagtcgtcctccccaacggcgaactggtttcccatctccatcccctgcataaaaacaccaccggctacgacctgcgccatctgtttatcggtagcgaaggtacattgggcattatcactgccgccacgctcaagctgtttgccaaccccttagacaaagcaaccgcatgggtcggcatacccgacatcgaatccgccgtccgcctgctgaccgaaacccaagcacactttgccgaacgcctatgcagttttgagctgatcggccgttttgccgccgaattgtcttccgaattcagcaaactccccctgccgacacattcagaatggcatattttacttgagttgaccgactcattacccgacagcaatcttgatgatcggcttgtcgaatttctttataaaaaaggctttaccgacagcgtgttggcgcaaagcgaacaagaacgtatccatatgtgggcgttgcgcgaaaacatctccgcatcgcaacgcaaactgggcaccagcatcaaacacgatattgccgttcctatcgggcgcgttgccgactttgtccgccggtgcgccaaagatttggaacagaatttcaaaggcatacaaatcgtctgcttcggacatctgggcgacggcagcctgcactacaatactttcctgcccgaaatcctcagcaatgaagtctatcgttacgaaaacgacatcaacagcacagtctatcgcaacgtccttgcctgcaacggcacgattgccgccgaacacggcataggtatcatcaaaaaacagtggctggacaaagtacgcacgcctgccgaaatcgccctgatgaaaagcatcaaacaacaccttgatccatataacattatgaatccgggcaaactgcttccgtaaccggcatttctgatttgcatacacaacaaagaaagggacaatagatccgattgtcggtttagcgcgagctcgtgagtgcggttaaaaattggtggaaattacacgaaaaatgaccgcacttttaaaataaaaaaatcggcagtgaatttccctgccgattttattttgttacaacttaacttaaaacgtccactgtaaattcaacgcaccttgtttagcttgatgatgtttgcctgtttggcggttgaatgtggcttgtaaggttaagtgagatttgattttcactgctacacctaattggctctcaattgccgtcttattgtttatcactcgacgctctccgtccatttccacaccgaaaggtttgttgtggtaaagcgcgttcacagcggcgaaaggttcaatagcgatatttttatagagtgaaaattgagctttagcttgaacgccaacccgagtttgtaattggcgggagccaagtaaattcacgtgggcattttcgctatcgctgaattttccgtttacccccaaataagtcaattgtgcctgtggttgtaggtaaacacgaaggctgttgccctttttagtgaagtgttccgccaataacgcattgtaacctgcttcaattgaggcagtaataccttttgaagtaaaacgttctgtaccatcttcagtgttgatacggtggcggaagcgttgatattgcatccagctatccgcatacgcacctgtctgtttgtcctgaagttggtgccaagtggcgtaaacgcctgcaccaaagcctttcacatttcccgttgtaagattgtctgtatctgggttgtggaaagtgctacgttgttctgcttgtccgcccattaagccaatagaaagttgattactttcgttttgccatgtgaatacttcgccgccgagttgcacacctttacgatagccttctacaggtgctgttttgccttgcacccattggttggaatgtccgtcaatcacacgcaaccacaagcctttgcgtggtaaagtgcggtcgaaaatatcgctgtttttgttgttcaaacgcaaggcgaataaggtattggcggcttgagcctgttgtgcataaatcgccatatcatcgcgttcttgcactttggtaaaaaagccctctgggcgttgttgtaaagaaagcgtataaattcccttttggtgtttgccagaaagacggaatgcgtgtttatctgctgtgccatttactttgataatttgatgcccatcgaggctttttaaatcgtctattggattttcgaagatgatgtcggaagtgccagtaacatttttctcaaaaattaatgcagtatttttcgcttctttaggatcgtaagcaaaacgaaaacgagctccgccagcataatcttcttttacgagtaaactttcacttttagtattaaaacggatgtctgcattcgttgtttttaatttcccaacattagaatcccaacggggctcccagagagaattttctaagcggaattcatccaaactaatcgtttgcccgataacgtgcgagttgtctgtaacctcaatatagtggaatggatctaaaccagaatatagatgtgctgcaaaagaaacataattttcaatatgatgaattacttgattagcccattctgtataattcccgacagataaaatttcgctgttgatatgactattttttatttttggacctaaggagaatatatgactttttactataagaggatgggatccaaatttttcagcttggcaagtactataatcacgtatcttagtgttagaattaaaacattccttaaaatatttccgtatttgttcttctgtgtccccatttctttttgcaacccctaaacctcgggcgaagccaactaggtaaccttcggtatattcttgatcataaaaagaaatcttttttgagttattgatgttttcgaattggtatgttctagggtatagtgcgggaaagggtggaacttttggattatcctcggttataagataagtttcttttttccaatattcactcgttttatcgcggagtttttttaagcgggtaatttcatcattagtgagcttggttttgtcgtaaacgtaatcaacagccaaaagcggagaggtataaagaatagaaaaaaatagacttacaataaatgattttttaaacttctgcttgcttgcttgcttgcttcgagtttcataataaattttcctttgtcaagtaaaaataaatggggcgtggattttagcataaaactgaacaaaaaatgtcatttatctcacatttttctctatttatttcttgtttattaaaagtaaacgtttgctttttgctattttgtcaagccagtttgaaaatgtgtataattgccctcgttatttacaaaaatttcaggaaaaatgaccgcactttacccttggctaatgccaatttatcatcaaattgctcaaacctttgacgaaagcttggggcatcatgccgtgctgattaaagcggatgctggtttaggtgtagaacgtttacacatcaggcggcagccttgcccataccgtctgaagcactgtttccacaatcagcgcgtatgcttaatcaaccgctgtttctcgcgtttccaatccgcctctttcatactctggcgtttgtcgtgctgtttcttaccttttgccaaaccgatttccatcttgatttttccgcgtgaaaaatgcaaatccagcggcacgatggtgtagccggcacgttcggttttgccgattaatttgttgatttccgactggttcaacaagagcttgcgcggacgtacggcatctggtttaatgtgtgtcgaggctgtgggcaaagccgtaatatggcagccgaccagataaaacgcgtcttttttccaatagatataactctctttaagctgtacgcgcgcggcgcggattgctttgacttcccagccttccaagaccaaaccggcttcaatccggtcttcaatgaaaaaatcgtgaaatgcttttttattgttcgcaatagccataaacatcctatcaatatccgccgtcagacggcataaacccgaaaacagaacccatcataccgcctcttcaaccgcctgcacaatcttctcgggatacagcctgttgaggcagtcggtatgccccagcggacattcccgcttaaaacacggcgaacattccaagtgcaggctgacgattttcgccctatcgctcaaaggcggcgtatgcgtcgggctggaagaaccgtaaaccgccaccaccttcctgcccaaagctgccgccaaatgcatcaatccgctgtcgttacacacgaccgtgtccgccaacgacagcaaatccattgcctgcgacaaatcggttttgccgcacaaattgacacacataccgtctgaaaggcggttgatttcctcggcaatttcatcatctttttgcgaaccgaacagccaaacctgccaacccgccgccagataatgtttgcccaactcggcaaaatgccttgtcggccaacgctttgccggcccgaattccgcacccggacaaaaagccagaacaggctttccaatatccaagccaaaggtttcgacagaaatttcccgccgccgttcatcaatggaaaactcggggaatcccgaatgcccgtcaaaatcttcctgactcggatgcgcgagagccgtatatcgatccaccatcaaaggcagacgttccttatccagcctgcgtatatcgttcaacagaaaataacggctttcaccgacataacccgtccttttaccgatacctgtcgccagcgcgatgattgccgatttcaaagaaccgggcaacacgataacctgatcgtatccgcgccgccccaaatccctaccgacccgccaacggcgtttcaactccaacgcaccatgtccgaacgaattctcaagaatttcattcacttccggcatacgctcgaacaccgccatcgaccacttcggtgcgaacacatcaatcgtgcaaccggggtgaagttccttcaaacggcggaacaagggctgggtcatcacgcagtcgcctatccaactgggggaaataatcaggattttgatggacataacaagaaaccgaaatcagacaggcagaattttaccgcgaaaccgttggaaaacctatcttgccgcattccgaacgccggacgtgcaaatatgaaaaagcccgaacattcaagttcgggcttcaaaattctggctccccgacctgggctcgaaccagggacctgcggattaacagtccgtcgctctaccgactgagctatcggggaatggggcgtattatagcgtc

SEQ ID NO: 3 - DNA, 23533 bp, Neisseria meningitidis
gcgggggcttccatcgcagtcatgcacaacatctgcatcaaatggttttgcaccatatcgcgcaacgcgccggtaatgtcgtaaaactcaccgcgctcttccacaccgagctgttcggcgatggtcaactgcacgctttcgatatatttattgttccacagcggctcgaacattacattggcaaaacgcagcgcaagcaggttttgcaggctttctttgccaaggtagtggtcgatgcggtaaatttgcccttctttgaaataacgcgcaacatcggtattgatttgctgggaagaagccaaatccgtacccaacggtttttccaaaactacgcgcacattgtcggcattcaaaccgatcgcagcaaggttttcacaggcttgcgcgaagaatttgggcgcggtggacagatagatgacgacgttgtcggtttctttgcgcgctttgaccaaatcgcccaaagcggcaaaatcgtccggctgcgtaacatcgactttgagatatgcgaaacgttcgacaaacgatgcccaagcctcatcggaaaaattttctttcacatggattttggaactggtttccaccttcgccagaaaaccttcggtatccaactcgctgcggctgacccccaaaatacgcccttcgggatgaagcagaccggcaacatgcgcctggtacagacagggcaacagcttgcgcatcgccaaatcgccggtcgcaccgaacaacaccaaatcaaaatttgtttgtgtactcatcgtattatctcgtcaggaaagaatttttcgatgccgtctgaaacctgtttcccccatcacgctgcatcgcaatatcggaaacaaaggcaggcggcataatgagtagtaatactacacaccgctacactttttgtctattcccatttttacaatttatttgacctagtccaaaaatcgggcaggtttcccctattccgttacaacaatcgaaagattctgcgatttaaatcaaatttcttttcaatgcctgatttttttgtaacaaaattacaaattttgtactataataacacccgcttcccactttcagacggcataccttttaaaatatagtggattaacaaaaatcaggacaaggcgacgaagccgcagacagtacagataatacggaaccgattcacttggtgcttcagcaccttagagaatcgttctctttgagctaaggcgaggcaacgccgtactggtttttgttaatccactatacttaccgtctgaatacccgatacaaaaatcagaaacgcacaaacaaatccccaataccccccccgttccgacaggagaccgaccgtgaacactactcctatccactccaaactcgccgaaatcaccgggcgcattattgaacgcagccgtccgacgcgtgaaaaatatctggcgaagatccgcagtgccaaacaaatgggacgcttagagcgcaaccagctcggctgcagcaacttggcacacggctatgctgccatgcctaaaagtatcaaaatcgaaatgcttcaggaaaccgtccccaacttaggcatcatcaccgcctacaacgacatggtttccgcacaccagccgtttaaagacttccctgaccaaatcaaagacgaagcgcagaaaaacggcgcgaccgcccaagtcgccggcggcacgcccgccatgtgcgacggcatcacgcaaggctacgccggcatggaattgtcgctgttctcccgcgacgtgattgccatgagtaccgccatcgggctgtcgcatcaaatgtttgacggcagcctgtttatgggcgtatgcgacaaaatcgttccaggtttgatgataggcgcgctttcgttcggtcatattccgggtatcttcgtccccgcaggcccgatgtccagcggtatcggcaacaaagaaaaagcccgcacccgccagcttttcgccgaaggcaaggtcggacgcaacgaacttttgaaaagcgaaatgggttcttaccacagcccgggcacctgcactttctacggcacggcaaactccaaccaaatgatgatggaaatgatgggcgtgcacctgcctgccgccgccttcgtccacccttacaccgacctgcgcgaagcgctgacccgctacgccgccggacacctcgcgcgcggcatcaaaaacggcacgattaaacctttgggcgaaatgttgaccgaaaaatcctttatcaacgccttgattggcctgatggcaaccggcggttcgaccaaccacaccatgcacctcgtcgctatggcgcgtgcggccggcgtgattttgaactgggacgacttcgacgaaatttcctccatcatcccgctgctcatccgcgtttatccgaacggcaaggccgacgtgaatcactttaccgcagcgggcggactgcctttcgttatccgcgaattgctgaatgcaggcctgttgcacgacgatgtcgataccgtcgtcggacacggtatgcgccactacaccaaagagcctttccttatcgacggcaaactcgaatggcgcgaagcccccgaaaccagcggcaacgacgacatcctgcgcaaagctgacaacccgttctcccccgacggcggtctgcgcctgatgaaaggcaacatcggacgcggcgtgattaaagtgtccgccgtgcgcgaaggctgccgcattattgaagcgcctgccatcgtgttcaacgaccaacgcgaagtgttggctgcgtttgaacgcggcgagttggaacgcgattttgtgtgcgtcgtccgctaccaaggcccgcgtgccaacggtatgcccgaattgcacaaactgaccccgcctttgggcatcctgcaagaccgcggcttcaaagtggcgctgctgaccgacggccgtatgtccggcgcgtccggcaaagttccagcctccatccacatgacacccgaagccctgatgggcggcaacatcgccaaaatccgtaccggcgacctgatccgcttcgactccgttagcggcgaactcaacgtcctgattaacgaaaccgaatggaatgcccgcgaagtcgaaagcatcgacttgggcgcgaaccaacaaggctgcggccgcgaactcttcgccaacttccgcagcatgaccagcagcgcggaaaccggtgccatgagtttcggcggcgaatttgcctgatgcgcgtttcagacggccttttcagaccgaaggccgtctgaaaaattattcaagcgttttaagatagacgtaggttggattctcgaatccgacacagccgtccaagatgtcggtttcttgaatccgacctacaacctgtcccatcttaataaaataccccattccacccggagaaccgaaatgtccaaactgaccccccgcgaaattttgaccgccggcgcagttgtgccggtaatggcgattgacgacttaagcaccgccatcgatttgtcccacgcccttgtcgaaggcggcatccctaccctcgaaatcaccctgcgcacccctgtcggcctcgatgccatccgcctgattgccaaagaagtgcccaacgccatcgtcggcgcaggtacggtaaccaatcccgaacagctcaaagccgtcgaagacgcaggcgcggttttcgccatcagcccggggctgcatgaatccctcgccaaagccggccacaacagcggcatccccctgattcccggtgttgccaccccgggcgaaatccaactggctttggaacacggcatcgacaccctcaaactcttccccgccgaagtcgtcggcggcaaagccatgctcaaagccctgtacggcccttacgccgatgttcgcttctgcccgacaggcggcatcagcctcgccaccgcgcccgagtacttggcactgcccaacgtcctgtgcgtcggcggctcttggctgacaccgaaagaagccgtgaaaaacaaagactgggacaccatcacccgcctcgccaaagaagcggcggcgttgaaacccaaagcctgattcgcatcgtaaaaatgccgtctgaaaaacctttcccgtttcagacggcattttgccgattgagggcacagtcggcatacacggcagcactgatcagacataccgcccctaaaatgcccatccgccttccgcataataaaaataacgttcagttcattcgacagcagccggacagcccatactacgcggctgaaaaaatgccgtctgaaacgcattcagacggcatccacttaaaaaaaacaactgattcaacgccgattaatccgcttccaaaaccactttcatcacttggttttcggcggcgtgtttgaacacgtcgtaggctttttccaattcactgaatttgaaatgatgggtcagcattttggtgtaatcgacggagctgctggaaatcgccttcatcagcatttcggtggtattggcgtttaccagaccggtagtgatggcaagctttttaatccagagtttttccagtttgaaatcaacggattgaccatgtacaccaaccacagcgatatggccgccgggtttcacaatgtcttggcacatattccatgtagcagggataccgacggcttcgatggcgcaatccacgccgtcttcgccgacgatggcaaagacttgtttggatacttcgccggaagcagggttaatggtatgggtcgcacccaattctttcgccagtttcaaacggttttcgtccatatcgcaaacgatgatggcggcgggactgtacagttgggcggtcaacagggcggacataccgacagggcctgccccagcgatgaatacggtgtcgccgggtttgacatcgccgtattgcacgccgatttcgtgggcggtcggcaaagcgtcgctcaacaacagggcgatttcttcgttgacattatcgggcagcggaacgaggctgttgtcggcataaggcgtacggacgtattcggcctgagtaccgtcaatcatgtaacccaaaatccaaccgccgttacggcagtgtgaatagagttgggttttgcagttgtcgcaagtgcaacatttgctgacgcatgaaataatgactttatcgccgactttgatgttttttacagcctcgccgacttcttctacaataccgatgccctcatgaccgagaatacggccgtcggcaacttcggggtttttgcctttccaaatacccaaatcggtaccgcaaatcgtggttttgacgattttcaccaccgcatcggtcggatcgataatctgcggacggggtttttcttcaaaacggatgtcgtttgcgccgtgataaaccattgctttcatgctgatactccttgcttgttgataaataatttcaataccgcaataaagtttctttatatgagttatatgcccctacaaaaaataagtcaataagaattattttcacaatgttatacaataacataccgttttaaatataaataaaaccaccgattgatattaatgaacacacccatccccttctccgaacggctcatccgctggcaaaaacaacacggtcgccaccacctcccttggcaggtcaaaaacccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgcgtactctgccgcgtgttcgcccgcgacggcaatccgcaggacaaaaaatttgaaaactcgctctggacacttgccgaaagcctgctgccgtctgaaaacgccgatatgcctgcctatacacaaggtttgatggatttgggcgcgaccgtgtgcaaacggacgaaacccttgtgccaccaatgcccgatggcggacatctgcgaagcgaaaaagcaaaaccgcaccgccgagctgccgcgcaaaaaaaccgccgccgaagtaccgaccctgccgctttactggctgattgtccgcaaccgggacggcgcgattttgctggaaaaacgccccgccaaaggcatttggggcgggctgtattgcgtgccgtgttttgaaagtttgaacgggctttccgactttgccgccaaattctccctgaccatggcagatatggacgaacaaaccgccctgacccaccgcctgacgcaccggctgctattgattacgccctttgaagcacaaatgccgtctgaaagcccttcagacggcatttggataaagccggcgcatttgaaagattacggtttgcccaagcctttggaaatttatttaaacggtaataggttagaataaacaaaataaacccattgaactgttgtttgcaggtatcgcagcaagaacaaccgatgaatttgggtcgtattttaggcggcgggataatgttcaaatgggacatttggaacggaagaagtcggcaatttaaaaaggatttaaaaagcaaagaaggtcaaaaacatgaacacaaacttaaatgacaaagacaaagccatggataccgcaatcaggtttcagaaaaggatgaggattccgaaatttttctttttaattctcggaatcacaatggttttggcatttatccaagacgtgataacgggttctaattttctgcaaataacaattaatgtaaaattttcgtaaaaatttatcggcttttaaaacaaaattgactaaaatagtcgcgagtttttactgcaataaaggagattgcaatgaatatgaaaaccttattagcactagcggttagtgcagtatgttcagttggtgttgcgcaagcacacgagcataatacgatacctaaaggtgcttctattgaagtgaaagtgcaacaacttgatccagtaaacggtaacaaagatgtgggtacagtgactattactgaatctaactatggtcttgtgtttacccctgatttacaaggattaagcgaaggcttacatggtttccacatccatgaaaacccaagctgtgagccaaaagaaaaagaaggtaaattgacagctggtttaggcgcaggcggtcactgggatcctaaaggtgcaaaacaacatggttacccatggcaagatgatgcacacttaggtgatttacctgcattaactgtattgcatgatggcacagcaacaaatcctgttttagcaccacgtcttaaacatttagatgatgttcgcggtcactctattatgatccacacgggtggtgataatcactccgatcatccagctccacttggcggtggcggcccacgtatggcatgtggcgtgattaaataattcgattgttcgaaacgaaaagtgcggtgaattttgaccgcacttttttgctagatatttagcattgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtttcaattcataagtttcccgaaattccaacataaccgaaacctgacaataaccgtagcaactgaaccgtcattcccgcgaaagcgggaatctagaccttagaacaacagcaatattcaaagattatctgaaagtccgagattctagattcccgctttcgcgggaatgacgaaaagagacctttgcaaaattccttttccccgacagccgaaaccccaacacaggttttcggctgttttcgccccaaataccgcctaattctacccaaatatccccttaatcctccccggatacccgataatcaggcatccgtgctgccttttaggcggcagcgggcgcacttagcctgttggcggctttcaacaggttcaaacacatcgccttcaggtggctttgcgcactcactttaaccagtccgaaataggctgcccgggcgtagcggaatttacggtgcagcgtaccgaagctctgttcaaccacataacgggtcttcgacaaatatcggttgcgtttggtttgcacttccgtcagcggacggttgcggtgggctttgcgcataatgccgtccagcaactgatgttcttccagatgttgccggttttccgcactgtcgtagcctttgtcggcatagacggtcgtacctttgggcagtccttccaacaacggcgacaggtgtttgcactcatgggcattggcgggggtaatgtgcagtttctcgatatagccttctgcatcggtacgggtatgttgtttgtaaccgagtttgtagaggccgtttttctttatccaacgggcatcgctgtccttactcggtgtggtttgaccgctgatttgtccttcttcgtcaacttctatggcctgacgctgtttgctgccggcggtctgaataatggtggcgtcaacgacggcagcggatgctttctctatttttaaacctttttcggtcagttggcggttaatcagttccaacagttcagacagggtattgtcttgcgccagccggttgcggtagcggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcttgagaaatcccctaaatgtcttggtgggaatttaggggattttggggaattttgcaaaggtctctagatgagtgaaaaagaagtgcaggctgcctaaaaagacagaaaaagtctttccggcagcctgcactttggtttcatttcagtcagtaaacccagtaaacgacggtctgaaaacgcagaacgttacgaaaaaagcagcctacacgcccatcccccgccttctacccgttctgtaaatcatacagatagcggtaatatccgttcggcttcgccagcaattcctgctgtgttcccgcttccacaatcctgcctttatccatggcaatgatccggtgtgccgttttaacagtggacagacggtgggcgataatcagcaccgtccggttggcgcaaatggcctgcatgttctgcataatcgctcgttcactttcataatccagcgcgctggtggcttcatcaaaaatcagaatgcgcggattggtgattaacgcgcgggcaatcgcaatacgctgccgctgtccgcccgacaagccggccccttgttcgcccaccacggtgccgtagccttccggcagctccataataaactcgtgtgcgcccgccagtttggctgcttcgataatgcgttccagcggcatacccgtatccgtcagcgcgatattgtcgcgtatgctgcggttgagcagcacattctcctgcaagaccacgccgacctgccgccgcagccaggcaggagcggccaaagccaaatcgttgccgtccaccaacacccgtccctgctccggtacatacagacgctgcaccaatttggtgagtgtggatttgcccgaccccgaacgtcccacaatccccagcacttcccccgcccgaatccgcaggttcaaatcctgcaaaatcagcctgccgtccgccttatagcggaaatcgacatgttcgaacgtaatctccccccggatatcgggcaaagccaaatgcgaagacgcattctcggtcggcgcattcagaatatcccccaaacgcgccaccgaaatccccacctgctggaaatcctgccacaactgcgccaaacggataacaggcgccgccacctgtcccgagagcatattaaacgcaatcagctgccccaccgtcagcttgctctcaattaccagccgtgcgccaatccacaacgtcgccaccgtcaccagcttctgaatcagctgcaccccctgctggccgaccaccgccaacttcgttacccgaaatcccgaagccacataagccgccaactgattgtcccaacgctgcgtcatctgcggctccaccgccatcgcctttaccgtacccaccgcagtgatgctttctactaaaaacgactggttgtctgcattgcgcgcgaacttatcgttcagacgcgtccgcagtatcggactgataaatgccgaccaaaacgcataggcaggcaacgaagccaataccacccaagtcagagtggagctgtaataccacatcaccgccagaaagataaacgaaaacgccaaatccaacaccgaagtcagcgcctgaccggtcaagaaattgcgaatctgctccaattcccgcacccgagccaccgtatcacccactcgtctgtgctcgaaataggataaaggcagggaaagcagatgccggaacaaacgcgcgcccaattccacatcaatacgtgaagtcgtatgtgcaaacagatacgtccgcaaaccgcccaacacaatctcaaacagcgacaccaccaacaaagccaccgacaccacatccaaagtagagaatccccgatgtaccagcaccttgtccatcaccacttggaaaaacagaggcgtaatcagcgcaaacagctgcaacaccaccgacaccaccaatacttcaaaaaacaaccggcggtatttgattaccgccggaataaaccaggtaaagtcaaactttgccaaactgcccaataccgaagcgcgggaagcaaccaatatcagtttgcccgaatatctgttagaaaattcggcaaaagacaataccgcagacttattcgtaaccaaatcctgtatcaaaaattgggcatgctcaccctcaccgtctgttttggccaaaatgaaatggttgccgtcatcacaccataccaatgcgggtaaagtcgccatagccaaacgtttaataggctggcggactacctttgccttcaatcccaaagatttggcggctaacagccattgcgtttcatttaaatcgctctgtgcggaagtacaaaattcatgctgtatatcggcaggattggcggcaatgccgtggtaatgggcgaggatgatgagggcggaaagggcggggagcggtgcggatacgatagacataaataaaatatagttagattggatgtggataacggctggctggaaaaggaatatattaagtagaaagaaatatataaataaaacagcagaacgcattgtaaggatatatatgggaattgtaaagagaaagtatggaaaagttctcgtttcaggaaggtaaaacggcttaggaatcgagttagatgaggatgcctcgcacctctcgtgcctcctgcataccgttaaggcacagggttaaggtgcaggctgctccgaactctgttgcggtcgggtaatgttattttttgtgtttcaggcagcctgaaatatctgtatatttttgttttaaatagattttaaagattgataactgttcttgacgatttttcaagaaaggagtaaatttcaagaaaggagtaaagtgacttattatcaatgacaagcaacgcgcgaagtgacaaggaaaactatctacttaaattctaaggaggcttcgaatatcataaaccaatcagaaacatagagataaaaattatgtacaaatataatcctcttatacaatttattgcacagttgattatgtcttatggagcaagcgtagggtgggcacttgctgccccacgcgtttcatatttcaaggcagcctgaaaccgtgtgggcataaatgcctaccctacatcccaaaaaacaagcgcagcctgcgtgtgtagggtgcgaactttcggcaggtagacacgcagttttatattttcaagctgagggatgcttaagaaaagtacaaaacattaaaaaataaggggctgtactagattagccctaaatccacaccaatcccgcaagatttttagctgtcgggacggtgtgccgaagttaaatcgaaattcgcattctttcaagaacagcgggaaagatttgcgatcaattccgttctatttgcgcaagacgcgttttgcctgattccaaaagttctcaatgccgtttatgtggttctgacggtcagcaaattccttggaatggttgatgcggtaatggataaaaccgcttacgtccaacttgtcgtaactgctcaggctgtcggtataaacaatgctgtccggcatgattttctgtttgataacaggcattaaagtatcggacttggcattatctacgacaacggtatagacccgtccgttacgtttcagaatgccgaagacaaccacttttcctgccgcaccgcgaccacgtttgcctttacgccgtccgccgaaatagctttcgtccaactcgacagagccctcgaaaacctcattggcagccaaggccagataatggctgatgaccatacggattttgcggtagaacaggactgccgaattgggatggatacccaaaatatcggcagcagaacgggcggtaacttcgagtacaaaaaaacggagcagctctttctgtacttttttctttaatttgcagtgtgttatcttcatatttcgggggtaacatatctgctaatctagtacagcctcaaacaaaaaagagaaattttaatttcgctaaatcgcataaagattaatcaagagtatcattaaatgatatgagtgagcatctataatgccaagaagagttgttaagacataacgattattgaaatagattgtaaaatagatacttagatagtctgaaaaacggatttgtgaaactttttattacgcgccatcatttgaaaatgaaacttaaaaaacacttatcataataaatattttctttacgttgtttgctaataaactcagtgcaatatcagcgcaatattttatggaaattttatggataacaaaaaagaatttattaataatttaacaaataggtatatgtggatctatccattggtcttaaatattctatttctacctttttaccagtcctaccaatctttttttattgcgcttggttgtttgtttgcactggttagaaaaatgcaaagcttagattttaaattacaaaatcatattgtattgttaaatataaaaagtgcttgggcagataaaaaagtatttttgattaggatagtagtgtcatggttggcagtaatggaaatatggatgtgttttatttcggaatcatcaacgtgggtatgcggtgctttttgtttaaatagtgaaatattggaaaaaatttttcgtggctttggttattctggtagtttatattttttatttatattgatgattgatctcaataagttaagagagagtatttgaatttcattttttgtttgacttaaactcaaggagagtaacaatgattggtagtggtgatactaaacaatgcaaaaaattttctgcgtgtgatggaaaataccacgtctacgatcccctcgccctagacttggacggcgacggcatagaaacagtcaccgccaaaggcttttcaggcagcctgaagactgagagagtgaatacgatgagtatacactctatgccactaaattgatattcactaaatcataccagctatattttatttaatgagacatatgaaaaataaaaattatttactagtatttatagttttacatatagccttgatagtaattaatatagtgtttggttattttgtttttctatttgatttttttgcgtttttgttttttgcaaacgtctttcttgctgtaaatttattatttttagaaaaaaacataaaaaacaaattattgtttttattgccgatttctattattatatggatggtaattcatattagtatgataaatataaaattttataaatttgagcatcaaataaaggaacaaaatatatcctcgattactggggtgataaaaccacatgatagttataattatgtttatgactcaaatggatatgctaaattaaaagataatcatagatatggtagggtaattagagaaacaccttatattgatgtagttgcatctgatgttaaaaataaatccataagattaagcttggtttgtggtattcattcatatgctccatgtgccaattttataaaatttgcaaaaaaacctgttaaaatttatttttataatcaacctcaaggagattttatagataatgtaatatttgaaattaatgatggaaacaaaagtttgtacttgttagataagtataaaacattttttcttattgaaaacagtgtttgtatcgtattaattattttatatttaaaatttaatttgcttttatataggacttacttcaatgagttggaatagttttggtaattttatgagcgcacgctcatccgcgttagcagaatttggaaatatggttgctaatttagtttctgcaaaaaatgagaaagatatctcgaaacgtaatgaatattacaaacaagctggttatagtgcattattagcatttggtaatttggctagtaatattgcaccaggtagtacgtcatcgcatattgtaaacggaacaaatgcctctgtgattgcaagccgtctctctggaaatatatcttcagctattcaggagcataaagatggtaaagttaatatcaaccgttttcaaaatattttagcggatttatattcattgggagggttaggaagtacattaatagagaagaatggaaatatgcagagttgggggattccattagcaattgctggagatataattgcagcaacggctattgccacaggagatactggtacgatatctacagaggaattttataattttgacaactggaaaggttttgggtatgagctatttgaagactggtctcgttgggtatacgactggctgcccgacggctggaatctgtggaaagaattggacagaaaccgttcaggccaataccacatctacgaccccctcgccctagacctagacggcgacggcatagaaacagtcgccgccaaaggcttttcaggcagcctcttcgaccataacggcaacggcatccgcaccgccactggctgggtttctgccgatgacggtttactcgtccgcgatttgaacggcaacggcatcatcgacaacggcgcggaactcttcggcgacaacaccaaactggcagacggttcttttgccaaacacggctatgcagctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcacgaacaaaatgctatccattagccatgttcgggaaaacacgatttccccgtttgttttaggctgtctaaacaaataaccataaatgtatatcattatttaaaataaataaaagtatttaactattattgacgaaattttagagaaagagtagactgtcgattaaatgacaaacaatagtgagaaaggaaatatttactatccgagcacagagcatattttaggtagcctgtaactgttcctgctggcggaagaggatgaaggttgacttacccgagaataaatgtcctgttgtgtgatatggatgccatgccgcgaagcaattgatgcaatcacggcagtcctacttgaatgaaacctgtcgttgcagaatttgaaaacgctatttttaagaaaggataaagggagaaagaatttttggtttttaagctgcatgaaaccgtgttggaataaatgcacacctacgataattaataattttcgttttttattctacaagctatttatatatgattgctaaaagtttattttttagatgccaaaaaatatattttatatacttcatattgtttatatgtctttatttgaatatatcttacgatggggaaatatttatatattttataataaattttactcatttgctaatatgtcatggaatattacttgtattttgtagaatttttccatatgaaaatattccatttactatttttctgaactttattagtttatttttaatatttttacctcttatatttaccataagagagctaattgattcatattatattgagtcgataattaatttattcttaattttaattcctcacgttatttttttaatttacttgaaaggaaagcagatatgacatctgcaaattttaatattaacggttttggagatgtgaaattaacaccctattcaccactcttgggatataaagcttgggattcatttattggttctattcaatccttatctgatttaatctataatgtggataacaatagaaataaaatggaaattactgttaataatgctattcaagctgcagatagctttttaagcagtaattggaagagataacaaaataacaaaataacaaaataacaaatactgcttctttacttgcatccttcgataacattttttaaatttaagaaatgtatctcgagatatacgagaaacaggaaaatttaaacctaatgatattcaacaagcaattggtgatatattcattgctgctggtgatggattacaatatataaaacaacaaacagaggcgatggctcaaagcaaattcttaccaactaaattaaaaactggtttaaatgatgtccttaattctagaatgctaaaatcctctactgttttacagcatgaattgaattaaataaggattatggaaacgagaggcttggcgaatctataatgaatatagatgattttacaccaagtaagatagcaaacttttttgcggatcctgatacatacagcaatgtattagaagaagtatctaggtttatatattccttagttcctgatgatgcaaacccttggaaagggggcgaagattatattggacgagggataagtgaatggggagagttactggaaaaatggtataaacaagattttctcccttatcttgaaaagaatgggaccaatttccgaaatttgaagattggctgcctgaattccctgaatgggcaagagagtggttgaaattagctctcaaacgttcaggcaaatataacgtttacgatcccctcgccctagatttggacggcgacggtatagaaaccgttgccaccaaaggcttttcaggcagcttatttgatcacaccaacaacggcatccgcaccgccacgggctggattgctgcatatgacggttttcctgtgcgcaaattaaacagtaacgggggcattattagcacgacagataccatattccaatctttgcatacatggcttgatcatcaaccaagatgatatttcccaagcacagcatgatgcatgccattgaaaaatatagaaaattaattgaaagcttaaatggatattgaaatgaatgatcacatagtacaaattataagaaggttcgggctaggtaggatatttttttattcgtatagcaaatcatctataataattttttcttcgtatgttgtttattatataatttacaattatcaatttaattacctttcgcttttaatttatttattaccaatattgtgcagtatatatatgtttatattttttttagggaaaactaaggatacattaacgacagagcgaagaaaaaaattttttaattctatttttccacttagaattctaatgataataggttctgagaaaaagaggttaggcatcggtagtttttatttgctaaacctactatggattatttggtgtcttatgattcatagagaacaagtcccattaaataacttaaccctcctattatccttcatattttcattattttttttattatgtgattttgttttattattgaatgtttatgtttatttttttaaattaagagaggcttaatatggttaatcaaatcaaatctgataataattcagtttctattgaatttatataagattttataactgcaagtacggatgtaattaatctgagttacgaaaattttcgtaaaaatttttatacacaaatgtcaactgattctaccaattatgcagccaaacatgaaagtttaggaaaatcggtacaacgtgaattacaaaaaacacaaagtcagttgagacaagttgtaagaaaaatgcagagtaaatataatataaataataaagcacgagtagcagaaatatctttgttaaggcaaatgcaaagccaattttctcgaaaatatgtaaacaaaaatcttggtaacagcaacactttggctcaacaaggcagctacaccaaaaaagacggcacaaccgcgcaagcaggcgatttgctgttggctgctgacaacctgcacagccgcctcacggacaaaatgctatccattagccatgttcgggaaaacacgatttccccgtttgttttaggctgtctaaaacaaataaccataaatgcatatcattatttaaaataaataaaagtatttaactatttttgacaaaattttagaaatagagctagagttttagttaagtagaaattgatagtgcttcaagggaagtattctctatgtttgcattaaagggggtctgataaagctattattcattactatggacttttatttcattattttcaggcggaaatctcatagccgttttgaatttttctcttccttattaattatacaaataattagtatattctgatatggattttttggaaatttttattatgtctgcatttagaaaaatattattaataatatcttgcctattgattgctagctgcagttttgttgaaactattttttatatggctattagcccagaacctgttgtggtagactttcctcttggtaaaaaaacaaaaagatctattgaactcaaacagaaaattggtaaaccttatgcaatatcgttaggaactaattttatacattatgatccaaaacagggggagaggtggattgatgataagttaaactatccatataatatatcggttaaaatatttaaagtggaagaagatggtaaaaaacttattatagatgagttgcttacagagagaagtagaaaattaggaggcggagtatttggagctgggggaaaatacagtatgcatatttatgatttttatttgccggaaggggaatatttatttgagatttctgataatagtgaatatattccactttacgatgaaataaataattctataagaatagtagttaatgcacgaattcagtaaatttttctagaaatgtggggttacttatggctgattattatgcgataactgtaaaatttgcgaagcagggtacgccactgaaacaagagggggtgtatccaagacgggtacgtttgggttgaactgtattcggctagagataaaaaaatcggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaaattctcaatgccgttaatgtggttctgacggtctgcaaattccttggaatggttgatgcggtaatggataaaaccgctcacgtccaacttgtcgcagctgctcagactatcggtataaacaatactgtccggcatgattttctttttgatgacagggagtaacgtttcagacttggcattatctacgacaacggtatagccccgtccgttgcgtttcagaatgccgaagacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtactgccgaattgggatggatacccaaaatatcggcggcagaacgggcggtaacttccagcacaaaaaaacggagcagttctttctgtacttttttctttaatttgcagtgcgttatcttcatatttcgagggtaacatatctgctaatctagtacagccccaaaaatataccaaaaacagcaaaacaaattgtaaggataggtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcatcggaactatcataggtatggagagaacgattacagcactagcgtaggttcctgtattaacggtttcacggtacggtattacccgtttattcgggaaaagcagcagctcacacagcaggagttggtaggttatcaccaacaagtagagcaattggtacagagttttgtaaacaatccaagtaaaaaataatggggctgtcctagataactaggataaactcgattttactaattgttttaaaatggaacaagaacttttatctcactgttgttaaaacgccattcgcactcctttaaatacagctcaaaatgcgctttgggaatgccgttaaacttgcgtaaatgacgttttgcctggttccaaaagttctcaattccattaatatggttttgtcgttcagcaaaatgtgtgctgtgattgatacgaaaacgaagtttcagcgaagctaaaatggctaaattcgcgcacatctaatacatcatagctacgataacaatccgtataaataatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgtgacaaatagctcaatgagtttattttgtttatactggcttagacgactttttctcatagggataattctaacttaatttgaatttccctagttatctaggacagcccctattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggtatccgagct

SEQ ID NO: 4 - DNA, 46594 bp, Neisseria meningitidis
cggggcttacaacatcggcgcaatcgacaaaaagaccatgcgcgactttgacaagtcctgcctgaccgaaatcaaaccgttgagcggcggagacatcaaggcaatcagggagaaggaggcactatcgcaagccgctttcgccatctatctcaacgtgggaaaaaatcacgtttcggcttgggagcggggcgttaaaaagccgagcggcgcggcgttgaagctgctgaccatcgtcaaaaacaagggcatcgaagccattgcgtagccgacttggcaaacggcaaaatcagcaagttcacaatagacgcgctgctgaatatgcctgccaagacaggcaagaccgccgaactgaatatcagggcgtagccgcataaatgcccgaccgcatcaaaccaagccgaaacggcggcggtgcagacgacatagcccgacagcaaggcacggcgcagacgggcgcgaaacccgaaacatcaccgaccgcgaggtacggggattttttgcgcccgttgcagggggggattggatttaagcggcgcgggcttgaaggcaaaacgggtggggcacagaactgtttaaatgcagtctgaatctcaaacgatttcagacggcattttgaaacaatggctcaaattctcgatccccttcccttaacgccgacgttttttattaacgcgccccttatttctgacactttgctcataaaccggcataacggtcggcaacaaccgttttagattttctatacgggcattgtttgtcggatgagtagaggtaatagcataaataaagccgttttggtcgttttcctgattcattttttcccaaaccctgacagcggccgccggatgatagcctgcctgcgccatcaacatcattcccccctcatcggcttcttcttccaagctgcggctataaggcaaggtaagaccgtacgtccccaaaatatccatacccaatccgaccaattccggattagtatccggttttttgtctaatataatctgcgtgcctatctgcgccgccgtattggtcaagatttgctgcccgaccttatttttaccgtgttcatgcagggcgtgcgtcatttcatgccccataatggcggcaatttcgtcatcggtcagcttgagtttgtcgactatccccgtataaaacgccatttttccaccgggcattgcccacgcgttcagctcatcgtttttgaaaaccgtcattttccagtcaaacttatggctggtattatttgccgcatcggcataaggcagcatacgtcgaaatactgcctgcaccctgcgggctgttctggatgtggtatcgacattgccggcagacttgtttaactcaaccgttttcatataatctttggcagccgcagcgttcattgtggcggaatcatgaccgtaaacatcagcaacgaccgcacaagcccccaataccgagattactgccgacaggcagagtatccgtttaaaggaaggaaggaaggaaatttcatatttaggtttactccttaaaaaattaaatttcaaaaaaatgccgtctgaatccaaaacggatttcggacggcatcttaacattgtttaatgtttttaaaaagatttacaccacgatgttctccagtctgcccggtacggcgatgattttcttggcaggcttgccttctatgaatttcaccgcgccttcagcggcgtattcggcagcttcttcagccggtttgtcgaaatcacgcataaattgccaataattctccaacttttttacggctgctgctgccttttgcggcaatattgcgctgaacttcaactgttttcaaaatggcagaagaataaatatcccttgtgaattcagtatcatgatttgaaatcaaaataccttgggagttgggcgcaatttattgattttttgtaaagtccgcgaccaatgaattcgatcgtattttggtcgcgcagaatttgcaactgttggcggattttgtctctgatatggttgttttggggaaattggatggatagtttgttttcaaattcatacatttgcgacaatgtgaattcttcggggagttggtcgatacatttcataacagccagaagccagcctttgcgctccgcattttggttgcgtaaaaacaaattggattgccattttttcagaacggtttcgggttcgataatgcgggaattgtctattaagaatattttgccgctttcaggcaaaggggcgagattgatagaacacataatgtggttcggccggtttttaatgcctttatttctgggaataatcatatccggcgtgatgaaatgtttgggtacaagcaccaattgccgtatggagtaatccgcttttttatatgcaagaaagaaaaagttggggttggtatctgaccggatgcgctccaacatggtgtgatatgcaccgtcaggcacgctgttgcctatggttttttgatttttactctttaattcatattgctcgtggcaatttgggcaaaagaggtctgcaacaggtttgttattggcaaatctctgcatcggcttgcttccgcaacaggggcagtagccgtttttttccaaccaagcctcgctcattacacggattttatgggttgctttattttgttgctttcccaattcggtatcgaaaaataaattcatgttttggattttgagatttcagttattcggggttcgtcatgcagacaacacaatccaccttaaaaaggccgtctgaaaccctgtttccaagtttcagacggcctttatccgtgtggctaaaccttaaaagcggttagacgacgatgttcaccagtctgcccggtacgacgatgattttcttcgccggtttgccttccatgaatttcaccgcgccttcggtggcgagtgcggcggcttcgaggtcggctttggatgcgtcggcggcaacagtgattttgccgcgcagtttgccgttgacttgaaccatcacttcgatttcggatttgaccaaggcggcttcgtcgactgtcggccagcctgcttcccacagtttcgcgccgttcaattcgctccacagggtttcgcagatgtgcggcacgatgggccacaacaggcgtacggcggtttccaatacttcttgggcgacggcgcgtccttgttcgccgccggtgtcggttttgtcgtattggttgagcaattccatcacggcggcgatggcggtgttgaactgctggcggcggccgtagtcgtcgctgactttggcagtggtcgcgtgcagtttgtggcgcaggtctttgagttctttagacaaaccgtcttggctgcctgcgaacgctttgaccgcttcgccttgcttcaagtattcgtaaacggtacgccacaggcggcgcaggaagcggtgtgcgccttcgacgccgctgtcgctccattcgagggactgttcgggcggtgcggcgaacatcataaacaggcgggcggtgtccgcgccgtaggcgttaatcagttcttgcggatcgacgccgttgtttttggacttggacattttttccgtgccgctgatgacgacgggcagcccgtcggctttgaggacggcggaaatggggcggcctttgtcgtcgaacgtcagctcgacatcggcggggttgatccaatctttgccgcctttgtcgttttcgcggtagtaggtttcgcaaacgaccatgccttgcgtcagcaggcgttcaaacggttcgtcaacattgactagaccttcgtcgcgcatcagtttggtgaagaaacgcgcgtacaagaggtgcaaaatcgcgtgttcgatgccgccgatgtattggtcgaccgcgccccagtatttcgcggcggcaggatcgaccatgccgtctgaaaattttggcgacatgtagcggaagaaataccagctcgattccatgaaggtgtccatggtgtcggtttcgcgtttcgccgcgccgccgcagcatgggcaggcagtttcgtaaaactcgggcatttttgccagcggcgaacccatgccgtcgggtacgacgttttcaggcaaaacgaccggcaattggtcggcagggacgggtacgtcgccgcattgttcgcaatggacgatgggaatcgggcagccccagtagcgttggcgcgaaatgccccagtcgcgcaggcggtattgggttttcggttcgcccgcgccttggctttgcagcttggcggcgacggcgtcgaatgccgtctgaaaatccaagccgtccaagtcgccgctgttgaccaatacgccgttttctttgtcgccgtaccattcttgccattggttttcgtcaaatgcgttgtcgccgacggcaatgacttgttttttcggcagattgtatttggtggcgaactcaaaatcgcgttcgtcgtgcgccggaaccgccatcaccgcgccgtcgccgtagccccacaatacatagttggcaatccacacttccagcttgtcgccgttgagcgggttgacgacgtagcggccggtcggcacgccttttttctccatcgtcgccatatcggcttcggcaaccgaaccggctttgcattcggcaataaatgcctgcaattcgggtttgtcggcggctgcggcggctgccagcggatgctcggcggcaacggcaacataagtcgcacccatcagcgtgtcggggcgggtggtataaacttgcaggaatttcgcgtaatcgccttccaagccttgtttgctgtcgtctgaaacggcgaagcgcacggtcataccgcgcgatttgccgatccagttgcgctgcatggttttgacttgttccggccagtgttccagcttgtccaagtcgttgagcagctcttcggcgtaatccgtgattttgaagtaatacatcgggatttcgcgtttttcgatcaatgcgccggaacgccagccgcgtccgtcgatgacttgctcgttggcaaggacggtttggtcgacagggtcccagtttaccgtgccgtttttgcgataaacgatgcctttttcaaacagcttggtaaacagccattgttcccagcggtagtattcgggtttgcaggttgcggtttcgcgcgcccagtcaatcgcaaaacctaggcttttgagctgggttttcatgtattcgatgttatcgtacgtccaagcggcaggggcgacgttgtttttcatcgccgcgttttccgccggcatgccgaacgcgtcccaacccataggctgcatgacgttgaagccgtttaaaagtttgaagcggctcaatacatcgccgatggtgtagttgcgcacatgccccatgtgcagcttgccgctgggataggggaacatggagaggcaataatatttgggtttggaagcgtcttcggagacgttgaaaatacgggcgtcgtcccattttttctgcgccgcaggctcaatggcggcgggccggtattgttcttgcatagtcattctgttttcgcttaaaaacgttggaaaaataaagtcggcatcaattataacaggttgccggaagcggcgaatcggcagattgccggcaggatgcgtaaattcgcacgcgcattattccgtatgccgtacaaatacaccgcgtttattgatacgcacgttttttatgctaatattacaaaccaaaatcaaatgtttaaaactctcctgatgcggctcttccgaacaaaaggcagacgggcatcgggtaaaagaggattctgcatatgaaaatcaaacaaatcgtcaaaccgggcttggcagtattggcggcgggcgttctgtctgcctgcgcaaccaaaagcaacgtcaaagccgacggcacgaccgacaatccggttttcccgaaaccctattccgtaacgctcgacaacaagcgcggcacattcccgacttatgacgaactggatcagatgcgccccggcctgaccaaagacgacatctacaaaatcctgggccgcccgcattacgacgaaagtatgtacggcgtgcgcgaatgggattacctgttccacttccataccccgggcgtaggtatcgaccctgaaaacacttccggcgtagaagatgttactacctgccaatacaaagtgattttcgataaagacaaatttgcccgcagcttctactggaaccccgtcttcccgaaagatgccgcctgtccgccgcccgcacccaaagccgagccgcaagtcatcatccgcgaaatcgtgccggcaaaaccgaaacgtatccgccaataatccgacatgccgttccgcctgtttttagggatattatgcggcctgtcaatggttgcccccgtatatgcacaggggcagccggatacggtcggcgactttatccaaaagaaaaaagtcatcgtcgatacatccaaagcggaactctgtttcgctgacgaccgtcagtgccaccccgtcctcatcggtgttgccacgcccaaggggacgttcgggctgacgctgaacagtaccgacaagcccggatacggcggcgaagtcatcggtttcaagcaggagggtgattttcttttcgccctgcaccgcgtttggaatcagataccgtcggaaaggcggaacgaacgcatcgcctccccgtccgtgtccgacaggattatgaccaacggctgcatcaacgtcagcgatgcggtgtacgaaaaactgcgtcattattttgtgttggaagtgatttgaaacagacggataccgcacgcgccggtatctgttttcacattgccccgatgcctgaaacagactgtccgccacgtcatgccgtctgaaaccggcgcagatgccgccaagccttcagacggcattgcctgcccgctccgaccgaacaacaaccatctttgggagaaccttatgcccgaacaaaaccgcatcctctgccgcgaactgagcttgctggcattcaaccgccgcgtgttggcgcaggcggaagaccaaaacgtcccccttttggaacgcctgcgcttcctgtgcatcgtttcatccaacctcgacgagtttttcgaagtccgtatggcgtggctgaagcgcgaacacaaacgctgcccgcagcgcaggctggacaacggcaaaatgccgtctgaaaccatcgccgacgttaccgaagcggcgcgctccctgatacggcaccagtacgacctgttcaacaacgtccttcagcccgagctggcacaagaaggcatccatttttaccgccgccgaaattggacagacacacagaaaaaatggattgaagactatttcgaccgcgaattgctgccgatcctgacccccatcggactcgacccttcccaccccttcccgcgcccgctgaacaaatcgctcaacttcgccgtcgaactcgacggcacagacgcgttcggcaggccttcggggatggcgattgtgcaggcaccacgcatcctgccgcgcgttgttcccctgccgtccgaactgtgtggcggcggacacggcttcgtcttcctctcctccatcctgcacgcccacgtcggaaaactcttcccgggcatgaacgtcaaaggctgccaccagttccgcctgacgcgcgacagcgacttgaccgttgacgaagaagacctgcaaaacctccgcgccgccattcaaaacgagttgcacgaccgcgaatacggcgacggcgtgcggctcgaagtcgccgacacctgtcccgcctacatccgcgactttctgctcgcgcaattcaaactgaccgccgccgaactctatcaggtcaaaggcccggtcaacctcgtgcgcctcaacgccgtccccgacctagtcaaccgccccgatttgaaatttcccacacacacgccgggcagactgaaagccttgggcaaaaccgcgtccatattcgatttggtgcgccaatcgcccatcctgctgcaccacccctaccaatcgttcgaccccgttgtcgaaatgatgcgcgaagccgccgccgaccccgccgtgcttgccgtcaaaatgacgatttaccgcaccggcacgcgttccgaactcgtccgcgccctgatgaaggcggcactcgccggcaaacaagtaaccgtcgtcgtcgaactgatggcgcgttttgacgaagccaacaacgtcaactgggcgaagcagctcgaagaggcgggcgcgcacgtcgtgtacggcgtgttcggctacaaagtccacgccaaaatggcactggtcatccgccgcgaagacggcgtgctcaaacgttacgcccatctcggcacgggcaactaccaccaaggcacatcgcgcatctacaccgacttcggcctcattaccgccgacgaacaaatcaccgccgatgtgaacatattgtttatggaaatcacaggtttgggcaaacccgggcggctgaacaaactctaccaaagtccgtttaccctgcacaaaatggttatcgaccgcatcgcacgcgaaaccgaacacgcaaaagccggcaaaccggcgcggattaccgccaagatgaattcgctcatcgaaccgaccgtcatcgaagccctgtatcgggcaagcgcggcaggcgtacaaatcgatttgattgtgcgcggtatgtgcaccttgcgcccgggtgtaaaaggcttgtccgaaaacatccgcgtccgctccatcgtcggcaggcagctcgaacacgcgcgcgtgtattacttccataacaacggcacggacgatacctttatctccagcgcggattggatggggcgcaacttcttccgccgcatcgaaaccgccacgccgattaccgcgcccgaactcaaaaagcgcgttatacatgaaggactgaccatggcactggacgacaacacccacgcgtggctgatgcagcccgacggcggctatatccgcgccgcacctgccgagggcgaatccgaagccgacctgcaaaacgatttgtggacactgctcggaggctgacccgcaccgccccaatcaaaaaccatgccgtctgaaacctttccgtttcagacggcatggttttacagcaatctaaacagggcggaccggagtcaaaaacacaccttcgccattcctgcacaagcacttcccctatacgctcccaaccccaagccgccgcattccagacggcattatagtggattaaattttaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaagaagaaaatcatgccggacagcattgtttataccgatagtctgagcagctgcgacaagttggacgtgagcggttttatccattaccgcatcaaccattccaaggagtttgcagaccgtcagaaccacattaacggcattgagaatttttggaatcaggcaaaacgcgtcttgcgaaaattatagtggattaacaaaaatcaggacaaggcgacgaagccgcagacagtacaaatagtacgaaaccgattcacttggtgcttcagcaccttagagaatcgttctctttgagctaaggcgaggcaacgccgtactggtttttgttcatccactatacctttccgacagccgaacaaaaccccgaatccgtctgcacggttcggggtatatctccaatacgggcatcgtgttccggaaaaccgtcaaatccgcatcggcatcacaatatatttgaaattcggattgttcggcacggtaaacagcgtcgagcggttggcatcgccgaaggcaagctgcatatcgtcggaatggatgttgcgcaacacgtccatcagatagccgatattgaaaccgacttcgagttcgccgccctgataggcgatttcgatttcttcgcgcgcttcttcctgctcgttgttgctgcacacaacgctcaacaggccgggttgcaaaaacaatcgcgcaccgcggaatttttcattggcaagaatcgatgcacgttccaacgcgcccaacaattctgccctcgacaacacgaaaatcttgtcgttgtccaaaggaatcacgcggttgaaatcggggaatttgccgtcgatgaccttgctgacgatggtcgtgccgttgcattggaaacgcacctgtttgtccagcagctcgatttgaatcggatcgtcggggttgttcaacagtttgaacagttccagcaccgttttgcgcggcaaaatcacttcggcgcgcggcaaatccgcatcaatcgcgcaggctgcataggcaaggcggtgtccgtcggtcgccacaaggcgcaactggctgccctcaacctgcatcagcagaccgttgagataatagcggatgtcctgcaccgccatgctgtactgcacttgcgacagcatggttttgaaacgctcctgctccagcgagaaagtcgcgctgatgtcctcgccgacattcatcatcggaaaatcggcggcaggcagggtctgcagggcaaaacgcgatttgcccgccttcagcgtcagacggctgtcgtcccaatccagcgacaccagcgcaccggcaggcagcgcgcgcaaaatatcctgaaatttcttggcattggtggtgatgcggaagtcgcccgcgccgccctcgggacccgcagtgtcgatttggatttccaaatcggttgccaagagtttggtctgaccgccttttccctcaatcaggacgttggacaggatgggcagggtgtggcggcgttcgacgatgccggtaacggcttgcaacggcttgagcaggctgtcgcgctcggcttgtaaaatcaacatgttcgctcctttaaatcggtttgtatagtggattaaatttaaatcaggacaaggcgacgaagccgcagacggtacaaatagtacggaaccgattcacttggtgcttcagcaccttagagaatcgttctctttgagctaaggcgaggcaacgccgtactggtttaaagttaatccgctatatctttacccttcggacggcatgggcaatatcatgtcgtctgaaaacgttttccatcagttttgaatcagaatcagcagcttttcataatcctgagccaattccggatcttcttcgcgcagtttcgccactgccctgatgccgtgcataacggtcgtatggtcgcgcccaccaaacgaatcgccgatagacggcaggctcaaagtagtcagttctttggtcaggctcatcgccacctggcgcggacgggcaatgtttcgtgtccgtttcttaccgagcacatcgctgattttgatgcggtaatatttcgccaccgcatcgatgatgatgtcggcggtgatgactttgtgcttctcggcaataatgtcctgcaaagcggtacgcgccaaatcgatgtcgatgacgggacggttcataaagcggctgctcgctccgacacgattaaacgcgccttcaagctcgcgcacgttggaacggatcagattggcaatgaacagcgcggcttcgtcttcgatactgatgcccgccgcttccgcctttttctgcaaaatggcgatgcgcatttccaattcgggcggctcgagttccaaagtcagtccccatgaaaaacgggatttgaggcggtcgtccatgccttcgattttcgcaggcaacacatcgcaagtgaggatgagctgttttttctcgttgtggaaatggttgtacagatagaaaaactcttccatcgtacggtctttgcctttgatgaactggatgtcgtcgataatcagcaggtcgtattgcttgtattgctgcttgaacacgtcgtaagtgttgttgcgaaccgccttcataaagctgcggatatagtcatccgaatgcatatagcgcactttggcatcgggacggtttttcagcagctcgttgccgaccgcctgcacaaggtgggttttgcccaaacccgtgctgccatagaggaagaacgggttgtaactctgccccgggctttccgcaatcgcctgcgccgcagccgccgcaaggcggttgcccttaccttctaccaacgtatcaaacgtgtaatccggagacaggttggtctgctcgtaacgcgcctcttccgcatcgcgctgcacgtccgtccgtgctttggcaactgccaccgattccggccgggaagcagacccggcagcctgacgcggctcgtgcggcaggtttttcatacgttccgccaaaatatccgccgccgttttcgacgcagcgggtttgacaggctcttcagacggcagctcgtccaacagaacctcctgcacgggcattccctccgacaccgcatgcaaggacggctcggcaggttcgacagcaccttcaaccgccgccatctcataacgcacgccttctcccggtttgaatacgaaggcggaacggccggcagccaactcttccctcaccgcttctatttttccggcaaactggctcttgagcatattgcaggcaaactggttcttgccgtacaccacccatacgccaccctcctcaccaacggtaaggggcgcaatccattgcgcaaactgcccttgaggcaacatatcgtgaagacggcggaggcacagcggccaaaactctgctaatgtcatggataggctcgaatcggtaaaaatgaaatcgaaaacaaagaaaatataatattttcaaaaggaaaacaaatctgttgaacgcacatcggttcaaaacgcgactgcccgattataccgactcacgaatattttatccacaacccgtgcaaaaatttatccacagaaaggcggcggaaatccgcaggcaatcgggcaatcttcctgcaaagtttctatattgattgacaaaagcggcaaattggagtgtaattcacggtttaattatctacccattctattttaggaaacatcatgaaacgcacttatcaaccttccgttaccaaacgcaaacgcacccacggcttccctggtgcgctccaaaacgcgcggcggccgcgcagtattggccgcacgccgtgccaaaggccgcaaacgcctggcggtataattttggactaccgcttcggaaggcagtaccgcttgttgaaaacggatgatttttcatccgtttttgcattcagaaaccgccgcagccgcgacctgctgcaagtttcgcgctcaaacggcaacgggctgggccatccccgcatcggtctggtggtcggcaaaaaaaccgccaaacgcgccaacgaacgaaattatatgaagcgcgttatccgcgactggtttagattgaacaaaaaccggctgccgccgcaggatttcgtcgtgcgcgtccaccgtaaattcgacagggctaccgcaaaacaggcaagggcggaactggcacaactcatgttcggcaaccccgcaaccggatgcaggaaacaggcatgatcagaacggtactctgcaggcaaggttcagacggcaacgggtttcccatacaaggaacatcccgatgaacttcctattgtccaaactcctgctgggactgatacggttctaccaatattgcatcagcccgctgattccgccgcgctgccgttatacgccgacctgttcgcaatacgcggtcgaagcggtcaaaaaatacggcgcattcaaaggcggccggctcgccatcaagcgcattgcacgctgccaccctttcggcggacacggacacgaccccgttccctgacccgacgcaatattcaaattgcacgctttccttttatttcccatcggtttctatataatgccgtctgaagcttcgggcaggcggcacgaccgccgggtatgaagcccgcccttattccccgtctatcggaacacgcaacctgcggcatttccgaccattcakgaaactcttatggattttaaaagactcacggcgtttttcgccatcgcgctggtgattatgatcggctgggaaaagatgttccccactccgaagcccgtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaaatgccgcagcatgaaaaatgccgtctgaaacctgttcagacggcatttttattgcccaccccctatcggggcggaaatcttcaacccgcatacatcacaaaaatcgtcgggcgttttttcagattgggcatttcttttctttttcgccactgcacgattgtttgactgatgatttcctgtgtcggcaaggtcaaatccgtagccgtgcataaacgcgtttcaggatgcaggttttccaccgcatcggcaagcagcgcatcattgcggtaaggcgtttcaataaaaatctgcgtctcgccgcactggcgcgaacgctgttccaaagcccgaaaagcctgaatccgctcgtttttttcagacggcagatagcctttaaacgcaaaactctgcccgttcgcacccgaagccatcaaagccagcagcaggctggaaggcccgaccagcggacgcacttcaaaaccgtgtttatgcgccaatgccaccaaattcgcacccggatcggccacagccgggcaacccgcctcactgacaatgcccatactgcgcccttcttgcaaaggtttcagcaattccggcaaagtcttcaaatccgtatgttcattcaacgtttgcagattcagctcgcggataggcgtagtcacgcccaaatgtttcaaatgcgcacgcgccgttttttccgcctccacgacaaaatccgtcagcccgacaatcgcctgttgttcatgcggcaacaggcacggcgtgtcaggcgtacccaaaggcgtaggaatcaaatacaaaacaggagacatcattccctcactcatcggttaaaaatgccgtctgagcctttcagacggcataaacgggcagttacagaacctccacgccctcatttttcaagaaatcgaccagacggaaaaccggcaaaccgattaaagcattcggatcggtactctcaatcctttcaatcagcaatgcacccaaatcctcactcttcagcgcacacgaacaataaaccgcatcaggctcgcgctccaaatagcggaggatatgcaactcgtccaactgcctcatcacgaccaccgtcttatcgatatgccgccgcatcctgcccgtaaccgtattcaacagcacgatcgcgctgtaaaactcaatctccctgccgctcaagtgcatcagcatcttttgcgcattggcaaggttcatcggcttgccccactgcctgccgtcgcaccacgccacctggtccgcaccgacaatcaacgcctctgggaaacgcccggtcaacgaccgcgccttaccctcggcaaggcgcaatgccgtctgaggggcggattcccccaacatcggcgtttcgtcaaaatcgggggacgccgcctgaaaggcaatgccgagcctttccatctgttcgcggcggaaaaccgaactcgtacccaaaatcaaaggcagttccaaacccatcccatcctccttaccgttgaaaacacgcccgaaggggcagtaaaatccagccatgcgccgaaacacggatacccgccttcggcgtaccgcaacatttttcttaaaaatattgacgttagaacatctaaattatatcatatcccgtttatgtcagaccctaatttgattgacttggaaatttttgccgccgaagggcagaacctgcaaggcagttttctgctggaagaattggatgaacgcgtcagttcgcacgattatcccgccgacaggcagaccaaaatatcgtttacactgaccggcggtcgcgaccggctgcaacgcctgttcctcgacctgaacgtcaaagccgatatgcccctgatttgccagagatgtatcaaacccatgccgttcatgcttgatgaaagcagccgtatcgtcctgttttccaacgaagagtccttggacgaatccatgcttgccgacgaagaactcgaaggcatactgattgaaaaagaactcgacgtgcgcacattggtagaagaccaaatcctgatgtccctgcccttttcgccgcgacacgaagactgcggcgacaatgggacactggaagaagtcaatcgggacaaacccaacccctttgctgttttggcaggtttgaaaagcaattgattaggacacagtttatttatctaggagcttgaaatggccgttcaacaaaacaaaaaatccccttccaaacgcggtatgcaccgttcgcacgacgcgctgaccgcgcctgcactgtctgtcgacagcacaaccggcgaagtacaccgcccgcaccacatctcccccaacggtatgtaccgcggccgcaaagtggtcaaagccaaaggcgaataatccctattcgactgactgaaaaagccagaacattgccatgcaattactggctttttttgcattggacgcaccatccgtccaaactttcgccatacgtcaacacacaggggcaaagcgttccgtataataccccgtgaaaatattccaaaagccccaaccaccaaggaaattccgatgaaacagaaaatctggtacacctacgatgacatccaccgcgtcatcaaagcattggcagaaaaaatccggaacgccgacatcaaatacgatgccatgattgccatcggcggcggcggctttattccggcacgtatgctgcgctgttttctggaaattccgatttatgccgtaaccaccgcctattacgacagcgacaacgaaggacaggttaccgaagaagtcaaaaaagtccaatggctcgaccccgttcccgaagccctgcggggcaaaaacgtactcgtcgtcgatgaagtggacgacagccgcgtaaccatggagttctgcctgaaagaactgctcaaggaagacttcggtacgatcggagtcgccgtactgcacgaaaaaatcaaagccaaagcaggcaaaatccccgaaggcattccctatttcagcggcatcaccgtagaagactggtggatcaactatccgtgggacgcactcgacatcgacgaacacaaccgccttgccgaggccggccgaggctgaccctttcagacggcatattttccgaaccgatgccgtctgaagcccgcacgacccctgccgcagaccgaaaacctaccggagaaaccctatgattacattggccgtagatgccatgggcggcgaccaaggacttgccgttaccgtacccggcgcaaccgcattcctccaagcacaccccgatgtccgcctgattatgaccggcgacgaaacgcaactgcgccaagccctgaccgcggcaggcgcaccgatggaacgcatcgacatctgccataccacccaagtcgtcggcatggacgaagccccgcaatccgccctgaaaaacaaaaaagactcctccatgcgcgtcgccatcaaccaggttaaagaaggcaaagcccaagccgccgtatccgcaggcaacacgggtgcgctcatggcaaccgcacgtttcgtcctcaaaaccattcccggcatcgaacgccccgccatcgccaaattccttccttccgacaccgaccacgttacccttgcactcgaccttggcgcgaacgtcgactgcacgtccgaacagctcgcccaatttgccgttatcggcagcgaactcgtccacgcactccatcctcaaaaaggacagccgcgcgtcgggctggtcaacgtcggcacggaagacatcaaaggtacggacaccgtcaaacaaacctacaaactgctgcaaaacagcaaactcaactttatcggcaacatcgaaagcaacggcatcctctacggcgaagcagatgtcgtcgtcgccgacggctttgtcggcaacgtcatgctcaaaaccatcgaaggcgcggtcaaattcatgagcggagccatccgccgcgaattccaaagcaacctgttcaacaaacttgccgccgttgccgccctacccgccctcaaagggctgaaaaacaaactcgacccgcgcaaattcaacggggccatcctgctcgggctgcgcggcatcgtgattaaaagccacggcggcacagacgaaaccggtttccgctatgccctcgaagaagcctaccacgaagccaagtccgccggcctttccaaaatcgaacagggcgtagccgaacaactcgccgcactcgaaactgccaaagccgtccaaaacgaaaatgtcggcggtctgtaacacacacgatgccgtctgaacgcccccgcccctttcagacggcatccgcccgcaccaaacctgcgggcgcggacggcgatgcgcctgtccggcacttcccaaatatcgccttgtaaaataaggagtatttgaaaaatgaagacattagaaaaacggatgaaagctctagacaaacggattatgaagttcggaaaatcccttgaaggcaggcttgatgcccgtctgattgaatccgcattggattatattcattattcggaacgttttttggcttttgaaatcctgtgtacttatatcgaagatttcgatgtccggctgacggaacaagaatcccgggaaatttcttttatcaacaaggaatttgagatagaaagcacgtccgattaaccaataaagccaatgggttgataaacatgaaaacatcgacggtcgtttttggcggattttttatggcagacaacggagagcgaatccaaatccccgttttggaaaatcctgacattagggaaatcaatcactttttttccgtatcaaattttgagaaaaaaaccggcgtccttgttttcagaatcatccccgagccggaatttggcaataccgaattaactgtctattttaaaaaaggatattatagtggattaacaaaaaccagtacggcgttgcctcgccttgccgtactggtttttgttaatccactatatcagacgaaaacaaacacccgcgccaatagcctgacggcaacccggcaatcaaaatgccgtctgaagcagcttgggctttcagacggcatttccttcgcttaaaacagcgtatcggcaaccccgccctgcctgtccacggcaatctgcatctgaaaaccatctgtatcccaaaccacacccccatccctgtttccatcatgtgcaccctgtccgtattgggcaatcatctgtttttcgcttacaatagccgaatctgaaccaactctctaaaaaggccgttcccatgcagtatgcaaaaatttccggcacaggcagctatcttcccgccaaccgcgtcagcaatgacgaccttgcccaaaaggtagatacctctgacgagtggattaccgcgcgcacgggcatcaaattccgccatattgcagccgaaaacgaaaaaaccagcgatcttgccgccgaagcggcgcaccgcgcgctggatgcagccggattagacagcggcgaaatcgatttgattatcgtggcaacggcaacgccggatatgcagtttccgtctactgcgaccatcgtgcaacaaaaattgggcatcaccaacggctgccccgcgtttgacgtacaggcggtgtgcgccggctttatgtacgcgctgaccacggcaaacgcctacattaaaagcggtatggcgaaaaacgcgctggtcatcggcgcggaaaccttcagccgcattgtagactggaacgaccgcacaacctgcgtattgttcggcgacggcgcgggcgcggtggttttaagcgcgtcggacacgccgggcatcatccacagcaaactcaaggccgacggcaattatctgaaactcttaaacgtccccgggcaaatcgcctgcggcaaagtttccggttcgccgtacatttcgatggacggtcccggcgtgttcaagtttgccgtcaaaatgctgtccaaaatcgccgatgacgttatcgaagaagcaggttacaccgccgctcaaatcgactggattgttccccatcaggcaaaccgccgcattatcgaatcgaccgcgaaacatttaggtttgagtatggacaaagtcgtcctgaccgtccaagaccacggcaacacatccgccgcatcgattccgctggctttggatacgggcatccgcagcggacaaatcaaacgcggtcaaaacctgctgctcgaaggcatcggcggcggtttcgcgtggggcgcggtgctgttgcaatattgaacccgatgccgtctgaaacaggctttcagacggcatttcccatatcatgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctgattatccaaccaaacaaaggaatactatgtcttttgccttcttttttcccggacaaggttcccaaagcctcggtatgatgaacggctttgccgaacacgccatcgtcaaaaacacctttgccgaagcctccgccatattggggcaggacttgtgggcgatgataaacggcagcgatgccgaaatcatcggtcaaaccgtcaacacccagcccattatgctcgccgccggcgttgccgtttaccgcgcctatttagaagcgggcggcaaaacgcctgccgccgttgccggacacagcctcggcgaatacaccgcactcgttgccgccggcgcattgaattttgccgacgcggtcaaactcgtgcgcctgcgcgccgaactgatgcagtccgccgtaccgcaaggcgtgggcgcaatggcggcgattctcggcttggaagatgagcaggttaaagccatttgtgccgaagccgcccaaagcgaagtggtcgaagccgtcaacttcaactcacccggacaaatcgtgattgcaggcaacgccgccgccgtcggacgcgccatggctgccgccaaagaagccggtgccaaacgcgccctgccgctgcccgtgtccgtaccttcccattgcagcctgatgaaacccgccgccgacaaacttgccgaagccctgaaaaccgttgaaatcaagcagccgcaaatccgcgttatccacaacgccgacgttgccgcctacgatgatgccgacaaaatcaaagacgcgctcgtccgccagctttacagccccgtacgctggacggaaaccgtcaacgccctcgtttcagacggcattgccgaatccgccgaatgcggcccgggcaaagtgttggcgggcttggcaaaacgcatcaacaaagccgccgcgtgcagcgcactgaccgatgccggacaggttgccgcctttatcgaagcgcactgacttcgttctgcaaaaagcagcctgccctcttcaggctgcttttcatgtccgaacgacggcagccccatatttacgctataatccatcccgaccaaaccaccgacagcggctgccgttgcagttcccgccctaccgatatgatagaaaaactgactttcggactgtttaaaaaagaagacgcgcgcagctttatgcgcctgatggcgtacgtccgcccctacaaaatccgcatcgttgccgccctgattgccattttcggcgttgccgccaccgaaagctaccttgccgccttcatcgcccccctgattaaccacggcttttccgcacctgccgcgccgcccgagctgtctgccgccgccggcatcatttccaccctgcaaaactggcgcgaacagtttacctatatggtttgggggacggaaaacaaaatctggaccgtcccgctcttcctcatcatcctcgtcgtcatccgtggcatctgccgctttaccagcacctatctgatgacttgggtctccgtgatgaccatcagcaaaatccgcaaagatatgtttgccaaaatgctgaccctttcctcccgctaccatcaggaaacgccgtccggcaccgtactgatgaatatgctcaacctgaccgaacagtcggtcagcaacgccagcgacatcttcaccgtcctcacgcgcgacacgatgatcgttaccggcctgaccatcgtcctgctttacctcaactggcagctcagcctcatcgtcgtcctgatgttccccctgctctccctgctctcgcgctactaccgcgaccgtctgaaacacgtcatttccgactcgcaaaaaagcataggcacgatgaacaacgtgattgccgaaacccatcagggacaccgcgtcgtcaagctgttcaacgggcaggcgcaggcggcaaaccggttcgacgcggtcaaccgcaccatcgtccgcctcagcaaaaaaatcacgcaggcaacggcggcacattccccgttcagcgaactgatcgcctcgatcgccctcgccgtcgtcatcttcatcgccctgtggcaaagccaaaacggctacaccaccatcggcgaatttatggcattcatcgtcgcgatgctgcaaatgtacgcccccatcaaaagccttgccaacatcagcatccctatgcagacgatgttcctcgccgccgacggtgtatgtgcatttctcgacaccccgcccgaacaggacaagggcacgctcgcaccgcagcgtgtcgaagggcgcatcagcttccgcaacgtcgatgtcgaataccgttcagacggcatcaaagccctcgacaacttcaacctcgacatcagacaaggcgaacgcgtcgccctggtcggacgttccggcagcggcaaatccaccgtcgtcaacctgctgccccgctttgtcgaaccgtctgccggcaacatctgcatagacggtatcgacatcgccgacatcaaactcgactgcctgcgcgcccaattcgccctcgtctcccaagacgtattcctgtttgacgacaccctgtttgaaaacgtccgatacagccgtcccgacgcgggcgaagccgaagtcctgttcgccctccaaaccgccaacctgcaaagcctgattgacagctccccgctcggactgcaccagcccatcggatcgaacggcagcaacttatccggcggacagcggcaacgcgtcgccattgcccgcgccattttgaaagacgcgccgatattattattggacgaagccaccagcgcattagacaacgaatccgaacgcctcgtccaacaggcgctcgaacgcctgatggaaaaccgcaccggcatcatcgtcgcccaccgcctgaccaccatcgaaggggccgaccgcatcatcgtgatggacgacggcaaaatcatcgaacaaggcacacacgaacaactgatgtcccaaaacggttactacacgatgttacgcaatatctcaaacaaagatgccgccgtccggacggcataaacaaaatgccgtccgaaatggtacaatcgccccgaccctttcagacggcatcatatccgccgacccatccgattatcttcaatcactgtaaaacccattatgacccaagacaaaatcctcatccttgacttcggttcgcaagttacccagctcatcgcccgccgcgtgcgcgaagcccacgtttactgcgagctgcattctttcgatatgcctttggacgaaatcaaagccttcaaccccaaaggcatcatcctctccggcggccccaattccgtttacgaatccgactatcaagccgataccggtatttttgatttgggcattccggttttgggcatctgttacggcatgcagtttatggcgcaccacttgggcggcgaagtgcagcccggcaaccagcgcgaattcggttatgcgcaagttaaaaccatagacagcgagctgacacgcggcattcaagatggtgagccaaacacactcgacgtatggatgagccacggcgacaaagtgtccaaactgcccgacggtttcgccgtcatcggcaacaccccgtcctgcccgattgccatgatggaaaacgccgaaaaacaattctacggcatccagttccaccccgaagttacccacaccaaacaaggccgcgccctgttgaaccgctttgtcttggatatttgcggcgcacaaccgggctggacgatgccgaactacatcgaagaagccgttgccaaaatccgcgaacaggtcggcagcgacgaagtgattttaggtctgtccggcggcgtggactcttccgtagccgccgcgctgattcaccgcgccatcggcgaccaactgacctgcgtgttcgtcgatcacggtttgttgcgcctgaacgaaagcaaaatggtgatggatatgttcgcccgcaacttgggtgtgaaagtgatacacgtcgatgccgaagggcagtttatggcgaaactcgccggcgtaaccgaccccgagaaaaaacgcaaaatcatcggtgcggaatttatcgaagtatttgatgccgaagaaaaaaaacttaccaacgccaaatggttggcacaaggcacgatttaccctgacgtaatcgaatccgcaggtgcaaaaaccaaaaaagcccacgccatcaaatcgcaccacaacgtcggcggcctgcctgaaaacatgaagctcaaattgcttgagcctttgcgcgatttgttcaaagacgaagtacgcgaattgggtgtggctttgggcctgccgcgcgaaatggtgtaccgtcatccgttcccgggtccgggtttgggcgtgcgtattttgggcgaagtgaaaaaagaatatgccgacctgcttcgtcaggcagacgatattttcattcaagaattgcgcaatactaccgatgaaaacggtacatcttggtacgacctgaccagccaggcattcgccgtgttcctgcccgtcaaatctgtcggcgtaatgggcgacggccgcacatacgattacgtcattgccttgcgtgccgtgattaccagcgactttatgaccgcgcattgggcggaactgccgtattccttgttgggcaaagtgtccaaccgcatcatcaacgaagtcaaaggcatcaaccgcgtggtttatgatgtgagcggcaaaccgcctgccaccatcgagtgggaataaacagcaaacatggctgccccgtccggcgcagtccttcgattatcggaaaaaaggaaaaaatatgagcacacaagatttaaacggcaaaatcgctttggtaacaggcgcatcgcgcggtatcggtgcagcaattgccgacacgctggcggcagccggtgccaaagtcatcggtacggcgaccagtgagagcggtgcggcggcgattagcgagcggttggcgcaatggggcggcgaaggccgcgtattaaattccgccgaacctgaaaccatcgaaagcctgattgccgacatcgaaaaagcgttcggcaaactcgatattctggtcaacaacgccggcatcacccgcgacaacctcctgatgcgcatgaaagaagaagagtgggacgacatcatgcaggtcaacctcaaatccgtgttccgcgcttctaaagccgttttgcgcggtatgatgaaacaacgttccggccgcatcatcaacatcacatccgtcgtcggcgtgatgggcaatgccggtcaaaccaactatgccgcggcaaaagcaggcttaatcggtttctccaaatccatggcgcgcgaagtcggcagccggggcattaccgtcaactgcgtcgcccctggctttatcgataccgacatgacacgcgccctgccggaagaaacccgccaaacctttaccgcccaaaccgccttgggcagattcggcgacgcgcaagacatcgccgatgcggttctgttcctcgcttccgaccaagcaaaatacatcaccggccaaacgctgcacgtcaacggcggtatgctgatgccttaacagacaactttttcaaccatgccgtctgaagccctttcagacggcatttgcattctcaggcaaaatgaacacacaccacaccccgccctgcccatgcggctcaggcacaagctgagacctttgcaaaattcctttccctcccgacagccgaaaccccaacacaggttttcagctgttttcagctgttttcgccccaaataccgcctaattctacccaaatacccccttaatcctccccggacacctgataatcaggcatccgggtcaccttttaggcggcagcgggcgcacttagcctgttggcggctttcaaaaggttcaaacacatcgccttcagatggctttgcgcactcactttaatcagtccgaaataggctgcccgggcgtagcggaatttatggtgcagcgtaccgaagctctgttcgaccacatatagtggattaacaaaaaccagtacggcgttgcctcgccttagctcaaagagaacgattctctaaggtgctgaagcaccgagtgaatcggttccgtactatttgtactgtcttcggcttcgtcgccttgtcctgatttttgttaatccactatacatcatcgctactaccgttccggcgcaacaggcattcctcgatgccgccgaactgatgcaatggagtatagaaaccgaagggctgggcttgaacgtcatctcgcacaagatactcggcaaagaccacgcccaagtcgaatttgaagcctacttccgagacggacaacaccgatccgcgcatcacgaactgtccggcttcgtcaacatcggcggacaatggtattttatcgatcccaccgttccgcatcctgcgatgaaacaaccctgcatttgcggatcaggcaaaaaattcaaagcctgctgcggcaaatatctgaaacctgtcgcataaaaatgccgtctgaacgttcagacggcattttcaacgtgcaaaaaaaaccattcataccaagggtaagtatgaatggtcaatacattgcgggaaaacgtcttacttgctgcactgccgaaaagggagaaacggcagcggtaatcagcggaaaggattgtacccgaattaatattaagaaacgttaatcgcgaaaatatattaacaaacctgttgaaacctattggttttcccgtatccacccgacccagcgttcaaacagcttcggttcgagcgcggcaacgaccgagcgtttgaacacgtgttcaccactccaaaacccgtcgccttccaaagtcgtcagcctgccgcccgcctcctcgaaaatcaacgcgccggcggcataatcccacagcttctgcccgccgtgaacataaacatcataacgcccgcacgccagataacaccaatccaacgtactgctgcccatactccgtatcgttccaaaaggcgcgagcgtactcatacggctggaaagtttgcccgaacgcagatatttgatttccacgcccgcaatcgcctcattgagttttttatccacgaggcgcaggggcagacgcgtcccgtttaaaaacgccccctgcccgcgttcggcataaaaacattcgccgctgactgggttgtagattacgcccaactcggcgcgcccgttgcggacaaacgccaccgataccgcaaaatgcggcagcccgttgacaaaattgttcgtcccgtctatcggatcgacaatccacagccccttttcccccgaatattgttcccacaaagccgactgttcctgccgcgacatttcctcacccaacatcggactgtcgattaaaagcggcaacgcggcggcaaaagccgtctgcgcggcaatgtccgcctcgctcaacatcgaaccgtcttccttgcggtgagacggcgtattcaaaaaacgcggcataatttcggtttgcgcgatatggcgcacgactttctgcaaacggtgtaacacttcctactgtcctcatattttgaacttgcggcgcgcgaacgtataatgtccgcttccatcacgccgctgcgacggattataaccgtccgaaccgccaaaaactatgccccgattccacctgcccgaaaacctttccgtcggacaaaccgtcgccctgcccgacaacatcgtccgccacctcaacgtcctgcgcgtccgccccaacgaaaacatcaccctcttcgacggcaaaggcaaggcacacgccgcacggctgaccgttttggaaaaacgccgcgccgaagccgaaatcctgcacgaagacacaaccgacaacgagtccccgctcaacatcacactgatacaatccatctcctccggcgatcgcatggatttcaccctgcaaaaaagcgtcgaactcggcgtaaccgccatacagcccgtcatcagcgaacgctgcatcgtccgcctcgatggggaacgcgccgccaaacgcctcgcacgctggcaggaaatcgtcatctccgcgtgcgaacaaagcggcaggaacaccgttccccccgtactgcccatcatcggctaccgtgaagcactcgacaaaatgccgtctgaaagcaccaagctgattatgagcatcaaccgcgcccgcaaactcggcgacatacgccaaccgtccggcgcaatcgtctttatggtcgggcccgaaggcggctggacagaacaggaagaacaacaggcatttgaagctggctttcaggcggttacactcggcaaacggattttacgcacagaaaccgccccactcgccgccctcgccgccatgcagacgctttggggcgatttcgcataaacagaaatgccgtctgaaacccgttcagacggcattttgcagccgattaagatagtaggttcaaataagatttcccgtgtcgtcattcccgcgaaagcgggaatctagaaacgaaaaactacagagatttatccgaaacaacaaccctctccgccgtcattcccgcaaaagcgggaatctagaaacgaaaaactacagggatttatccgaaacaacaaaccctctccgccgtcattcccgcgcaggcgggaatctagaaacgaaaaactacagggatttatccgaaacaacaaaccctctccgccgtcattcccgcgcaggcgggaatctagaaatttaacgttgcggtgatttatcggaaatgactgaaactcaacggactggattcccgcctgcgcgggaatgacgagattttaggtttctgtttttggttttctgttctcgcgggaataacggaattttaagttttaggaatttgtcggaaaaacagaaatccccccgccgtcattcccgcaaaagcgggaatctagaaacgaaaaactacagggatttatccgaaacaacaaaccctctccgccgtcattcccgcgaaagcgggaatctagaaatttaacgttgcggtgatttatcggaaatgactgaaactcaacggactggattcccgcctgcgcgggaatgacgaattttaggtttctgtttttggttttctgttctcgcgggaataacggaattttaagttttaggaatttatcggaaaaacagaaatccccccgccgtcattcccgcgaaagcgggaatctagaaatttaacgttgcggtgatttatcggaaatgactgaaactcaacggactggattcccgcctgcgcgggaatgacgaattttaggttgctgttttttggttttctgtttttgcgggaatgacgaattttaggtttctgtttttggttttctgttctcgcgggaataacggaattttaagttttaggaatttgtcggaaaaacagaaatccccccaccgtcattcccgcaaaagcgggaatctagaaatttaacgttgcggtgatttatcggaaatgactgaaactcaacggactggattcccgcctgcgcgggaatgacgaagtggaagttacccgaaacttaaaacaagcgaaaccgaacggactagattcccgcctgcgcgggaatgacagtgtatccatttctaattttaatccgctatattttacacaaactatttgaacgatatgacccgcctgccgtaagctttctcaagctccgcctgcctttgacgctccattcttttcttcttttccctaccgaatttacccaaagcacgcttcaagtcaaacatcaccttcaacgaacggcggtgtcttctttcttgttccctatctttttccaaatcgctacccaacatactgtttttactgaggaacttggcataatgcaattcttgggtacataaggcgggattaacctgataaacaggcatcccctccttatcaaagaaataagtaaacatcatccaatctaccgctttaatccactctgccggcaaaacggcaaacctttccaagaaaaaccgcatcgcctcacgcgaaatgatatagccagccgtcccccaatgttcgctctccagcaaaggaaatgaccgattctcataattcaggactttatccggtctgacaataactttcgcaaacatcgtttccaaacgaacgataaaggcagaatccttatcaaaacgctcttccaaccaagtatcttcggcaaggaacttttctgcgtctttgccaagcaggacatcatcctcaaatacggcaacatagggcagaccttcatccaatgcctgtttccacaatacggcgtggctcataaagcaggctttttccacttcgctcaacaggtgctgttttgccaatcccggcaccaattccgccatcatccgattcagttcttcagacggcatcagtgcgtcgaaaaactgaaacgggatgccgcgcacgccgaaggttgcggcaatgtgcgccctgcgttctgcggcggaagctaagctgataacatggttttgcataatttatcctgttttttgtctgttggataaagcggcgtttttcaacggtttttcagcaatcggcgcaaaatgccgaagtattgcctcaaggtaaacagccgccgcatcctgccgtctgctgcaaatacgatgtccatctctcctccttttattggaaaggcacaatgaactgttcgcgcctttgccggcgtttttccctttccctgctgattttggtcaaggcgcggatcaggcggtgtttgaatgtgttggcgggggaatcgcgcctttgctgtttgcggttcaggaggcggtcgtgttcgatcaggctgcccaatgcgctgttttggtcgtgaaacttggcataatgcagctcttgggcgcacaaggcgggattgagctggcaaaccggcattccttccctgtcgaaaaaatcgctgaacatcatcagatcgacggggtgcagcccttcgggcggcagggcggcaaacctgtccaggaaaaaccgcatcgcttttcgggaaatgatatagcccgccgtcccccagtgttcgctttccaacagcggaaaggcgcgcccgcagtaatccgccacgccggagggcgaggtcaggacgtgcataaacatcgtttccaagcggacgataaaggcggtatccgggtcaaagcgttcttgcagccaagcgtcttcggcaaggaatttttccgcaccttcgccgagtaaaacgtcgtcctcaaatacggtgatatacggcagaccttcgtccaatgcctgcttccacaatacggcgtggctcataaagcaggctttttccactccgctcaaataggggtgcgccgacaagccggggacgagttccgccattgcctgttccagcctttcagacggcatcagtgcgtcgaaaaactgaaacgggatgccgtgcctgccgaaggtatcggcaatgtgcgccctgcgttctgcggcggaagctaagctgataacgtggttttgcataatttatcctgttttttgtctgttggataaagcggcgtttttcaacggtttttcagcaatcggtgcaaaatgccgaagtattgcctcaaggtaaacagccgccgcatcctgccgtctgccgcaaaatccagccacgcgccggcgggcagcgtgtccgtccgtttgaagcattggtacaaaaaccggcgggcgcgttcaaaatcttcttccggcaaatgtttctccagcaattcatacgctactgcttttatttggcggtattcaaggctgtcgaaccgggttttaaaacccatagactgcaaaaaatcgtttctggcggttttttggatgccttgcgcgatttcgtgttggcggatgctgtatttggatgaaacctgattggcgtgaaggcggtatttgaccaaggcttcgggataataagccagcctgcccaatttgctgacatcgtaccaaaattggtaatcttccgcccaatcccgctcggtgttgtaacgcaaaccgccgtcaatgacgctgcgcctcataatcatcgtgttgttgtgtatggggttgccgaaagggaaaaagtcggcaatgtcttcgtgtcgggtcggttttttccaaattttgccgtgttcgtggtgccgcgccagccggttgccgtccttttcttccgacaaaacttccagccacgcacccatcgcgatgatgctgcggtctttttccatctcacccacgattttctcaatccagtcgggggcggcaatatcgtctgcatcggtgcgcgcaatatattccccccccccccccgactttgccaattcatccagcccgatgtttaaagagggaatcagaccggaattgcgcggctgcgcgaggatgcggatgcggccgtcctgttcttggaaacgctgggcaatggcaagcgtaccgtccgtcgagccgtcatcgacaatcaaaatatccaagttgcgccaagtttgattcacgacggcggctaatgattgggcgaaatatttttctacgttgtaggcgcaaatcaatacgctgactaaaggctgcaatttattctcccgataggcacgatgccgtctgaaggcttcagacggcatttggactgtacaacggttactcgcccaaaagcgcgatatccgctaccgcgttcatttgttctgccaagcggttcagcaggttcaggcggttttgtttcacggcggcatcttccgccatcaccatcacgccgtcgaagaaggcatcgacttgcggtttgacggaagccagttcggacaaggcggtctggaaattgccttcggcaacggcggcggcaattttcggctgcaagccttgtgcggcggcaaagagggctttttcttcgtcctgttgcagcaagctttcgttaaccgcgcccaactcggcatcggcttttttcagcaggttttgcacgcgtttgttggcagcggcgagcgcggcggcttcgggcagttgtttgaacgcggcgacagcctgcagtttggcggtcaaatcgtccaaacggcgcggctgcttggcaagtacggcggcaacgatgtcttgcggataatcgttttgcagcaatacggcaaggcgcgcctgcatgaagtcggcggtttcagacggcgttttttcgttgagcaaaccttgcgggaagctgttgaaggccgtctgaatcagttcgtttacgtccaaaccgtactgcatcagcatacgcaaaatacccaatgcggcgcggcgcagggcgtatgggtctttgtcgccggtcggaatcaggccgataccccaaatgccgaccaaggtttccagtttgtcggcaagcgcaacggcggcggcaattttgccctcaggcaggttgtcgccggcaaaacgcggttggtagtgttgctcgacggcttcggtaatttcttcggtttcgccgtccaagcgggcgtagtatttgcccatcgtgccttgcagttcggggaactcgccgaccatttcggttactaagtcggcttttgccaaacgcgcggcgcgttcggctgcggcggcatccgcgcccaaagccttggcgatatgggcggcgatgctttgcaggcgttcgatgcgttcggcttgcgaaccgattttgttgtgataaaccacgttcgtcagtttgggcaggcggctttccaaagtcgctttttggtcttgtttgtagaagaactcggcatcagacaggcgcgcgcgcaagacacgttcattgccttggatgatgtgtgacggatcttcggtttgcagattggacaccagcaggaagcggttcatcagcttgccgttttggtcgagcagcgggaagtatttttggttttgctgcatcgtcagaatcaggcattcttgcggtacggcgaggaagtgttcttcaaaaccggcttccaataccacaggccattcgaccagcgcggttacttcgtccaacaaggcttcatcggcggcggcggtcgcgttcagacggcgtgcctgcccttccaataccgtctgaatcgcggctttgcgctcggcaaacgaagcgacgactttgccttgctcgcgcatttgtgcggcgtagctgtcggcgttttcaatggtaatttcgccgtcggagaggaagcggtgtcccaaggttttgttgccgctttgcagacccaaaacgctgacgttcacaatgtcgccgccgtgcagtacaactagcccgtgaacggggcgcacaaaggtaaacgtgctgctgccccaacgcattactttgggaatcggcagcttcttaaccgcttgattgataatgtcttccaaaagtccgcccaacggtttgccgatttggacgtattcgtaggcgtacacgtcctgcttgccgtcgtggacgatggtcaagtcttcgattttcgcgcccgcaccgcgtgcgaaaccttccaaagccttggttggcgcaccgtctttcatggcattcgctacggcagggccttttttcacaattttttgatcagcctgaacggctttgacgtttttgacttgaaccgccaaacggcgcggcgaggcataagccgtaaattcggctgcgccgtcaaccagttgcgctttttccaagccttcggcaacggaagcggcgaaatggttgcccagattattcagggctttgggcgggagttcttcggtaaggagttcgattaaaagggtttgggtcatcattcggctttctttgaatttggttaatctgcctgtttataggtttcgctgtaattttcccagccgtcatccccataaaaaccgtcaaccagcggggtggcgtacaaagtggcaacatcttcgcggtctgccagccaagagataatggcttttttctcggtttctcccaagcttcgggcaccggatttttgaaacaggcacgaaaaatcgccgcaatcgcccccccgccatttcaaagccgtttgccgcaagatacgcaatcagctcgtccataaagcggtcgaacgcttcggcatcgtcctcagcttggtgcaaactgccttgaacgccgaaaatcaatgtttgaaactcgcccaaatgcagctttttatgctggcggcggttcattttgtgcaggcgtttcctgcttggggtgcggaaatagacaggcatgattttcctaaaaaatataatggcttccggacggctgccttatcgtgccgcccgaacgtaaaaaatcgtcgcccccttaggcggcgtttgccttcattaaagggaagcccagtttttcgcggctttcaacatatttttgcgccacggcgcggctcaatgcacgaatacgtccaatataagttgcccgctcagttacggaaatcgcgccgcgtgcgtctaaaaggttgaacgtatgccccgctttgaggacaagctcgtaggcaggcagggcgagggcggcgttttcttcggcaagcaggcgtttggcttgcgcttcgtagtcgttgaactggcgcagcagccagtcggcatcgctgtattcgaagttgtaggtggattgctcgacttcgttttggtggtacacgtcgccgtaggtgacggtgttgccgtcgagcgtttttgcccaaacgaggtcgtagacgttttctacaccttgcaagtacatcgccaagcgttcgatgccgtaggtgatttcgccgagtacgggcgtgcagtcgatgccgccgacttgttggaaataggtaaactgggttacttccatgccgttgagccagacttcccagcccaaaccccacgcgccgagggtggggttttcccagtcgtcttcgacaaagcggatgtcgtggactttgggatcgatgcccaattcgcgcagagagtcgagatagaggtcttggatattggcgggagcgggcttgagggcgacttggaattggtaatagtgttgcaggcggttggggttgtcgccgtagcggccgtctttggggcggcggctgggttggacgtaggcggcaaaccaaggctcggggccgagtgcgcgcaggcaggtggcgggatgggatgtgccggcaccgacttccatgtcgaagggttggatgacggtgcagcctttgtctgcccagaatgtttgcagtttgaagatgatttgttggaaggtaagcatggcttatgattcgataaaataaagggtttattttactgtttccattgctgtttggataggtttatctcaaagacagactgatttgaaaacacggcatacatgatatagtggattaaatttaaaccagtacagcgttgcctcgccttagctcaaagagaacgattctctaaggtgctcaagcaccaagtgaatcggttccgtactatttgtactgtctgcggcttcgtcgccttgtcctgatttttgttaatccgctatatgtttcggttaggcggcaggctgccctattgaataccttaaagcaggctatgcctgccaacgccatatccaaacacagtctttaatttaaatccggaaaataaaaagcacgaccaaacggtcgtgcttttccaaaccaaacaagtttatttcttgtgcgaacggatatagtccaaagttttgagctgtgcaatcgcagcagccaatactttatgcgcttccgccaaagccttatcgtctttagcttgggaaatgcccgcttctgcggcttttttcgcctcttccgcacgtgcccgatccatctccgcactgcggacggcaacatccgccaagacagttactttatcaggctgtacttccaaaacaccgccggaaacagcaaccaaaacctctttatcctcgcccggaacggtcaaacgcaaagcccccggccgcaccaaactcataatcggctcgtgtcgcggataaataccgagttcgccctgtacagtcggaacaacgataaatgttgcctcgcctgaatagattttctgctcgctacttaccacctcaacttgcatgatgctcatgccgacctccttagtttaaggttttcgctttctctactgcttcttcaatgctgccgaccatatagaatgcctgctcgggcagatgatcgtattcgccgttcaagatggctttgaagccggcaatggtatcgcgcagggcgacatatttacccggagaacctgtaaacacttcggcaacgtggaacggttgggacaggaagcgttggattttacgcgcacgcattacggtcagtttgtcttcatcagacaattcgtccatacccaagatggcgatgatgtcgcgcaattctttgtatttttgcagggtggactgcacaccgcgcgccacgtcgtagtgctcttgacccaataccatcggatccagttggcgcgaagtagaatcaagcggatcgactgccgggtaaatacccaaagaggcaatatcgcggctcaatacgacggttgcgtccaagtgggcgaacgttgttgccggagacgggtcggtcaagtcgtccgcaggtacatatacggcttggatggaagtaatagaaccggtttgggtagaggtaatacgctcctgcaaacgacccatttcttctgccaatgtcggttggtagcccactgcagacggcatacgacccaacaatgcggatacttcggtaccagccagggtgtaacggtagatgttgtccacgaagaacaatacgtcgcggcctttgccgttttcgtctttttcgtcacggaagtattccgccatggtcaaaccggtcaatgcgacgcgcaaacggttgcccggaggttcgttcatctgaccgtaaaccattgccactttatccaatacgttggaatctttcatctcgtggtagaagtcgttaccttcgcgggtacgctcacccacgcctgcgaacacggacaagccgctgtgcgctttggcgatgttgttgatcaattccatcatgttcacggttttacccacaccggcaccgccgaacagacctactttaccgcctttggcaaacggacacagcaagtcaatcactttaatgcccgtttcgagcaattcggttgtggaagacagttcgtcaaacttaggggcagcttggtggatggcacggctcttgtcggtatcgatcggacctgcttcgtcaacaggcgttcccaatacatcgacaatgcgtcccaacgtacctttacctaccggcacagtaatgggcgcaccggtattgctcacagtcatgccgcgtttcaaaccgtccgagctgcccatcgcaatggcacggactacgccgtcgcccaaaagctgttggacttccaaagtcagaccgttttcgtctaatttcaaagcgtcgtaaacgcgcggaatcatgtcgcgtggaaattccacgtcaacaaccgcaccgataatttgtacgattttgccttggctcattatcgtatcctaatttccgtacaggattcagacggcatcagacagccgccgcacctgctacaatttctgacaattccgtggtaatcgcagcttgacgcgatttgttatataccaaacgcaactctttgatggcattgcctgcattgtctgttgcagctttcatggcaaccatgcgggctgcctgttcggatgccatattgtcgctcaacgcctgataaaccacagactctaaatagcggcgaaccagatattccaacactgcaagtgcagtcggttcgtagcggtattcccagctgaacggtgatttgggagctgaatcgccaatcacgttctcaccgataggcagcaatacttccattctcggttcttgacgcatggtattgacaaaacccgaatacaccagatggattctgtcaatttcatgtttctcataccgttggaagagttctgtcaaaggtccgagcagcatttccatttttggggtatcgcccaaatttacggcactggcaaccacattcagaccaatgctctgacacgccatcagacctttactgccaaagcatacgatttcctcttcaataccttgattccgatactcttgaacttgtgccaaaaactttttcagcacgttggcgttcaaaccgccacacaaacccttatcagacgtaatcaaaataaaaccgacacgtctgatttcccgatgagattccagtaacggaataccatgatcggtattggtttgcgcaagatggctcatcaccatacgcactttttcggcatacggacgcgccaaacgcatccgttcctgagtcttccgcattttagaggttgacaccatctgcatcgctttagtgatcttttgggtattctgaacactgcggattttggtgagaatctcttttcctactgccatttcagactcctttcacttcaagccttatgcctgataggcgtaagaagatttgaaggatttcatggctgcttcaagcgttttctcgctctcgtcggacattgcacctgaagcattgacggcttccaaaacttccggatgttgggtacggacaaagctcaaaaattcagattcaaaagccagagctttggcaaccggaacatcagaatacgaaccgttgttgattgcccaaagggtcaaagccatttcagccgtattcaacgtactgaactgtttctgtttcatcagttcggttacgacttcgccatgctccaattgtttgcgcgtagcttcatccaaatcggatgcaaattgcgagaacgccgccaattcacgatattgtgccaacgccaaacggataccgccacccagctttttaatcactttggtttgtgcagcaccgcctacgcgggatacggaaataccggcattgattgcaggacggataccggcgttgaagaggtcggtttccaagaaaatctgaccgtcggtaatcgaaatgacgttagtcggaacgaaagcagatacgtcgcccgcttgggtttcgataatcggcaacgcggtcagagaaccggttttgccttttacttcgccgttggtcaatttctccacttcgtgttcattgacacgtgccgcacgttccaacagacgggagtgcaggtagaacacatcgccgggataggcttcgcggccgggcggacggcgcaaaagcagggaaatttgacggtaagccacagcctgtttggacaaatcgtcataaacaatcaaggcatcttcgccacgatcgcggaagaattcacccatcgtacaaccggagtaaggtgcgatatattgcaatgccgccgcttcagatgcagttgcagcaaccacgatggtatgctccatcgcgccatgctcttccaatttgcggaccacgttggcaatagaagatgctttttgaccgatagcgacatagatacagataacacccgtacctttttggttgacgatggcatccaatgctacggccgttttacctgtctgacggtcgccaataatcaactcacgctgaccgcgaccgacaggaaccatagagtcaatcgccttcagaccggtttgcatcggctggtcaaccgatttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatgtgttcgtactcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaattaccgtaccacaggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcaccaactcgccgacctgtttgtcggtcaacggataggcactgtaaatgacggcagatttgatatggttgaatgataaggtcaagtcttgatattgagcatatacttccggcaatatcgacaaacgtttctgcccggccaagacgataacaaagtttttcaactccttgtctttcaaaccgaccaaatcgatgaggatatctgctttttctgaagcattcgtttcaggacggtcaatcaatgaagccaccttcccttcctgaacaaccgccgcaagtttttccagtccgcccaaccaagactcaatttggtttttttcctgagccagaccgaacaatgcctttgcataaggtctggcaatcgttgcgaactctgccataagattacagctcctgtttcagggtatcgagcagttttgcgtgtttggaagcatcgacttcgctgcgcaaaatagattcggcacctttgacagccaacacggcaacctgctcgcgcagggattcgcgtgcgcggaacaattcctgctccacatcggcctttgcctgagctgcaatgcgcgccgcctcggaagaagcctgttctttggcttcttcgacaattttggcggcacgtttttcggcgttggcaaccatttcggaaacctgattacgcccttctgccaagagttctgcaacctttttttcagcctgctcaaaatcgcttttaccacgctcggcggcagccaagccttcggcgacttttgcggcacgctcatccaaagcttttgcaatcggcggccacacgaatttcatggtaaaccataccaaaccgaaaaagacgatgatttgagcgaataatgttgcattgatattcacgttacttaaccttcgtactggggttaatcaaacaggctgcgcctgtacggaacggacgaatccgtcctgattatgcacctgcaaacgggttaacgaaggcgaacagcagtgcaatggcgacaccaatcaagaatgcggcatcaatcaaaccggcaatcaggaacagtttggtttgcagcggaccgatcagttcgggctgacgggcagaagactccaaatatttagaaccgaccattgcgataccgatagaggcacccaatgcacccaatgcaacgatcaaaccacatgcgatagcaatcaaacccattttaaactccttaaagaaacaaaggttaaactacaaaaacaaactacttaggaaaatcagtgcgcatcatgtgcctgtccgatatagacgaacgccaacgccatgaaaataaacgcctgcagggtaatcaccaaaatatggaaaatcgcccatgccaaaccggcaataatgtggaatacaaacagaatcggatccatgacttcgacgctgccggaagccgcccaagcaccgccaagcaaggctatcaacaagaataccaattcgcccgcatacatattgccgaacaaccgcataccgtgggatacggttttagaaagaaactcgaccaaattcaacagaaagttcgcaggtgcgagttttgcaccgaacggcgcgctgaacaactcgtgaaaccagccacccaatcctttgattttgatgttgtaatagatacaaatcagcaacacgccgacagcgagtgccaaagtggtgttcaaatcggcagtcggtacgacgcgcagcagggcgtgatggttgccggtaatgccctgccataccatcggcagcaaatcgaccggcagcatatccatcgcgttcatcagaaaaatccagacaaacagcgtcagacccaacggcgcgacggcttttctagacttttcgttgtgaatgatgctcttacacatatcgtccacaaactcaaacaagatttccactgcggcctggaaacgtccgggaacgcctgccgtcgctttttttgcaccgcgccacaacagaaagctgccgattacgcccaacaggacggcaaaaaagacggcatcaaggttaataaacgaaaaatcagcaatgtttttcagtccctgaccctgagtaacatccgacaaactggtcaagctctgcaagtggtgcttgatgtagtcggcagcggtaatggtttcacctgccataatctttcactctcaacaatactaaaaaaaccaaatggctgacaccgagcagccccatcagaaacggggcgaacaccagcgattgatgccatattgcaaatacggcaagcatggacaacagcgacagcactacttttaaaatctctccgaagacgaacatcctgctttgcaggaaggggtttcccctgaaaagttttaaaagtaaaactgcaacaaacgtgggaagcaggtaggacaaaccgccaccgaccgccgaaaggaatccggcaaaaccccatacagcaaaggcaactgcggcgcatatggacaatacggcggattgtaggatgataatctgcttcataaagggaatgtttccgcctcggatttggggcgcggctaatataatttagaagccttattacgtcaagcgacagttaatctttgtgaaacaacgtatcccaatccgccgcgctcgccgcctgaataacggcgacaggtgtcattctaacacacattacatataattacaggatattaaggagtttgtccgcaatttctttacatttttaatgttcttacgtgatttgtttgctttacgtggaaataataaaaaatcaacgcgaaattgtagcagtttatcggtcggattgtcggcagtttggggaatttgctcaataaataaaaggtcgtctgaaaatattttcagacgaccttttccgaataaaggattagcaactgcctgccgctttaagcaaagcattgcattgacttttgcctttgtgcgttccgcctcccaaacaaattgcatcggaagtggtaacgccgattgtgctgattacactggtaacatagcattggctcacgcgcttacccacagttgcggtaaagttgatgcgtatgccttcattgttgcggttgctgatttttacggcatttgggctgacgcccaaggcaaacgcggcacgttcctgaagtttctagtcggaaacggttacattattgattgagccgcaacctgctaatgccaacgcaacgaacgcagccgaaacgatgatgcgtgtgttcataatttcctcgaaaattaaaaatgaaaacaggaaaacgattcttacgtgaagcagaaaaaatgtcaatagaattatatttcccacttaaaatctggaaagctattctctatatttcagacggtatatcccgcaaaattaaggccggtaatctatgcccaactgctccagcaggtggccgaacgtttcaggcgtatcgaaatacaggacaatcctgccttttttgtggttggcggttttgacttcagcgttgacacccagtttttcagtcagcaaatcattcaggcggccgatgtcggcggcggcagtctttttgggctcgggacgtttgttttgaagggcggcctggctgcggcgttcgacttcgcgcaccgaccagccgtttttgacggccttttgcgccaattcgagctgttcgacgagttttcggagaggaccatgcgcgggcgtgccccatttc

SEQ ID NO: 5 - DNA, 49646 bp, Neisseria meningitidis
cagacattaccgtgtacaacggccaacacaaacgaagcagcacaagccgttgcagatgcctttacccgggctaccggcatcaaagtcacactcaacagcgccacacgcgaccagcttgccggtcaaatcaaagaagaaggcagccgaagccccgccgacgtattctattccgaacaaatcccggcactcgccaccctttccgccgccaacctcctagagcccctgcccgcctccaccatcaacgaaacacgcggcaagggcgtgccggttgccgccaaaaaagactgggtggcactgagcggacgttcgcgcgtcgtcgtttacgacacccgcaaactgtctgaaaaagatttggaaaaatccgtcctgaattacgccacgccgaaatggaaaaaccgcatcggttacgcccccacttccggcgcgttcttggaacaggttgtcgccatcgtcaaactgaaaggcgaagcggccgcattgaaatggctcaaaggtctgaaagaatacggcaagccttacgctaaaaactccgtcgcccttcaagcggttgaaaacggcgaaatcgatgccgccctcatcaacaactactactggcacgcttttgcgcgtgaaaaaggcgtacaaaatgtccacacccgcctgaatttcgtccgccacagagatcccggcgcactcgttacctattccggcgcagccgtgttaaaatcctcccaaaacaaggatgaggcgaaaaaattcgtcgccttcctcgccagcaaggaaggacagcgcgccctgaccgccgtccgtgccgaatatcctttgaatccgcacgtggtatccactttcaatttggaacccatcgccaagttggaagcaccccaagtgtccgccaccactgtttccgaaaaaraacacgccacccggctgcttgagcaagccggtatgaaataagccgttttcggattgtcaaacgggtggacatttatactgtccgcccgttttgccgataaaaaacactatgtctcctaaaaaaatacccatttggcttaccggcctcatcctactgattgccctaccgcttaccctgccttttttatatgtcgctatgcgttcgtggcaggtcggcatcaaccgcgccgtcgaactgttgttccgcccgcgtatgtgggatttgctctccaacaccttgacgatgatggcgggcgttaccctgatttccattgttttgggcattgcctgcgcccttttgttccaacgttaccgcttcttcggcaaaaccttttttcagacggcaatcaccctgcctttgtgcatccccgcatttgtcagctgtttcacctggatcagcctgaccttccgtgtcgaaggcttttgggggacagtgatgattatgagcctgtcctcgttcccgctcgcctacctgcccgtcgaggcggcactcaaacgcatcagcctgtcttacgaagaagtcagcctgtccttgggcaaaagccgcctgcaaacctttttttccgccatcctcccccagctcaaacccgccatcggcagcagcgtgttactgattgccctgcatatgctggtcgaatttggcgcggtatccattttgaactaccccacttttaccaccgccattttccaagaatacgaaatgtcctacaacaacaataccgccgccctgctttccgctgttttaatggcggtgtgcggcatcgtcgtatttggagaaagcatatttcgcggcaaagccaagatttaccacagcggcaaaggcgttgcccgtccttatcccgtcaaaaccctcaaactgcccggtcagattggcgcgattgtttttttaagcagcttgttgactttgggcattattatcccctttggcgtattgatacattggatgatggtcggcacttccggcacattcgcgctcgtatccgtatttgatgcctttatccgttccttaagcgtatcggctttaggtgcgattttgactatattatgtgccttgccccttgtttgggcatcggttcgctatcgcaattttttaaccgtttggatagacaggctgccgtttttactgcacgccgtccccggtttggttatcgccctatccttggtttatttcagcatcaactacacccctgccgtttaccaaacctttatcgtcgtcatccttgcctatttcatgctttacctgccgatggcgcaaaccaccctgaggacttccttggaacaactcccaaaagggatggaacaggtcggcgcaacattggggcgcggacacttctttattttcaggacgttggtactgccgtccatcctgcccggcattaccgccgcattcgcactcgtcttcctcaaactgatgaaagagctgaccgccaccctgctgctgaccaccgacgatgtccacacactctccaccgccgtttgggaatacacatcggacgcacaatacgccgccgccaccccttacgcgctgatgctggtattattttccggcatccccgtattcctgctgaagaaatacgccttcaaataacagcttgaggaagtaccgccatgaccgccgccctgcacatcggacacctgtccaaaagttttcaaaacaccccagttttaaacgacatttcgctcagcctcgacccgggcgaaatcctctttatcgtcggcgcgtccggctgcggcaaaaccacccttttacgctgccttgccggttttgaacaacccgattttggcgaaatttcgctttccggcagaaccatcttctcgaaaaataccaacctccccgtccgcgaacgccgtttgggttatgtcgtacaggaaggtgtgctgttcccccacctgaccgtttaccgcaacaccgcctacgggctgggcaacggcaaaggcaagacggcgcaagagcggcagcgcatcgaagctatgttggaattgaccggcatttccgaacttgccggacgctatccgcacgaactttcgggcggacagcaacagcgcgtcgccctcgcccgcgccctcgcacccgatcccgaactgattttgttggacgaacccttcagcgcgctggacgaacagttgcgccgccagattcgcgaagacatgattgccgccctgcgcgccaacggcaaatctgccgttttcgtcagccacgaccgcgaagaagccctgcaatacgccgaccggattgccgtgatgaaacaggggcgcatcctccaaactgcaagccctcacgaattgtaccgacaacctgccgaccttgatgccgccctgtttatcggcgaaggcatcgtgttccccgccgcgctcaacgccgacggcaccgccgattgcggattgggccgcctgcccgttcaaagcggcgcacccgcaggcacacgcggcacactgctcatccgtccggaacagttcagccttcacccccattccgcacccaccgcctccattcacgccgtggttctcaaaaccacgcccaaagcgcggcataccgaaatcagcctccgggtcggacaaaccgtcctcacgctcaacctcccttccgcccccaccctgtcagacggcatttccgccgtcctccatttggacggtcccgccctgttcttccccggaaataccctctgaaaggcggcagcatccacaagcctgcggatatttatcttgttggaaacagaatttgtttgctatattcaacctgcgcgcctcaagccaaacacggcacgcacggcacgcaggcagccgtttctgcctatatgccgccccttccaaccacatatgccgcacaccgcagcatacgaaaggatatatcatggcaaaagtactcatcgtacccgtatctgccggactggacgcctccgccgccgcacaagcctttgcaaaagcactggacgcacaaattttccaagccgttgacgcaaccgccgaaaccctgctcgcgcaaggcaaaagcgacgactggttcgacgcactggtcggcaaagttgccgcactcgatgccgccaacctcgtcatcgaaggcatcgcgcccgatgccgacaaaatctacctcgcaggcaaaaacgtcgaactggcattgtcccttgacgcggcagccgtcttcgccgtccgttccgacaacgccgatgccgacgaactggcaaatcgggtgaaccttgccaaacagttcttcgccgccgcgccgggcgtattggaaggttttgtcgtggacggcgcggcagcctccgttgccgaagcggcagccgaaaaaaccggcctgaccttcttcggttcgagcgacgcgctgaaagacgtatccgtattggcaggccgcgaagcaaaacgcctgtcgccggcgcaattccgctacaacctgatcgacttcgcccgccaagccgacaaacgcatcgtcctgcctgagggcgcagaaccccgcaccgtccaagccgccgccatctgccacgaaaaaggcattgcccgctgcgtcctgcttgccaaacgcgaagaagtcgaagccgttgccaaagaacgcggcatcagcctgcccgactctttggaaatcatcgatcccgcctcattggtcgaacaatacgtcgagccgatgtgcgaactgcgcaaatccaaaggcctgacacccgaagacgcgcgcaagcaactgcaagacaccgtggtactcggtacgatgatgatggcgcaaaatgatgtggacggtttggtatccggtgcggttcacaccaccgccaacaccatccgccccgctttgcaactgattaaaaccgcaccgggcgcaagcctcgtgtccagcgtattctttatgctgctgcccaaccaagtcctcgtcttcggcgactgcgcggttaatccgaacccgaccgcgcaacagcttgccgacatcgccatccagtctgccgattccgcaaaagccttcggcatcgacccgaaagtggcgatgatttcctactccaccgtcaactccggcagcggccccgatgtcgataccgtcatcgaagcaaccaaacttgcccgggaaaaacgccccgacctcgccatcgacggcccgctgcaatatgatgcggcaaccgtgccgggtgtgggcaaatccaaagctccgggcagcccggtggcaggacaggcaaccgttttggtcttccccgacctgaacaccggcaactgcacctataaagccgtccaacgcaacgccaacgtcttaagcgtcggcccgctgctgcaaggcctgcgtaaaccggtcaacgacctctcccgcggcgcactggtagaagatatcgtgtttaccatcgccctgactgccgttcaggcaaaacaaatggaaggctgacaaacggctttccgggtttaaaccctatgccgtctgaagacagactcccgttttcagacggcatttttatcagcacggcacatttgtttgttaaaatcgcagccatattgcaaaaaaagaggaggaagccatgcaaaccgccattatcgattacggtatgggcaacctgcattccgtattgaaatccgtccggacggcggggcagcttgccggaaaaaataccgaaatctttttaagcggcgaccccgaccgcgtgtcccgcgccgacaaagtcatttttcccggtcagggcgcgatgcccgactgtatggcggcattaaaacgagacggtttggacgaggcagtcaaagatgccttaaaaaacaaaccgtttttcggaatctgcgtcggcgcgcaacttttattcgaccacagtgaagaaggaaacaccgacggcttgggctggttcggcggcaaagtcagacgctttgagcgcgacctccgcgacccgcagggatgccgtctgaaagtcccgcatatgggctggaacaccgtgcgccaaacccaaaaccacccgctgtttaaagatattccccaagacacgcgtttttacttcgtccacagctactatttcgcccccgaaaatcccgaaaccatattgggcgaaagcgactacccgtccccgtttgcctgcatcgtcggcaaagacaacgtattcgccacgcaatttcacaccgaaaaaagccacgatgccgggctgacgatgttgaaaaactttttaaactggtaagccggacacggccccgcacaaggagaaaaattatgctgctgatacccgccatcgatttgaaagaaggacgctgcgtccgcctgaaacaagggctgatggaagaggcgaccgtcttttccgattcgcccgccgaaaccgcgctgcactggttcaaacaaggcgcgcgccgcctgcatctggtagatttgaacggcgcgtttgccggcgttccgcaaaacctgcccgccatcaaagacatccttgccgctgtcgccaaagacatccccgtacagctcggcggcggcatacgcgatttgaaaaccatcggacaatatttggatttgggcttaaacgacgtgattatcggcacggcggcggtcaaaaaccccgacttcgtgcgcgaggcgtgcaaagccttccccggcaggattattgtcgggctggatgccaaagacggtatggccgccatcgacggctgggcaaccgtaaccgggcatcatgtaattgatttggcaaaacgctttgaagacgacggcgtcaacagcatcatctacaccgacatcgggcgcgacggtatgatgagcggcgtgaacatcgacgcgacggtcaaactcgcccaaaccgtccgcattcccgtcatctcctccggcggactgaccggcttggacgacatccgcgccctgtgtgccgccgaaaaacatggcgtagcaggcgcgattaccggccgcgcgatttacgagggtagcatcgattttgcccaagcgcagcaactggcagattccctcgactaaaggcatccgattatggcactggcaaaacgcatcatcccctgtctcgacgtaaaagacgggcgcgtcgtcaaaggcgtgaacttcatcggtttgcgcgacgcgggcgaccccgtcgaagccgccaaacgctacaacggcgaaggcgcggacgaattgaccttcctcgacatcaccgcctcatccgacaaccgcgacaccatcctgcacatcatcgaagaggttgccggacaagtcttcatccccctgaccgtcggcggcggcgtacgcaccgttgccgacatccgccgcctgctcaatgccggcgcggacaaagtcagcatcaacaccgccgccgttacccgtcccgatttaattgacgaagccgccggatttttcggttcgcaagccatcgtcgccgccgtcgatgccaaagccgccaaccccgaaaacacacgctgggaaatctttacccacggcgggcgaaatccgaccggtttggatgcggtggaatgggcggtcgaaatgcaaaaacgcggcgcgggcgaaatcctgctcaccggtatggacagggacggtacgaaacagggtttcaacctgccgctgacccgcgccgttgccgaagccgtcgacatccccgtcatcgcctccggcggggtcggcaatgtccggcacctgattgaaggcataaccgaaggcaaagccgatgccgtacttgccgccggcattttccatttcggggaaatcgccatccgcgaagccaaacgcgctatgcgcgaagccggcatcgaagtgcgcctctgaccgcctcgactatgccgtctgaaaggaaatatggataaaaacctgcttgaagccgtcaaatttgacgaaaaaggtttggtttgcgccatcgcccaagatgccgaaaccaaacgtattttaatggtggcgtggatgaacgccgaagccctgcaaaaaaccgtcgaaaccggctttgcccactattacagccgttcgcgccaaaaacaatggatgaagggcgaagagtcgggacacacgcaaaaagtccgcgcactgcgcctcgactgcgacggcgacgccattgtgatgctcatcgcccaaaacggcggcatcgcctgccacaccgggcgagaaagctgcttttacaaagtctggcgtggcagcgcgtgggaaaccgccgatgccgtcctgaaagacgaaaaagagatttacggcagcacgcactgaccgcctccaacattgaattatcaggcatttttttgtacaatttcgccgtctcaaacactgtccgggccgtctgaaaagcggcctgaacctttttgcaaagaaaaccatgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaaaaagcaatcggcgataaaatgccgtctgaacccgaaaaaaggctttcagacggcatttttgcctgcaactcaaatgcaccgatcaaaatcaagacgcatcggataccgttatcgggcatcccgtcctcatgaatttagggctgacgcaagaacgctggccggacatcgtgttccacgaaacgcgcgaacattcggtcaaactttaaaaaacaatcggcaataaaatgccgtctgaacccgaaaaaaggctttcagacggcatttttgcctgcaattcaaacgcagacggtcaaaatcaaggcgcatcggataccgttatcggatgcgtcccatccgcatgaatttggggctgacgcaagaacgccgatgtgatttcacatcccgtactgtttcgacagcttcacataatgcgcggcggaatatttcaaaaaggctttttcctcatcggtcagcacgcgcacctgtctgaccggcgaaccgacataaagatagccgcccgccaagcgtttgcgcggcggaacgaggctgcccgcgccgatcatcacttcgtcctcaatcacggcatcgtccagaaccgtcgtccccatgccgaccaggacgcggttgccgatacggcagccgtgcagcatcactttgtgccccacggtaacgtcttcgccgataaccagcggcgatccttcgggtttggcggcggttttgtgggaaacgtgcaagacgctgccgtcctgtatattgctgcgcgcgccgacggtgatgctgttcacatcgccgcgcaacacggcgcacggccacacggaaacatcttcggcaagcgacacttcgccaatgacgacgcaggcttcgtctatcatacaggtttcgtggatttcgggcgtgcggttttggaaagttcggattgcgttcatttttcctccttcggtaaggtatatattgttaaaggatttattaaatattccccctgattgcttttaaaatcctgcctgtaatatcgaccccgagtaatgtgattatcgggaatatcagcttatatatcaatttattggactttaacagcataaaccttaaatgatacgcccttctttttatatcagcatcacactctatatttttactcgtcattataaaaagcaaaacgagatattcgtaggaaagaaaagaataaagataactcgatatatccctattaaattccatttccgcatttttctccaaaatatataataatgactttatacttttttccgaaacagttcccgtaatagaatcttttcttccctgccgataatagtaataacaaccgtccaaataagaaaaagttgttgccgcattaaataacctcattgaccattcgatatcttcagaataaattcccctttcaaaaaacagtttttctctaataatcaattctctttttataatcttattccacgccgaacccggaaattttctaaatcggcataatcctttcaaaacttcgactttggattgattgagtattttttcaggctgataatcttcgccaaaatatgaaacacttcccttatcatatttaaccgcatttaaaaacaccacatccggcatatcagtatcatctttactaagaaaatccagcaaaatctgacagttaataaaatcatccgaatcaataaagactatatattttccgtttgaattttttattccggtatttctcgcctccgacaacccttggttatcctgatatatatatttgatatttggtgtccggtgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgctgtttgatattttatctatatatttgtaacatatatcttcacttccgtcttttgacccgtcattcacaaggataagttcgacattttcattacttaatatagattctatggaacttaaacacgcttccaaataactttcgacattataaataggaactacgatacttaaatccatatctttctcattttactaaatcattttaatcttaacccaatcataaccggcaggaggggaaacgcccccctgtttgataacggacgcgccgtttcctgccgcccgaaaggtttcagacggcagggattccggttatttgcccgctttgagcccttgccacagcttcacgcccagtttgacggattctgcggatttgggcgatacgatgaaacttttttccatcagttctttgttcgggaaaatcgatgcgtcggaggtgtatttttcatccatcagctcgcgcgcgggacggctggcgggcgcgtaggtaacgaagctgccgtttttcgccgccacctcgggccggagcgtgtagtcgatatagcggtgggcattggcaacgttttgcgcgtcgcgcggaatcataaaggaatccacccacacgcccacgccggttttcggggtcaatactttgatttccacgccgtttgcggcttcttcggcacgggttttggcaatgttcaaatcgccgccgtaaccgatggcggcacacaggttgcccgccgccatatcgtcgatatagccggaagagctgaagcgtttcacgtcgccccggacggctttcatcatatcgacggcggctttgatgtcttcgggattctcactgttggggtctttgcccaaatagtgcaacgccaagggaatctgttcgattgcgctgtcgaaatagctgatgccgcaggatttgagtttggcggtgtattcgggtttgaacaccaaatcccattcgttttcgggcagcttgtccgtacccaatgcttttttcacctgctgggtattgattgccaaggtattgatgccccagaaataggggacggcgtattcgttgcccggatcgacggcttccatcattttcagcaaatctttatcgatgttgccgtaatgggggatttgcgccttgtcgattttctgatacgcgcccgctttgatttgccggccgacgttggcgatggacggcgcggtcaggtcgtagccggatttgccggtcaggacttttgcctccagtgtttcgttgctgtcgtaataatcggaacgcgtcttgatgccggtttctttttcaaaggcggcaacggtttcgggatcgacataatccgaccagttgtagatgttgagtttgcccgattgttcggcttcgggcttggcggagggggtttgggcggcggtatcgcttccgccgccgcacgcagtcaaggcgaggctcaggattgccgccgccaccagtgtttttttcatggttttcgacctttcgttcaaaaataaaaaacattgcagggacggacgggccgcctgcatcggaagctgtgggggcggccggtcggctttcttggcccttggtgcagcaaggtttgcattaaacggcaaaaacagccggggcgcaaccgttaattttcaccggtttgccgttccggtgcccgatcgggcggtaatgcgggacattgttccgcctgcgtaaaaatgccgtctgaagcctcggcggctttcagacggcatcggggcggacggcatcagttgctcaacacgtccacgcctttgggcggggtaaacttgaacgcgccgcgcgagagttggggattggtattcaaaccgccgaaactgatggaggtttggttgccgaagctgtctttaagctgcatggcggcgaggttgccgcctttgaagccgatgcggatgtattggtagccggcgttgttgcgtttgggcgttgccagcacataatcgatgccgttggacgaaccgtcctctttcagcgtgtagctgctttcgagggcggttttgttcgacaggatggcggcggggctgccgcctatggcctggtcttgggacgacttggtcacttgtgccagatcaacatcgtagagccaaacggtttgaccgtcgccgacgatggtttgcctgtaaggtttggtgtattcccatttgaaaaggcccggtcgcaggattttgaacgtgccgtgcgcggtttgggttttctttttgctttggacggtttgggtgaagctgccgctgataccgtcggcatcgttgttgaattgcttaagcgcgtctaccgcgcccgcctgtgcggaagcgacggcgacggtcagggagcaaacggcgaggaattggaacaggttgtgcggtttcatcattatttttccttgtcgggatgagtgtggcgtaaagtatcggcgcagcaaaacaatcatacgggcggcgttacgggcggtttgcattttgcaaaccgcgttttccgagggctgattttttgcccaccggaaaaggcggcgcgccacgctgccctttaatgtgtgccgcgttatagtggattaacaaaaatcaggacaaggcgacgaagccgcagacagtacaaatagtacggagccgattcacttggtgcttcagcaccttagagaatcgttctctttgagctaaggcgaggcaacaccgtactggtttttgttaatccactatatttgacggtttgggcgcggaatgccgaatcgcggagattatatgcctcatcttgttttttttaaacgctataatatttgttttccgaacacggcggacttgagatgaaacccgatatttatgctttgctggaacgcgccctgctttcgggcgacccagatgaaaaaggacggctgacggatgaggcgtttgccgccgttcaaaatgcggacggggcggaaacaaacgcaccgccggcggacttcccccgcgcgggacgaccggacaagcctgttttggtcgcgccgtcgcagctgacgccacgcaaaatgaacacaaccgaaggctatgcggcgatgctgcacgcgattgcgcatatcgaattcaacgccatcaatctggctttggacgcggcataccgtttccgcacgctgccgtttcagtttgtccgcgactgggtgaaagtggcgaaggaagaggtgtaccatttccgcctgatgcgcgaaaggctgcgcgctttcggcttcgattacggcgattttgaagcacacaatcatttatgggatatggcatacaaaaccgcctacgatcctttgttgcgtatggctttagtgccgcgcgttttggaagcgcgcgggctggacgttacgcccggcatacgcgcgaaggtggcgcagcgcggtgattcggaaacctgcggcgtgttggacatcatttaccgcgacgaagtgggacacgtcgccatcggcaaccggtggtatcaacacctttgccgcgaacgcggtttggagcctgtcgccctgttccgcagcctgattgcccgttacgatatgtttatcttccggggctatgtgaacatcgaagcgcgcgaaaaagcaggcttcagccgctttgaattggatatgttggaagatttcgagcagggtttgaaacaaaataaacatgccgtctgaaacccttcgtcccgcactttataaaaaaggaacacacatgatacaagccgtattgttcgacctcgatggcacgctcgccgacaccgccctagacctcggcggcgcactcaacaccctgctcgcccgccacggactacctgcaaaaagcatggacgaaatccgcacccaagccagccacggcgcggcaggactgatcaagctcggcgcaggcatcacccccgaccatcccgactatgcccgatggcgcaccgaataccttgacgaatacgacagccgctacgcccaagacaccaccctcttcgacggcgtaaacgaactcatcgccgaactcggaaaacgcggcatcaaatggggcatcatcaccaacaaacccatgcgcttcaccgacaaactcgtccccaaactcggcttcatcatcccacccgccgtcgtcgtcagcggcgacacctgcggcgagcccaagcccagcgtcaaacccatgctgtatgcgtgcggacaaatccacgccgacccgcaacacacactctacgtcggcgacgcggaacgcgatatacaggcggggcgcaacgccggtatgacgaccgtcctcgccgaatggggctacatcgctcccgaagacgataccggctcatggcaggcggatttccacatccgcacgccactcgatctgctcgaatgtctggacaaaatacagccctgaaaaatatccgccccacaaacatatagtggattaacaaaaaccagtacggcgttgcctcgccttagctcaaagagaacgattctctaaggtgctgaagcaccaagtgaatcggctccgtactatttgtactgtctgcggcttcgtcgccttgtcctgatttttgttaatccactataaaactgccgtctgaaacctgatttcagacggcagttccgccttcaaaccgaatcaaagcccgtcaaaacctgcgtttgagcttgcacgcctgaaggatgtgtaccgccaattcctcaaccgacttatccgtcgtattcgcaaacggaatcccatgccgtctgaacatactctgcgcgtccgccacctcgctgcggcatgtatcgattttggcataagttgaattcgggcggcgctcttggcggatggcctgcaaacgttccggctggatggtcaacccgaacagcttatccctataaggcttgaccatacgcggcagatcggccgattccaaatcgtcgggaatcagcggatagtttgccgcacggatgccgtattgcagggcgaggtaaaggcaggtcggcgttttgcccgaacgcgatacacccatcaagattacatccgcttcctgaaggttcttatcgctgaccccgtcgtcgtggttcaaagaaaaattgaccgcttccatacgcgcatcataacgcttcgtattaccgatactgtgatgcccctgcccggatgccgtggcttcggtattgagttccttctccaacagtcccaaaaaagtctcaaagaaattaatctgaaaagcatccgcccctttgataatccgacggatttcgtcatcaaccacactgacaaacgcaatcggacgctgaccgttttcctgccggctccgattgaccttctccaccaccgcgcgcgccttttccggcgtatcgacaaacggatgcgtatggcgtttgaacgacagattgccaaactggttcagcaacgcctcgccgatattctcagcagtcagaccggtacggtcggaaatgtaaaacacatggcgcggactgctcatcttccatccttaaaacacaggtttaaaatcccatcataacagcagcagcagacacaaggaaagcacccgcagcacacctacctcggattacacccaaacagacacaatataattttgaaataaaattatttatataaagtattttttggcagaaaattttaaaaaataaacaaaaaaatcaaacagaaaaaacattaacctattcaaaccacctgttttacaaagaaaatacccaaaaaaagaagtataccggctgtaagtttcaaaccgctacacacgccgaaaccgcaatttttcagacggcatcatgattttaaaacggataaaacacatgacagcagaggaacgaatcgcttaaaataagcacgcggatttgtttcttttttaacatattttggattggacacacaaatggccgacaactacgtaatctggtttgaaaacctgcgtatgacagatgttgaacgcgtgggcggtaaaaacgcctcgctgggcgaaatgatcagtcagctgaccgaaaaaggcgttcgcgtccccggcggctttgccaccacggccgaagcctaccgcgcattcctcgcacacaacggtctgagcgaacgcatttccgccgcactggcaaaattggatgtcgaagacgttgccgaactggcacgcgtcggcaaagaaatccgccaatggattttggatacgcctttccccgaacagctcgatgccgaaatcgaagcggcatggaacaaaatggttgccgatgccggcggtgcggacatttccgttgccgtacgttcttccgcaactgccgaagacctgccggacgcatcattcgctggacaacaggaaaccttcttgaacatcaacggcttggataacgttaaagaagcgatgcaccatgtattcgcttccctgtataacgaccgtgccatttcttaccgtgtccacaaaggcttcgaacacgacatcgtcgccctttccgccggcgttcaacgcatggtgcgttccgacagcggcgcatcaggtgtgatgttcaccctcgacaccgaatccggctacgatcaagtcgtctttgttacctcctcttacggtctgggcgaaaacgtcgtacaaggtgcggtcaacccggacgaattttatgtgttcaaacccacgctcaaagcgggcaagcccgccatcctgcgtaaaaccatgggttcaaaacacatcaaaatgatttttaccgacaaagcagaagccggtaaatccgtaaccaacgtcgatgtccccgaggaagaccgcaaccgcttctccattaccgacgaagaaattactgagttggcgcattacgcactgaccatcgaaaaacactacggccgcccgatggatatcgaatggggacgcgacggcttggacggcaaactctacatcctgcaagcccgtcccgaaaccgtaaaatcccaagaagagggcaaccgcaacctgcgccgcttcgccatcaacggcgacaaaaccgtattatgcgaaggccgcgccatcggtcagaaagtcggtcagggcaaggtgcgcctgattaaagatgcttccgagatggattccgtcgaagccggcgacgtactcgttaccgacatgaccgatccggattgggaacccgtgatgaaacgtgcttctgccatcgttaccaaccgcggcggccgtacctgccacgccgccatcatcgcgcgtgaattgggcattcctgccgttgtcggctgcggcaatgcaaccgaattgctgaaaaacggtcaagaagttaccgtatcctgtgccgaaggcgataccggctttatctatgccggtctgttggacgtacagattaccgatgtcgccttagacaatatgcctaaagcacctgtaaaagtcatgatgaacgtcggcaatcccgaactcgcattcagcttcgccaacctgcccagcgaaggcatcggcttggcgcgtatggaatttatcatcaaccgccaaatcggtatccaccccaaagccttgttggaatttgacaaacaagacgacgaattaaaagcggaaattacccgccgtatcgccggttacgcgtcccctgtcgacttctacgtcgataaaatcgccgaaggcgtggcgacattggccgcatcggtttatccgcgtaaaaccatcgtccgtatgtccgacttcaaatccaacgaatacgccaacctggtcggcggcaacgtatacgaaccgcatgaagaaaacccgatgttgggcttccgtggtgcggcgcgttatgtcgccgacaacttcaaagactgtttcgccttggaatgcaaagccttgaaacgcgtccgcgatgaaatggggttgaccaacgttgaaatcatgattccgttcgtccgcactttgggcgaagccgaagccgttgtcaaagccctgaaagaaaacggcttggaacgcggcaaaaacggcctgcgcctgattatgatgtgcgagctgccgagcaacgcggtattggcggaacaattcctgcaatacttcgacggcttctccatcggctcgaacgacatgacccaactgaccctcggtctcgaccgcgacagcggcttggtatccgaatcgtttgacgaacgcaaccctgccgtcaaagtgatgctgcaccttgccatctccgcctgccgcaagcagaacaaatatgtcggcatctgcggtcaaggcccgtccgaccatccggacttcgccaaatggctggttgaggaaggcattgaaagcgtttccctgaacccggataccgtcatcgaaacttggctatatttggcgaatgaattgaacaaataatcaatgcccatacccccgagcctgaaaagcgcgggggtatttttttccaagcagctccgctcagacggcatttcctgccgatgccccgtccgcgataatatttgacacccacgcgccgactgcctacaattcccccttccccgagcaaccggcaacggtcagcttcttctttcagacggcatctgcctgtctttttcctcttcaaaatacatcattattatgcacgtctccgaattacaaaccctgcacatttccaaactcttagaattggcggaagaacacggcatcgaaaacgccaaccgattccgcaaacaagacctcgtatttgccatcgtccgccagatgatgaaaaaaggcgagggtttcacctgctccggcacgcttgaaatcctgcccgacggcttcggcttcctccgcagcgcggacacgtcctatcttgccggccccgacgacatctatgtctcgcccacccaaatccgccgcttcaacctgcatacgggcgacaccatcgaaggaagcgtgcgcgtcccaaaagacaacgaacgctattttgccctggtcaggcttgataccatcaacggcgaccacccggaagtatgccgccataaaatcctgtttgaaaacctgaccccgctgtttccgaccgaacagttgaagctggaacgcgacttaaagtccgaagaaaacctgaccggacgtgccatcgacctgatttcccctatcggcaaaggtcagcgcgccctcttggttgccccgcccaaaagcggtaaaaccgtgatgctgcaaaacattgcccacgccgttaccgcaaactatcccgaagtcgaactcatcgtcctcttgattgacgaacgtcccgaagaagtaaccgaaatgagccgctccgtccgtggcgaagtagtctcctccacctttgacgagccggctcaacgccacgtccaagttgccgaaatggtgcttgaaaaagccaagcgtatggtggaacacaaaaaagacgtggtcatcctgctggattcgattacccgccttgcccgcgcctacaataccgtcgtgcctacctcgggcaaaatcctgaccggcggtgtcgatgccaacgcgctgcatcgtcccaaacgtttcttcggcgcggcgcgcaacgtggaagaaggcggttcgctgaccatcatcgccaccgcattggttgaaaccggcagccgtatggacgatgtgatttacgaagaattcaaaggcaccggcaatatggaattgcaccttgaccgccgtatggcggaaaaacgcctcttccccgccatcaacatcaacaaatccggcacgcgccgcgaagagctgcttgtcccaaacgaccagttacaacgtatgtggctcttacgcaagttcctgcacccgatggacgaaatcgaggcagccgaatttttaatcgggaaaatcaaagcctctaaaaacaacgacgatttctttgaactgatgcgcggcaaataaacgcgccgcccgcattaatgcgaaatgccgtctgaagcctgaaaatcgggtttcagacggcactttcattcacacggtcggcgcagctcctccctccccccgttaacggcgcaaccgtcggcagtgtccgtgtccgcttgccgaaagcgcggcctttgcaaagccggcttgaacgcatccgtaccggcaatgaaaaccgatgcgggaacttgattcaaggttgcgccgaaccgcactcatttttgtataaatttggggctgtcctagataactagggaaattcaaattaagttagagttgcccctatgagaaaaattcgtctaagccggtataaacaaaataaactcattgaactgtttgtcgcaggtgtaactgcaagaacagcagcagagttagtaggcgttaataaaagtacctcagcctattattttcatcgtttacgattacttatttatcaaaacagtccgcatttggaaatgtttgacggcgaagtagaagcagatgaaagttattttgctgaacgacaaaaccatatcaatggaattgggaacttttggaaccgggcaaaacgtcatttacgcaagtttgacggcattcccaaagcgcattttgagctgtatttaaaggggtacgaacgacgttttaacaacagcgagataaaagttcaaatttccattttaaaacaattagtaaaatcgagtttatcctagttatctaggacagccccataaatttttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatttccaattaaaaatttttaatatattaatcaataaattaattttataaaataaaaatattgtcaacaatattttgccttatcgcccaaacctctgtatattttcctacagtaaattgttgacaatccatacgcccacatatgcgccgcctaaggataaatcctcccgccggacaacgggtgcaagggatcggatgcgatatttccatattcaaacaagggattggcggcacatcggcaaaatccccgcgccgccccggtccggcagggcttgcgtccctcccggacaagccccgaccccgcctttccgaaagacgggctcaaccattaaggaaactttagtcaaaatgaaaaaacacatatgggcggcatctttgctgccggcatccctatcggcagaacctttaaactggtggaagccttattccgccgtcaattcgggcgataccgcctgggtgatgactgcggctgccttggtactgttgatgacgcttcccgggctggctttattctacggcggtatggtgcggaaaaaaaacctgctctcgacgatgatgcacagcttttccatcgcgacattggtgggcatcctttgggtcgccgtcggctattctttagcgttcacgccgggaaatgcctttatcggcggtttggggcgcgtatttttaagcgggatgcagatagacgctaccgcacagatgctgaccgtgtcgcccaatgcgccgactgttcccgaaccggtatttatgttttttcagatgacgtttgccattatttcgaccgccattattaccggcgcgtttgccgaacggatgaaatattcggcaatgatgctgttttcgggcatatggtttttattggtttatgtgccgggcgcgcattgggtgtggggcggcggctttatgagcaagggcggcgtattggattatgccggcggtacggtggtgcacatcaatgccggtatcgcgggactcgtcgccgccttggttttgggcaggcgcataggctacgggcgcgaggcgatgcctccgcacaatatggcgatgacactgatcggcgcggcaatgttgtggttcggctggttcggctttaacgccggatcggcgcttgcggcagacgcggcggcgggtatggcgatggcggtaacgcaggtgtcggccgtattcggcgcggcaggctggcttgcctgcgaaaaaatagcgggacacaaaccttccgctttggggctggcttccggcgcggtttccggtctggtcggcatcacccctgccgccggctttaccggcccgtcgggcgcggccgccatcggtatattgactgccgccgcgtgctttgtgtccgtcaccgtcgtcaaacacaaattgcgttacgatgattctttggacgctttcggcatacacggattcggcgggctggtgggcggaatattgaccggcatctttttcgacaaccgcattttcggcggggatgcggcagtttggcagcagttgtggatacaggtaaaagacggggtcgttatggcggcatacagcgggctaatgagttgggcgattttgaaggtcgtggggaaaatctgcggcggcctgcgcgtcggcaaggatgtcgaacgcgaaggtttggatctgaatatccacggcgaacgcgtggaataagggcggctatgccgtctgaagcctgaaaatcgggtttcagacggcatttttcacgtttgccgccgatggataaacatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactatactgcctgcgacgcttaacggctgtctttccactgataatatttcgagccgaggaaagaaccgagtttgcgcaaaaacggttgcaggataatattcggctggcgcaaccgctcaaacggcttcagacggcattcgtcccctaaaattgcttcggcaaccgccagacctgcaatgcctgttatcgccatcccgtgtccggaataaccttgcgcataaaaaacattcggggctaaacgtccgaaatgcgggacaaggttggcggtaatgtcgcactccccgccccacgaatattcgattttgacatcggcaagctgcggaaaaactttaagcatatcttggcggacaagctcggtcatacgctcaggattgtcgataaactcgttatccttaccgccgaaaagcagtctgccgtccgcgctgaggcggtaataatccaaaatatggcggttgtcgcatactgccatattgttacggataagcccttttgcgcgcgcccccaagggttcggtcgcaataataaaggtgctgacagcaatcgccttgcgttccaaaggccggaatatcgggttcaaacctgcataagtattgacagcatagaccacatttttgcactcgacgctgccttcgggcgtgtaaaccagccaaccgttttgatgcggttcgatgcacgtcatcggggattgctcgaaaatctgcgcaccggcttcggcagcggcacgagcgatgcccaaagtgtaagtgagcggatgcaggtgtccggataaggggtcgaattgtgccccttggtacatatcgctgtcaagctgctgtttcaactcggctttatcccaaagttgataatgactcgcaccgtaatgccgttgggcgtgttcatgccactgctgcaactcttcccaatgctgcggacggacggcaaccgtggcataaccgcgctgccaatcacaatcgacggcatgtttgcggacgcgttcgtccaccagttcgaccgcctgcaaagactgttgccaaaaccattgcgcctgctccaagccgacctgtttttcaatttcccccataccgcaggcgtaatcgctgataacctgcccgccactccgtcccgacgcgccgaaaccgatacgcgcggcttccaacacaaccgtttcatgtccctgctccgccaagggcaatgcagtgcacaaaccacccaatccgccgccgatgatacaggtatcggttttcagacggcattgaagtttcggataaacagtatgaggattaaccgaactgaaataataagaaggcagatattcttgaaaatcagggcgaatcattgtgtttgctttatcaggtgtattttcggacggaatgatacaggctgtcgggccatatcgtccaaacagaaaatcggttgaagaaaacaggctgacccagtcatgcggtcagcctgccttattaattaatttgctttctcggcagccaatttttcctggcggtaggcttctgccgcttctcggtcacgcttggttgcctgcctcatcatccaataattgacgatgatgaccaatgttccgatgatgccgattaggatggtcgccaagacattcatctgaggatcgagacccaacttgattttggagaaaatcacctgcggcaatgtggatgaaccggggccggagaggaatgaggtaatcaccaaatcatccaaagacagggtaatgccgagcagaaagcctgaagcgatggcaggggcaatcaaaggcaaagtgatgacaaaaaagattttcagcgggcgcgcgcccaaatccattgcggcttcttcgagcgactggtcaagctcaaccagacgcgaacggataacaacggtaatgtacgccatacacagcgtcgtatgtccgaggaagatggtgaaaaagccacgatcgaagtagagatgttgtaaccattcgctgccctgcaaaaatatctgtacctgaataatcagcagcagcatagacagaccggtaatcacgtcgggcatcaccataggtgcggaaatcatgccagcgaacaaggtactgccgcgaaaacgtttaatccgcgccatcgcatagcctgccagcgtgcccaaaacgacggcggcaagcgaagacacaacggcaatccgcagcgacagccaagcggcttccaagatggtgtcgttttccagcaatgcgccgtaccacttggtcgaaaagccgccccaaacggttaccagcttggattcgttaaacgaatagatgaccaaaacaaccagcgggatatacagaaacgccagcgacagtgccaacatcagtttcaagaaccaagataatttggatttctgcattatttggctccttcttccaattcgcggttttcataatgctgaaacagggcaatcggcacgaccagcagcgcgaccatcacgacggcgacggcggaagccagcggccagttgttttgatcgaagaacgcctgccacaagactttaccaatcatcaggttttccgaaccgccgaccagctcgggaatgacgaactcgccgacagcagggacgaaaaccagcatggagcctgcaataatgccggttttcgacaaaggcagggtaatcgtcaagaacgatttgaccggccccgcgcccaaatcggaagccgcttcaagcaggcggttgtcgagtttcaccagttgcgtgtatagcggcagaatcataaacggcagataggcgtaaaccatcaccaaattgagcgaaaaggcattgtagaacaaatccaaaggctcgctgataatacccattttaatcaacaggttgtttacaatgccgttatgcccgagcagacccatccacgcatagacgcgcaacaggaacgatgtccaaaagggcagcataatggcaagcagcaaaccattgcggacagaaggattggcacgagaaatcgcataggcggtcggataaccgaccaacagacaaattaccgtcgtagtcagcgcagtcttaattgaagaccaataagtcatcagatagatattgctgttttcaccgtcgccgaacggattgagcgtactccaaaaattttggaagatgtctgcataattttggtagctgacagcaatattcagacgacccaaatcctcatctatcgtcgttaaaggagtaaacggcgggatggcgatttcttgttcggcaaagctgattttcagcacgatggcgaacggaatcagaaacagcaccaaaagccaaatatacggtacggcaatcaccgcacgctgccccggacggcggaacagtttgtttttcagtttattaaggttcattgcattccccttaaatcaacggaacaacggagtcggttggttttccggccagctgatatagacggtttcgtcccaagtcggcggtgtaatgttgcgcacataccagtaaggggcggggacttggcttttgacgacgcgcccgttgccgagcttgatatggtaaatggcgaagctgcccaaataggcgatttcttttaccgtgcctttcgcccagttgtagtcgcccaaatattcgggtttttctttatataaatcaatatcctctggtcgaatactaacccaaaggtcctgctcgctcggaccacccaaaccgtgatcgatgcggacgtggttttccaaaccttcgcattcgataacggcatagtcggcatgatcttcaatcaccacaccgtcaaagatgttggtttcgccgataaactcggcagtgaagcggctgttgggatagtcgtacacgtcgctgggtgtgccgacttgctgcaactgaccgtcagacataatggcgatgcgggtcgccatcgtcatcgcctcttcttggtcgtgcgtaaccataatacaggttacgccgacttgttccagcgtattgaccaactcaagctgggtttgttggcgcagttttttgtccaatgcaccgaggggctcatccagcagtagaattttcggacgttttgccagactgcgtgccaaagcaatgcgctgctgctgaccgccggacaattggtgcggtttgcgtttagcaaatttggtcatctgaaccaggcggagcatttcttcgacgcgcgcggcgatttcgcctttaggcattttgtcctgtttcagaccgaaggcaatgttttgttctacggtcatatgcggaaaaagcgcgtaactttggaacatcatattgatggggcgatcatagggtgcaagtttggtaatatcctgaccatcaaggataatttttccctgattgggactttccatacccgccagcatacgcagcagtgtagattttccgctgccggaactgcccaaaagggcgaagatttcgtgttgataaatgtccaagtcgatgttatcgacagcgtaattgtcaccaaactttttcaccaaaccttggattttgagataaggtttggctgaagacgcagtggttgcggtcataatggcaatactccaataaaaagacgagtaccggcaaaacggattttcgaatgggtgataaaaagctgtttgattgctggcgggagttaaacgtttgatgccgtctgaaactcttgtaaagcgcacgggcagcatgaaatggaacaagattccaaagaactttatattatattagtttatgcggttttcgggcaatatagtggattaaatttaaaccagtacagcgttgcgttgccttgccgtactatttgtactgtctgcggcttcgtcgccttgtcctgatttaaatttaatccactataaatatggatttgagcttgtcggaaagcaacagaaaagaaaacaccgcccatttttctgggcggtgtcggaaagcgtaattatttacgcagacccaagcgggtaatcaacgcgcgatacgtatcgggctgggtacggcgcaagtaggccagcaggcggcggcgttggctgaccattttcaacaggccgcgacggctgtggtggtctttggggttggctttgaagtggggggtcaggtcgttgatgcggaaagtcaacagagcgacttgtacttcggaagagccggtgtcgccttctttgcgttggaaatctttaacgatttgtgctttttgttctacggtcagtgccataatgaaaactccaaaaatataagaatccccatagggattcagacaagtttgccaagcctgaagacaacggcaaactccctatgcccaagataggacaacgtggcattatgacacaattcccgcatttctgcacaatattttaagaccgtggaagtaaccgttaaaaatgccgtctgaagcattgtctgcttgagacggcaatgttcagacggcatatgcgcttcaaaccacgatttcttctttcttcttcggttctttaccgatattgtcgcggctcaaaccgaacattagcagaagcgggctggcaaccaatacggaagaataaatgccgaacacgatgccaatggtcaacgccatagaaaagccgtgcaaggccgcaccgccgaacaccagcatggatacgaccatcgcctcggtcgaaccgtgggtaatgatggtgcggctcatcgttgcggtaatcgcgttgtcgatgacttccggcacggcatgtccgcgcatcgccggcttgcggaagttttcacggatacggtcgaagacgacgacggattcgttcacagaatagcccaatacggcaaggatacccgccaagacggtcagcgaaaattcccattggaagaaggcaaagcagccgagaataatcacgatgtcgtgcatattggcgataatggcagatacggcaaaacgccattcaaaacgcatcgacaggtaaataatgatgccgataacgacaaaacctaaagccatcaatccattacttaccaattcctcaccgacttgcgggccgataaattcgacttggcgcaaggtaacgtcgggactgtcttttttcagcaaatccataacctgattggacaactgtgcggaagtaacaccttctttgttcggcaggcggatcatgatgtgtttgttcgtacccaatgcctgaacctgtacatcacctattttcagcgtatcgaggcgttcgcgcatcttattgacatccgcaccctgctgatattggacttccattaccgtaccgccggtaaattcgacagagaaattcagacctctggtaaccaaaaagaacacggcagcgataaacgtaaccaacgaaatgaaggtcgtcagtttgccgtagctcataaacggaatatcgcgtttgattttaaagagttccatagcttactccttgcctcctgccatttcggctttcggcttccacaccgaaccaatggaaatattctgcaatttgcgtctgcgtccgtaccacagattgaccaacgcacggaatacgacgacggatgaatacatcgaagtcagaatacccaaacagtgtacgaccgcaaaaccgcgtaccgggccggaaccgaataccaaaagcgcgataccggcaatcagcgaagtcaggttcgaatcgacaatggtcgcccatgcgtgttggaaaccgagattgattgcctgctgcggcggcacgccggcacgcaattcttcgcggatacgttcgttaatcaagacgttggagtcgattgccatacccaaagtcaacgccagcgcggccatacccggtaacgtcaacgttgcctgcatggcagacaaaataccgattaggaacagtatgttggcactcaatgcaatggtagaaaagaaacccatcagacgatagtaaaccaccatgaatgcagcaacgatggcaaaaccccataaagtcgaatggaagcctttttcgatgttctccttacccaaagacggaccgatggtacgttcttcgacaatctgcatcggtgcggcaagagaaccggcacgcaacagcaaagacgtatcattggcttcggctgtcgtcatgcttccggaaatttccacgcgtccgccggtaatggcagtacggataaccggcgcggttacaacctcggattttccttggtcgatcaaaaccatcgccatgcgtttgccgacatttgcggcagtcagttcgccgaaaatgctgccgcccgcgctgtccaagctcagactgacggcaggtgcgcccatttggtcgaaactcggttgcgcatcgttgatgttgtcgcccgtcagctcgacctgtttgctgatcagcagaatttcgggacgatctccgccgcttgaaagcagctcataaccgctcggcacgttgccttccaatgcctcgcgcaacttggcaggatcgtcctccaccatacgcaattccaaagtcgcggtacggccgatgatgtcttttgccttggcagtatcctgaacgcccggaagctgcacgacgatacggtctgcaccggactgctggatgacgggctcggccacgcccaactcgttcacacggttgtgcagggtagtgatgttctgtttgaccgcatcggaacacactttattgaccgcctcttccgaaagcgtcaagacgatattgctgccgtctgaattcagcgttgcttcagaaacagcttgcgcaactgcggcagagccttttgcacatcacctgcatcctgcaaagggacggtcaggctgtttccagcctgacgcaccgtgccgctgcggattttttcgcggcgcagttcgcggcggatgtcgcccgaataacgttcaaacgttttctgcatcgttgctttcatatcgacctgcatggtgaaatgcacgccgccgcgcaggtccaaacccaaaaacatcggattggctttgattttcgccatccattcggggctgtccgccaacaggttgagcgcggtaatatacccttcgcccaaagtgttttcgatgacgtcgcgcgctttaagctgcgtttctgtgtctttgaaacgcactttcagtgaattgtccacaacaaacatcccgtcggtctgaatacctgcgtttttcagcgcggcatccactttgaattgagtctgttcgttgatgatgatggcttgtcggttggtcgatacctgcacggcgggtgtttcgccgaataggttgggcagcgaatacactgcggcaaccgcaatcgtgaacacaatcagcagatatttccataaaggataacggttcatcattgttccttaatggttggaaccccaccctttcggtggtgtcggaatcgggctatttcagaagaggcaaaaacccttcccagccaggcaagaccggaaagcggcatcctgaatatgccgccctgcgtgtcggaacatggtcaagccttcggttggaattcaaaacaaagtgccgcattcgggctttccagatgcggcttgtcggcacaaatcaatcgacttttgcggcaatcgcattgcgttccacttcgacctcgatttttgtaccctgtccgatatccacggtaaaaaactgttcgccgactctggttaccttacccttgaaacctgccgccaagaccactttgtcgccgactttcaaggcggcaagcattgcctgatgcgctttgaatttcttttgctgcggacgcatgatcaggaagtagaacaccaccataatcaacactaaaggagcaaattgtgcaacagcttgattcataatttatccgttctttctaatatggttgaaaatcgagaggggtatataataacataagaccgtaaacaatatatcgggtttgccgtccgtaccgaccgtataccgcagcctgcccgtccacaaacccatgtccttgacccgcctaatcttgaaattctatgcactgttgcgcctttttttgggcaaaaacgcccgcaccgcatggatttcgcatcccgcctgtgccgggcacgaacccggcgcaaaccatcccgattcgcccgaccgcatcctctgcatcgagcaggcattgcgccgcgccggtatttggcagcacctccaaaccatagaggcggaagaaatcagcgatacgcgcctcgcacttgtccactcgagcaaatatctgaaccgtttggaatcttgcctgccccaaaaaggcaagatttcccgcctggataacgacactgcaatcagcacaggatcgctgtctgccgcacgctttgccgccggttcggcagttcaggcagtcgacatggtcatgaaccgtaaagcatggcatgccttttgcgccgcccgcccgcccggacaccatgcgggcagcggcaaagccggcggattctgcctgctgaacaacgttgccgccggcgtcatgcatgccattgccgaataccgcctgaaacgcattgccgtcatcgatttcgatgtccactacggcgacggtacggcagaaatattcaaagacgatccgcgcatcctgtttttcaacctgtttgaaaccgaccttttccccttccccgaaaacaacgatatgcccgacggcggcaatatggtgcacctgcccttgccgccaggaacgggcagccgcacattccgcgaagccgtccgcaggcagtggctaccccgacttgccgcattcaaacccgaactggtgctgctgtcggcaggattcgacgcacaccgtctagacgaatcgggcaggctcaacctgcacgaggcggattttgcctggctgacacacaaaatcattcagacggcatcgggctgccccggcaaaatcatatccgtactcgaaggcggctacacccttgaacctctggcacaatctgctgccgagcatatccgcgtgctggcagggctgggcaaatccgatgccgcaaccgcctatcagaaaacactggacccaacaaaaaaacggtttgccaaaccgaaaaccggacaggtgcgccaacctacccaatccgaccgttacgacatatagtggattaacaaaaatcaggacaaggcgacgaagccgcagacagtacagatagtacggaaccgattcacttggtgcttgagcaccttagagaatcgttctctttgagctaaggcgaggcaacaccgtactggtttttgttaatccactataaatgccgtctgaagccgattcggttttcagacgacatcattatttgacctgacgcaaacagaaagccttccgcgtgcttaaacacatctcttgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcctcttgtagtaaaatatctaaacagattcaactggaaacggtcaagcttcttcacgccattcccatttcaaccgccgcctgccagattcagacggtattcctacttgaaaacaaggagcgttacaatgaaagcagcacgtttttacgacaaaggcgacatccgcatcgaagacatccccgaaccgaccgtcgcccccggcactgtcggcatcaatgtcgcctggtgcggcatctgcggtactgacctgcacgaattcatggaaggcccgattttcattccgccttgcggtcatccgcacccgatttccggcgagtccgcacccgtaacgatgggacacgagttctccggcgtggtctatgccgtcggcgaaggcgtggacgacatcaaagtcggccaacacgtcgtggtcgaaccctacatcatccgcgatgacgtaccgaccggagaaggcagcaactaccacctctccaaagatatgaactttatcggcttgggcggctgcggcggcggtctgtccgaaaaaatcgccgtcaaacgccgttgggtgcatccgatttccgacaaaatcccgttggatcaagccgctttgatcgaaccgctgtctgtcggacaccacgcctatgtacgcagcggcgcgaaagaaggcgacgtcgcattggtcggcggtgcaggtccgatcggtttgctgttggctgccgtgttgaaagccaaaggcatcaaagtcatcatcaccgagttgagtaaagcacgcaaagacaaagcgcgcgaatccggcgttgccgactacatcctcgacccgtccgaagtcgatgttgttgcagaagtgaaaaaactgaccaacggcgaaggcgtggacgtggcatttgagtgcaccagcgtcaacaaagtgttggatactttggtcgaagcctgcaaacctgccgccaatttggttatcgtatccatctggagccaccccgccaccatcaacgtccacagcgtcgtgatgaaagagttggacgtgcgcggcacgattgcctactgcaacgaccacgccgaaaccatcaaactggtcgaagaaggcaaaatcaaccttgagcctttcatcacccagcgcatcaagctggacgagctggtttccaaaggcttcgagcgtctgattcacaacaacgaatccgccgttaaaattattgtgagtccaaacctgtaagcaaattacatttgcaacagcacaaatgccgtctgaaacgctcagacggcattttccaacgaagcgcaacaggcgtattgcccgagagcagccgtttagcctatcattccgaacaaacagaaacaaacagaaggaaaatcatgggagattccgtactatccgccatccaacaaaccatcacccagcgaaaatctgccaatccgtccgaatcttacgtcgcacagctcttgcataagggcgaagacaaaatcctaaaaaaagtgattgaagaggcgggcgaagtgttgatggcatccaaagacaaaaacccgtcccacctggtttacgaagttgccgacttatggtttcacaccatgattcttctgacacaccacgacctgaaggcggaagacgtattggacgaacttgcgcgccgtcaggggctgtcggggctggtcgaaaaagccgctcgcacagaatcttgaatttatattaaaatccgcactttcccacattcaatccgtctgaccgcttttcagacggcatcggagccgttatggacaactgtattttctgcaaaatcgccgccaaagacattccggcgcaaaccgtctatgaagacggcgaaatggtttgtttcaaagacatcaaccccgctgctccggttcatctgctgctgattcccaaagtccatttcgattcgttggcacacgccgcgcccgaacatcagatgctgctgggcaaaatgatgttgaaagttcccgaaatcgccaaagcggcaggactggcagacggcttcaaaaccctgatcaataccggaaaaggcggcggacaagaggtcttccacctgcatatacacatcatgggtacacccgtataaaccgttatttcacaatcaacccctaatacttacttaaggatacatcatgggcagtttttctctgacgcactggattatcgtactgattatcgtcgttttgatattcggcaccaaaaaactgcgcaacgtcggcaaagacctcggcggtgcggttcatgacttcaaacaggggctgaacgaaggtacagacggcaaagaagcccaaaaagacgatgtaatcgaacacaaaaaagacgaagacaaagcgtaatttatgtttgatttcggtttgggcgagctggtttttgtcggcattatcgccctgattgtcctcggccccgaacgcctgcccgaggccgcccgcaccgccggacggctcatcggcaggctgcaacgctttgtcggcagcgtcaaacaggaatttgacactcaaatcgaactggaagaactgaggaaggcaaagcaggaatttgaagctgccgccgctcaggttcgagacagcctcaaagaaaccggtacggatatggaaggcaatctgcacgacatttccgacggtctgaagccttgggaaaaactgcccgaacagcggacacctgccgatttcggtgtcgatgaaaacggcaatccgcttcccgatgcggcaaacaccctatcagacggcatttccgacgttatgccgtccgaacgttcctacgcttccgccgaaacccttggggacagcgggcaaaccggcagtacagccgaacccgcggaaaccgaccaagaccgcgcatggcgggaatacctgactgcttctgccgccgcacccgtcgtacagaccgtcgaagtcagctatatcgatactgctgttgaaacgcctgttccgcacaccacttccctgcgcaaacaggcaataagccgcaaacgcgattttcgtccgaaacaccgcgccaaacctaaattgcgcgtccgtaaatcataaagagagcaatccggtgtccgaaacacaaaacgaacaacccgtccaaccgcttgtcgagcatctcatcgagctgcgccgccgcctgatgtggacggttgtcggcatcttagtctgctttttcggcctaatgccgtttgcccaacaactctatacttttatcgccgacccgctgatggcaaacctgcccaaagacaccagcatgattgccaccgatgtcatcgcaccatttttcgtgccggtcaaagttaccctgatggcggcatttttaatttcgctgccgcatacgctctaccaaatctgggcatttgtcgcgcccgcactctaccaaaacgaaaaacgcctgattacgccgctcgtcctctccagcgtcagcctgtttttcatcggcatggcatttgcctactttttggttttccccgtcattttcaaattccttgccagcgttacccctgtcggtgtcaatatggcgacagacatcgacaaatacctctccttcatcttggggatgtttgttgcgttcggcacaacgtttgaagtccccattgtcgttatcctgttaaccaaaattggtgtggtaacaaccggacagctcaaacgcgcccgcccctatgtgattgtcggcgcgtttgtcattgccgccatcatcacgccgcccgatgtgatttcacaaaccctgcttgccattccgctgattctcttatacgaagcaggtatttggttcggacgctttttcacgccacgttcagaacaggatggcgacatacggccgcctgcaacaacctgacactatgccgtccgaacctccgcctcataccgcaacagattaaggaatacctttgaataccctctatttaggttcaaacagcccgcgccgaatggaaatcctgacacagttgggctaccgcgtcatccaactgcctgccggcatcgacgaatccgttaaagccggcgaaacacctttcgcttacgttcaaaggatggcagaagaaaaaaaccgaaccgccctgaccctcttttgcgaaaccaacggcacaatgcccgatttccccctgattaccgccgacacctgcgtcgtttcagacggcatcatattgggcaaaccccgctcccaagccgaagcaatcgaatttttaaaccgattgtccggcaaacaacataccgtcctgactgctgtctgcattcattatcgcggcaaaacgtcaagccgcgtccaaaccaaccgcgtcgttttcaagcccctgagttcggaagaaatttccgcctatgtgcaaagcggcgagccgatggacaaagccggtgcctacgccgtacaaggcataggcggcatctttatccaatctatcgaaggcagcttcagcggcattatgggactgcccgtttatgaaaccgtttcgatgttgcaggatttgggataccgctcccccttgtccgcccttaaaccgtaaagaccgccgtgaacagacaaaccgcttacctccttgcctctttcagcctgatcgcactgataatcctgtccctttcctgggaactgtggattgcaccgttgcgcccgggcggctcgtggctcgcgctcaaagccctccccctctgtctgccgctttcaggcatcttgaaaaagaaaatctatacttaccaatacagctccatgctggttctgatttactttgccgaagccgtcatgcgcctgttcgacgcctatcccgcagaacagatttgcgccgcgctttccgcagtattcagcatcatcttcttcatatcctgcctgtcgttcgtcaaacaatacaaggaaacaaacaatgcccgctgaaacgaccgtatccggcgcgcaccccgccgccaaactgccgatttacatcctgccctgcttcctttggataggcatcgtcccctttaccttcgcgctcaaactgaaaccgtcgcccgacttttaccacgatgccgccgccgcagccggcctgattgtcctgttgttcctcacggcaggaaaaaaactgtttgatgtcaaaatccccgccatcagcttccttctgtttgcaatggcggcgttttggtatcttcaggcacgcctgatgaacctgatttaccccggtatgaacgacatcgtctcttggattttcatcttgctcgccgtcagcgcgtgggcctgccggagcttggtcgcacacttcggacaagaacgcatcgtgaccctgtttgcctggtcgctgcttatcggctccctgcttcaatcctgcatcgtcgtcatccagtttgccggctgggaagacacccctctgtttcaaaacatcatcgtttacagcgggcaaggcgtaatcggacacatcgggcagcgcaacaacctcggacactacctcatgtggggcatactcgccgccgcctacctcaacggacaacgaaaaatccccgccgccctcggcgtaatctgcctgattatgcagaccgccgttttaggtttggtcaactcgcgcaccatcttgacctacatagccgccatcgccctcatccttcccttctggtatttccgttcggacaaatccaacaggcggacgatgctcggcatagccgcagccgtattccttaccgcgctgttccaattttccatgaacaccattctggaaacctttactggcatccgctacgaaactgccgtcgaacgcgtcgccaacggcggtttcacagacttgccgcgccaaatcgaatggaataaagcccttgccgccttccagtccgccccgatattcgggcacggctggaacagttttgcccaacaaaccttcctcatcaatgccgaacagcacaacatatacgacaacctcctcagcaacttgttcacccattcccacaacatcgtcctccaactccttgcagagatgggaatcagcggcacgcttctggttgccgcaaccctgctgacgggcattgccgggctgcttaaacgccccctgacccccgcatcgcttttcctaatctgcacgcttgccgtcagtatgtgccacagtatgctcgaatatcctttgtggtatgtctatttcctcatccctttcggactgatgctcttcctgtcccccgcagaggcttcagacggcatcgccttcaaaaaagccgccaatctcggcatactgaccgcctccgccgccatattcgcaggattgctgcacttggactggacatacacccggctggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccgtacctgatgccccgatacgccgacgaaatccgcaaactgcccgtatgggcgccgctgctacccgaactgctcaaagactgcaaagccttcgccgccgcgcccggtcatccggaagcaaaaccctgcaaatgacccgcgccggcggatgcggataccgcccgaaatgtaaagctccatgcaagacattgcaaaaaacagcaaaccggtagggaaatacgctatcaaaaaacattgcagccgtgttaagataaaccgtcaaacaatcttttcacagccccgcccgaaacagggtcggggcatacccttacgaaaaggaaacaccatgagccgcgtattactcgtagatgacgatgccctgctaaccgaactgctgaccgaatacctgagcgccgaaggtctgaacgtccgcagcgttcccgacggggaagcaggcgtacaggaaatcctgagcgggcagtacgatgtagtcgtattggattccatgatgcccaaaatgaacggcttggatgtcttgaaaaacgtacgcgcccgaagcaccgtccccatcatcatgctgaccgccaaaggcgacgacatcgaccgaatcatcggcttggaaatgggcgcggacgactatgtccccaaaccctgcacaccacgcgaactcttggcacgcatcaatgccatcctgcgccgcgcacaacacagcggcgaacagaacaacgcacccaacagcatctccgtcagcgatgtcgtcctgtaccccgccaaacgccaggcatccgtcaaagacatgccgctcgaactgaccagcaccgaattcaacctgctcgaagtcctgatgcgccatgccggacaggtagtcagcaaagaaaccctgtccgtcgaagcactcgaccgcaagctggcaaaattcgaccgcagtatcgacgtacacatctccagcatccgccacaagttgggcgatgcctctctgattcaaaccgtacgcggcttgggctacctgtttgtcaaaaactgaaataaacagataaatgaaactgttccaacgcattttcgccacattttgcgcggttatcgtctgtgcaatctttgtggcgagtttttctttctggctggtgcagaacacccttgccgaaaaccagttcaaccaacgccgcaccatcgaaaccactttgatgggcagcatcatttccgcattccgggcacgcggggacgcgggtgcgcgcgaaatcctgacggaatggaaagacagccccgtctcatcgggcgtgtacgttatacagggcgacgagaaaaaagatatcctgaaccggtatatcgacagctataccatcgaacgcgcccggcttttcgccgccggacacccgcattccaacctcgtccatatcgaatacgaccgcttcggcgaagaatacctgttcttcaccaaagactgggacaaactccaagcccgccgcctgcccagccccctgttgatccccggcctgccgctcgccccgatttggcacgaactcatcatattgtccttcatcatcatcgtcggactgctgatggcatatatcctcgccggcaacattgccaaacccatcagaatcttaggcaacggcatggacagggtggcaaacggagaacttgaaacccgtatctcccaacaggtcgacgaccgcgacgacgaattgtcccatcttgccatccaattcgacaaaatggtggaaaaactcgaaaaactcgttgccaaagaacgccacctgctccatcacgtctcccatgaaatgcgttctccccttgcgcgcatgcaggcaattgtcggactgattcaggcgcagccccaaaaacaggagcaatatctcaaacggctggaaggcgaactgacccgcatggatacgctggccggggaactgttaaccctgtcccgtctcgaaacttccaatatggctttggaaaaagaaagcctgaaactcctgcccttcctgggcaacctggtagaagacaatcaaagcattgcccagaaaaacggacaaacggttaccctgtctgccgacggaaaaatccccgaaaacacaaccatccttgccaacgaaagctacctgtaccgcgccttcgacaacgtcatccgcaacgccgtcaactacagtcccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggttccaaaacagaaaaaagtgcgaactgaccataataccgtctgaaccggcttcagacggcattgcacaaacagttaccccaaaacaaacacacagcgggtgtctctccaaaaatcacgcacataccgtccgcaaaggaatatatcatgtcggcacaaaccgatccgggctacttcttcatgcccaaccacatcatcctgataggcgcgagcgaacaaccgtacagcctgggcgaacgtgtactcagcaacctgctgagtacgccctttcaaggaaaaatcacccccgtaaacccgcgccaccacaccatagccggactgcccgcctacaccagcctcaacaaaatccccggcaatgcagacctgattattgccgttaccctacccgacagttacgacaccctcttcaaaacctgccgcaaaaagcagctccgacacatcatcctcatacaggactgggacaacctgtctgccgcagaactgcacaccgccgaaactgccatccgcaaacaccacggcaacggactcaacatcaccgcctgcaccaccgcaggcatccaactgccctcactcggactcaacatcagtacccaagacggatacgccgcaggccataccgccatactgaccggcaatgccgccgtcagccgccaaatcgacaacatcctgaacaaactccgtcaaggcacatcccgccacatcagcctgcatcccggcatcagccccatcacatccgccgattggctcaaccgcttcggacacagcctgcacaccaaaaccgccgtcctacaccacaaccctgaagaggatcagcgcaaactgttcagcgcaatccgccaatttacccgccatacgccgctgattctccacatcacctgccgcacgacagaaaccgaccgtgccgtactgcactgcctcgcccgacactgcaacttcctcgtcagtttcaacgccgacgacctcgaagccgcactgcgcgcccaactgtccgaccttccacccctgtcccgactcgacatcctgtccgacacgcctgccgaatggctgcacgcgcacgcgccaaaaaacctcaccctccactttcccaaccttccccaccacatccgcaacggacacctgaccggcacacccacaccctcaatctgccacgacatcgcctcacgtcagcttgcccaccccgacacccaagccgtcctaaccatcctcagtccctccggacacgaggattacaaaaaaacagcacgcgcccttatccgcctgtccgaacagaccgccaaacccctgctcgtcagcagccccttttcagacggcataacccatttcgacacccccactcaggcaatccgcaccctttcctaccgcaacaccgccgccgccctgaaacaggcacagctcgacattgcaccgccgcagccatgccgtctgaaaacaccgcaaccccaaaacatcaaaaaagcccttgcagcggcaaacccctccctgctcgccgaagccctgcacctccccccctaccggcacaccacccataacgccgtacaattccaattcgacagccaccccctctatggcgacatcctgaccgcacgctgcaacggacaaaccactgccgtactcccgccgtttaccacgctcgacagccgccaccttgcccgctttgccgaactcgacggcacacaaaccctcgaccagttcctgcacacactgaccgtcattcccgaataccgccaacacattctcggcatcaccctcaacctcaacggcggacaatacagcagcgatttcctcttaaagacacccgaaacacacgacacgcccaaacgcaagaacacaggcaaagccgcccaaaccctcgaacatgccgccgcaaaaatgcagagtgccgccgcatacctgaaacacaaaaacccgacagccgccgaatttctccgccacacaagcgaagccgccgcagaactgctcggcagcaaaaccgaaaccggagcagccgtacccaacgtacttgccccctatcccgcagcataccccaaaacactgtccctaagaaacaacacgaccgttaccattacccccattttgcccgaagacgcagaagccaaacagcagttcgtccgcagcctcggtcccgaagcacggtacacacgcttcatgacccacaccaacgaactgcccgcagccacgttggcacgcctgtgcaaccccgattaccactgtgaagccgcatggacggcaaaggatgccgacagcaacatcgtcgccgtcgtccgccacagccgcctgaatcgcaacgaatgcgaattcggcatcacactggcggaacatatgcgcggcagcggactggcacagaaaatgatggaactcatcatccaaaccgccgcacagcaaggctaccggactatgagtgccgacattctcaaaaccaatacccccatgatcaaacttgctgaaaaatcaggatttaccctcaaggaatcggacaccgaaaaaaacctgtaccgcgcatatctgaaccttgcggcagacaaaacaacagaaaaaacaaataaaaacttgcgcaccgaccacaaaataacctaaaatcggcagtttccatatatccgattttctcaaaaggactcaaaatggtagttatccgtttggcacgcggcggctcgaaacaccgccccttctacaacgtcatcgttactgactcacgcagccgccgcgacggccgcttcatcgaacgcgtaggcttctacaaccccgtagccaacgaaaaacaagagcgcgtccgcctcaatgcagaccgcctgaaccactggattgcacaaggcgcgcaagtcagcgactccgttgcaaaactgattaaagaacaaaaagccgcctaatccgcatttgccgccatgacagacactcaaaaccgggtagccatgggctacatcaaaggcgtattcggcataaaaggctggttgaaaattgccgccaacaccgaatattccgacagccttttggactaccccgagtggcatttggtcaaggacggcaaaaccatcagcgttacccttgaagccggaaaagtcgtcaacggcgaactccaagtcaaattcgaaggcataaacgaccgcgacttggcattctcattgcgcggttacaccatcgaaataccccgtgaagcattcgccccgacagaagaagacgaatactactggacagacttggtcggcatgaccgttgtcaacaaagaccataccgttttaggcaaggtaagcaacctgatggaaaccggcgcaaacgacgtattgatgattgacggagaacacgggcagattctgattccgttcgtttcccaatatatcgaaaccgtcgataccggcagcaagaccattactgccgactggggtttggactactgatgcttatccaggcagttaccattttccccgaaatgttcgacagcattacccgctacggcgtaacgggacgcgcgaacagacagggaatctggcagtttgaagcagtcaatccccgaaagtttgccgacaacagattgggctacatcgacgaccgcccgttcggcggcggcccgggaatgattatgatggctccgccgcttcatgcggcaatagaacacgccaaaacacaatcctcccaagctgcaaaagtcatctacctcagcccccaagggaaaccgcttgacacaccaaaaagcggtagaactggcagaacttccgcatctgattctgctgtgcggacggtatgagggcatagacgaaaggcttctgcaaagcagcgtcgatgaagaaatcagcatcggagacttcgttgtttccggcggagagcttcccgccatgatgctgatggatgcggtattgaggctcgtacccggcgtattgggcgatatgcagtctgccgaacaggattcgttctcaagcggcattttggactgcccccactacaccaaacccttagaatttcaaggtatggctgttccggaagtattgcgttccggcaatcatggcttgatagcggaatggcggttggaacaatcgctgcgccgcaccttggagcgcagacccgatcttttggaaaagcgcgttttaatcccaaaggaatcccgcctcttagaaaccatccggcaagagcaacgggaaatccaatcataatttaggaaaaaaacaatgaacctgattcaacagctcgagcaagaagaaattgcccgcctgaataaagaaatccccgaattcgcaccgggcgacaccgtagtcgtatccgtacgcgtcgtggaaggtacccgcagccgtctgcaagcctacgaaggcgtggttattgcccgtcgcaaccgtggtctgaacagcaacttcatcgtccgcaaaatctccagcggcgaaggtgttgaacgtactttccaactgtactctccgaccgtcgaaaaaatcgaagtcaaacgccgtggcgacgtacgccgtgccaaactgtactacctgcgcggcctgaccggtaaagctgcacgcatcaaagaaaaactgcctgcacgcaaaggttgattcaaaccgttttcccccaatgccgtctgaaccttcagacggcatttcttattgctgcgatgccggcaagtcaacgatatgcctgcccctcatccaccttgattaacaatcactcccgcctattcaagcataatttacagaccaaacgttatacagtatcatatcagccatataacgataaacgctttaccgccttccctttcaaaaccgcaaatcatcatgacaccttcccttttactatcaggattgaccttccgcctcatccttgccctgattgccgtatcccttttatggggcgtttacttttgggcagtatccgcatgagcatcattgtcgaaaacctgaccgtcagctaccgccgccgacctgccgtgcaccatgtggacattacttttgaagaacatagtatgtgggcggttttcggtcccaacggcgcagggaaatccacctttctcaaatccttgatgggattgcagcctatcgatacaggcagcatccggctggacggattgacccgtcagaacatcgcctaccttccccagcagtccgatatcgaccgctcccagcctatgaccgttttcgacttggcggcaatggggctatggtatgaaatcggctttttcaaagggataaataccgctcaaaaacaacgcgttcacgaagccttggagcgcgtcggaatgcaacggtttgccgaccgtcagattgcctatctctcaaacggacaatttcagcgtgtcctttttgcccgaatgctggttcaaaatgccaaattcctgctgctcgacgaacccttcaatgccgttgatgcacggacaacctacgagcttctcgacgtattgcagaaatgccattgcggcggacacgccatcatcgccgtactgcacgattacgaacaagtccgtgcctactttcccaataccctgctgctcgcccgcgaaaaaattgcggcaggcgcaaccgagaccattctgacagaaccctacctcgcccaagccaacgccaaaatgcagcaacaggaaagccccgactggtgcgcctcataaatgccgtctgaaaccgaaaaaccatgaatctctacgacctgctccttgccccctttgcagaattcgactttatgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttgagcctgcccgccatgggtttgggcggcgtagccgcaggcatgctgatggcactgcttgccggactcgtcagccgcttcaccaccctgaaagaagatgccaactttgccgccttttatctcagcagcctcgccatcggcgtagtcctcgtcagcaaaaacgggagcagcgtcgatttgctccacctccttttcggctctgtacttgccgtcgatattcctgccctgcagctcatcgccgccgtctccagcctcacgctcattacccttgccgtcatctaccgcccgctcgtactcgaaagcatcgaccccctgtttctcaaatccgtcggcggcaaaggcgggctttggcacgtcctctttctcgtcctggtcgtcatgaacctcgtatccggctttcaagccctcggcacactcatgtccgtcggactcatgatgctgccagccattaccgcccgcctgtgggcgaagcatatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgaccgg

SEQ ID NO: 6 - DNA, 49767 bp, Neisseria meningitidis
gttatgatatgtttcgatatgtaaacatttataggtttggagcgataaacaatgaatgcagtcgtagttgccgtaatcgttatgctggtgctgtcgctgtcgcgcgtgcacgtggtattgagcctgacggtcggcgcgtttgtcggcggcgcggtggcgggtatgccgctgcaaaacattgccgatgcggcgggacaggtcagtcaggcggggattatccccgtgttcaacaaaggtttggaaggcggtgcgaagattgcgctttcttatgcgatgctcggcgcgtttgcaatggcgattacccattccggcctgccgcagcagcttgccggcgcggtcgtccgcaagctgaaccggggcggtatgcccgacagcgtgcgttcgggcgagggcgcggtcaaatggctgctgctttccatcatccttgtgatgggcatgatgagtcagaacatcatccccatccacattgcctttatcccgatgattgttccgccgctgcttttggtgttcaaccgcctgaaaatcgaccgccgcctgattgcgtgcgtcatcactttcgggctggttacgacttatatgttcctgccttacggcttcggcgcgatttttttgaacgaaatcctgttgggcaacatccattccgccgcgccgcagcttgatgtgaaaaacattaacgtgatggcggcaatggcgattcccgcgttgggaatgctggccggactcctgctggcgtttgtccattaccgcaaaccgcgcctgtaccaaagcaacaatgccgatacggcgggcaacgccgatgcggcaaaccgtccgcagccgtccgcctaccgcagcctggccgccgccgtcgccattgccgtatgctttgccatccagttgatgtatgaagactcgctggtgttgggcgcgatgctcggtttcgccgtatttatgatgttgggggtcattaaccgcgacaaggcaaacgacgtattcggcgaaggtatcaagatgatggcgatggtcggcttcattatgattgccgcgcagggttttgccgccgtgatgaatgcgaccgggcatattcagccgctggtggaaagcagtatggcgatattcggcaacagcaaaggtatggcggcattggcgatgctggtggtggggcttttggtaacgatgggcatcggttcgtccttttccactttgccgattattgccgcgatttatgtgcctttgtgtgtcggtttgggtttttcgccgcttgccaccgtcgccattgtcggcacggcgggggcgttgggcgatgccggttcgcctgcgtccgattccacgctgggcccgacgatggggctgaacgccgacgggcagcacgaccacatccgcgattccgttatcccgaccttcatccactacaacatcccgctgctgattgccggctggattgccgcgatggtgctgtaaatggacgcggttcaagagttggaacgccgtattgtcgaactggaaatccaatccgcgcttcaggaggacgtaatcgccggcctgaacgcgatggtggcggaattgcggcagacgctggatttgcagcaggctcagttgaggctgctgtatcaaaaaatgcaggacaggaatcccgacgcgcaagagccgtattccctgcgcgacgagattccgccgcattattgatgcgccgccgtatccggatttccttaaaaaaggctgtgtttgaatattccgccgatgcaaacctaagatatatagtggattaacaaaaatcaggacaaggcgacgaagccgcagacagtacaaatagtacggaaccgattcacttggtgcttcagcaccttagagaatcgttctctttgagctaaggcgagccaacgctgtactggtttttgttaatccactataactttaatcagtcggacaaaatgccttttatccgatggaaccgttttccgcccgaacggaaataagcggcttcccccgctgcaaacagataaaaccaaccgggtattcaaacacagccaaaaaaaagccgtccgaacccaaaggggacagacggccaaacacattacggggaaaacgttttactcaatgagtctgcgaaacagacattgctaaaacaattgcaattataaggtaagtttatttttttttttttttttttgcaaagaaatgtaaatttttaaatttttaaaaccgttccgccgcatccgtttggatgccgtctgaaacggcggcagggtttatcgcgctgtgccgcaaaccgggcattcagggttgcgcggcaggtcgaaatattgccagcccccttccaaggcacggtaaaccgccagcctgccgtgcgacggttcgcccgcatccagcaggattttcagagcctccgccgcttgggtactgccgatgatgccgaccagcggcgagaacacgccgaagagagaacagatgccgtctgaagccgatccgccgtcaaacaggcaggcgtaacacggcgagtcgggcaagtcgggacggtacacggcaagttgcccttcaaagcgtaccgccgcccctgaaaccagcggtgttttcgtttgcacgcaggcacggttgacggcttgccgcgtggcgtagttgtcgcaacagtctaaaacgatgtcggcggcttgaaccaaaccggtcaggcggcagccgtcgagtttttcgttgacggcgcggacgttgacggtatggttgatgcgtttcaggcggcctgccaaggcttcggttttgagtttgccgacatcgccctcgtcaaatgcgacttggcgttgcaggttgtgcagttcgaccgtgtcggaatcggctatggtcagcgtgccgacacccgaagcggcaaggtagggcagtgcggcggcacccaaaccgccgcagccgacgaccaaaatatgcgcggcggaaagtttctgctgcccttcgatgccgatttcgtccaagaggatgtggcggctgtaccgcagcaggaatgcatcgtcgttgtcgtgttcggtcgtggtcatgatgatgttcggaaaaaaacagttgcgggcgattgtaacgctgccgtcgggcggcgttcaacttcagacggcatttcgggacacgggcggttaaagtgtgaacggtttggcacggatgcggcatttggggtacatttacaatatttacggcagacgagagagaaaaatcatgcaactgcatattctgaacaatccaaaggacgcggctttggcggcggacgcggaatttctgaaacaatccctgttcaacctcctgcacgaagaagcctcgccgttggttgtcgaaacagtcaaactcttgtccacttccgacgacagcgcggcattgattgaaaaagtattgccgcaattggacgaacaacaaacccacgatttaaccttggcctgcggcctgttcgcccagattttgaacatcgccgaagacgtgcaccacgaacgccgccgccaaatccacgaagaagccggacgcggcggcgcggaaggcagcctgacggaaaccgtccgcaggctcaaagcggggaaagccgacggcaaatcggtgcagcggcagttggacaatacgtccgttaccgccgttttgaccgcgcacccgaccgaagtgcaacgccaaaccgtcttaagcttcaaccgccgcatccgcgcactgttgccgcaacgcgaacgctgcaccaatgccgacgcgctggcacggctgcgccgcgaaatcgacactatcctgctgggcttgtggcagaccagcgaaacgcgccgccacaaactcagcgtcaacgacgaaatcaacaacggcgtgtccatcttcccgatgagctttttcgaagccctgcccaagctctaccgcaagatggaacacgactttcagacggcctatcccggcgtccgcgttccggacatcctcaaaatcggcggctggatcggcggcgaccgcgacggcaatccgtttgtttctgccgaaaccctgcgctttgccttccgccgccacgccgatgccgtgttccgcttctatcgcggcgaactcgacaaactctaccgcgaactgccgctctccatccgccgcgtcaaagtcaacggcgatgtaacggcgttgtccgacaaatcgcccgacgaagaaatcgcccgcgccgaagaaccctaccgccgcgccatcgcctacattatggcgcgcgctatgggcaaagcgcgcgcgctcggtttgggtatgggctgcaaattcggctttctcgagccttatgcttcggcacaagagtttctggatgatttgaaaaaattgcaacgttcccttatcgacaacggcagccgtctgcttgccgaaggccgtttggcagacctcatccgttccgtatccgtgttcggctttcacatgatgccgctcgacttgcgccaacacgcaggcaaacacgccgatgtggttgccgagcttttccaacacgcaggcttggaagactacaaccgcctgaacgaagagcaaaaacaaaccgccctgttgcgcgaattgagccatcaacgtcctctgtacagcccgtttatcacatacagcgaccatacccgccacgaactggcaattttcaacgaagcgcgcaaaatcaaagacgaatttggcgaagatgccgtaacacaaagcattatttccaactgcgaacaacccagcgacctgctcgccttggcattgctgctgaaagaaaccggcctgttggcggtggaaaacggcaaaccgcacagccgcatcaatatcgtgccgctgtttgaaaccattgaagcgttggaaaacgcctgtccggtcatggaaaccatgttccgcctcgactggtacgatgcactgctcgaaagccgtggaaacatccaagaaatcatgctcggctattccgactccaacaaggacggcggctacgttaccagctcatggtgcctctatcaggcggaattgggcttggtcgaactcttcaaaaaatacgatgtccgtatgcgcctgttccacggacgcggcggcagcgtaggtcgcggcggcggcccttcttaccaagccattctcgcccaaccggcgggcagcgtggcgggacaaatccgcatcaccgaacaaggcgaagtcattaccgccaaatacgccgaccccggcaatgcccaacgcaacttggaaaccttggttgccgcgactttggaagccagcatcctgccggataaaaaagaccctgatgccaaactgatgcaggcattgtcggacgtatcgttcaaatactaccgcgaactgattacccatcccgacttcatcgactactttctgcaaaccagcccgattcaggaaatcgccaccctcaacctaggcagccgtcccgccagccgcaaaaccttggcgcggattcaggacttgcgcgcgattccgtgggtattttcctggatgcagaaccgcctcatgctgccggcttggtacggtttcggcagcgcggtggaaaccttgtgcgaagacaaacccgaaacgctcgccgccctgcgcgaacacgcccaaagcaacccgttcttccaagccatgctctccaatatggaacaagtgatggcgaaaaccgacatcaccctcgcggaaaactatgccggcttgagcgaatcgcccgataaggcaaaaatcatcttcgggatgattaaggaagaataccgccgcagccgcaaagcactgctcgacctactgcaaaccgaagagcttttgcgcgacaaccgcagcctcgcccgttcgctcgctttgaggattccctacctgaacgcgctcaacggtttgcaagtcgccatgctcaaacgcctgcgtaaagaacccgacaatccgcacgcccttctgatggtgcacctgaccatcaacggcgtggcgcaaggtttgcgcaatacaggctgatagtgccgcatcggggcaaaatgccgtctgaacgcctttcagacggcatttccctgaccgcacttgcagagaaacaccgattgttttaaagtgaacggcagtgatatgttgaaagacgaccaatgaaaattaccgttatcggcgcaggttcgtggggtacggcgctcgccctgcatttttcccaacacggcaaccgcgtatccctgtggacgcgcaacgcagaccaagtccgtcaaatgcaggaagcgcgtgaaaacaaacgcggactgcccggcttttcctttcccgaaaccttggaagtgtgtgcggatttggcagacgcgctcaaagacagcggacttgtccttatcgtaacctccgttgccggattgagaagcagcgcagagctgctcaaacagtacggcgcgggacacctccccgtcctcgccgcctgcaaaggattcgagcaggataccgggctgctgacctttcaagtcttgaaagaagtattgcccgacaataagaaaatcggcgtactttccggcccgagttttgcacaggaactcgccaaacaactgccctgcgccgtcgtccttgcctccgaaaaccaagagtggattgaagaactcgtaccgcagctcaacacgaccgtcatgaggctttacggcagtaccgatgttatcggcgtggcggttggcggcgcggtaaaaaatgttatggcgattgccaccggattgtccgacggcctagagtacgggcttaacgcccgtgccgcactggttacgcgcggattagctgaaatcacccgccttgcctccgcaatgggcgcacagcccaaaaccatgatggggctggcaggcatcggcgacctcatcctcacctgcaccggcgcactttcgcgcaaccgccgcgtcggcttgggtttggcagaaggcaaggaactgcatcaggtgctggtcgaaatcggacacgtttccgaaggggtcagcacgatagaagaagtcttcaatactgcctgtaagtaccaaatcgacatgccgattacccaaactctgctgcaactcatccgcaaagaaatgaccccgcaacaggttgtcgaaagactgatggaacgcagcgcgcgttttgaataaacaacagacagatgccgtctgaagccttcagacggcatacggacaggtaaggttatgaaacaaaatatcgaaaaactcgaaagcagcgtttatacgttggtacaaaaattcgaaaccctcgtcagcgaaaaccgccgcctcaaagaaaccgtcgccgaactcaaacgggcgcacgagcggcaaaaactcgaacacgaaaccgccgtcgacgaactcagcgaagccctgctcgtccaagtcggcaaactcaaagaagacctgcaaaacaaaattgacagcctgacagaagaaaatacacgataccgcagcctgctcgaacagagcagggaaaaaatcagcgcactggcagcgcgcctcccccaatggcaggaaacgcagcaataaggattaaaggatgaacatcgaacaagtccacatcgaagtcatgcacgcccggctgaccgtcaacacgccggcagaagaaaaagacacactgttgcaggcagtcggaatgctcaacggcaaagccgaagccatccgcgaaggcggacgcgtcgcggacagcgaaaaaatcgtcattatggccgcgctcaacgtcgtccacgacctgttgaaaacctccctgaacggcggcgatttggcaatcggcgattttgcgcgtaaaatagccgatatggacaacgcctgccaaaaagcactatcccgcttggcgcaggaataacccctttttccctgcggtgtccgcgaaggcatatattcctttgaaccaataagttcgcttaaggttgccgggagcagtagtgggcgcgagcgtccttttgcggacgcacccgaaactacccgaggcagccgccttgtcagcaaggttcaagcggattcggccgaaacggctctcgcggggattcccattcaaaaccgcatcgcaacgatgcggtttttcacattggccgccgccccgcccgaaaaagcagtatgcagtctgccgaaatccggaaaatccttccgtaacgcggtaatgcgattgacaaaatcgaatcctgtctttaaaatttacaactttctatatctatctggatttccactatgaaaaccttttcagcgaaaccccacgaggtgaagcgcgaatggttcgtcatcgatgcccaagacaaagtcttgggtcgcgttgcggccgaagtcgccagccgtctgcgtggcaaacacaaacctgaatacaccccccacgtcgataccggcgattacatcattgttatcaatgcggacaaactgcgtgtaaccggtgccaaattcgaagataaaaaatacttccgccattccggtttcccaggcggtatctacgaacgcaccttccgcgaaatgcaagagcaattcccgggccgcgctttggaacaagctgtaaaaggtatgctgcccaaaggtcctctgggttacgccatgattaaaaaactgaaagtgtatgcgggtgcggaacacgcccatgctgcgcaacaacccaaagttttggaactgaaataaggacgcgacatgaacggtaaatactactacggcacaggccgccgcaaaagttcagtggctcgtgtattcctgattaaaggtacaggtcaaatcatcgtaaacggtcgtcccgttgacgaattcttcgcacgggaaaccagccgaatggttgttcgccaacccttggttctgactgaaaacgccgaatctttcgacatcaaagtcaatgttgttggcggcggcgaaaccggccagtccggcgcaatccgccacggcattacccgtgccctgatcgacttcgatgccgcgttgaaacccgccttgtctcaagctggttttgttacccgcgatgcccgcgaagtcgaacgtaaaaaaccgggtctgcgcaaagcacgccgtgcaaaacaattctccaaacgttaatgttggaaattcaaaaaaccctgcttatcgcagggttttttatttgtagtagacggtttcccattggcaatctaaagattacagattgggcaaaaatcaaaaacagtatagtggattaacaaaaatcaggacaaggcgacgaagccgcagacagtacaaatagtatggcaaggcgaggcaacgccgtactggtttttgttaatccactatacatgaaaaaatagaaaaactgccgggtatggttgaataaggggtcagaccggttccagttcgctcagtccgggcaaatctgcaaaaccgcgttcgcgtatgatttggcaaaaattgttcagatagctcttgtccgtatcttcggtacggatggcggcatacagtttgctttgcagtccgtcggcagtaatttggcggtggacgacatagcctttttcaaggtagggcatgactgtccaatagggaagggcggcaatgccacgtctgctggcaaccagttggataatggcgatggtcagctcgctgtgtcggcgcggcgggttgatgtttttcggaatcaggatttttttgggcaaatccagcatctcgtcgggaacgggataagtaatcagggtttccccgataaagtcttccgccgtccaaacgtttttggcggcaagcggatggtctggtgcgcaaatgccgaccatttcgtaggcaaacagcggttggaaagaaataccgttttgtttttccgcttcggaaacaatggcaaggtcggcacggtgttgcagcagcagtccgacgggatccgcttggaatcccgatacgatatccaattcgacttggggccacatcgggcggaattcgcccatggcgggcatcagccagtcgaaacaggtatggcattcgacggcaatccgcagctctcccgcctctccttccgtgattcgcgccaaatcccattctgcaacagcaacttgaggtataagttcgtgggcgaggcgcagcagcctttcgcccaccggggtaaagcgcaagggcgtggatttgcgttcgaacagcggcgtgccgtagtggttttcgagcatacggatctggtgggaaagggcggattgggtaaggaaaacccgtttggcggcaagggagacgctgccggtttcttcaagtgccagcagggttttgaggtggcgcaattcgataatggaatccatggggcttcagacggcatattgaaccggcgcatattaaaataattcatatgcgggtgcaaatcggaaaaatgtgaattccggacattttgcgattagaatgcccgcttgtttaaagcgattaggaaaaaagatggtattgtgcagggattttctgacttggtgtaatgaaacattgcagacagcgttgtttaaagattacgcccctaacggtttgcaggttgaagggagggaatatatcgggaaaatcgttacgtcggtaacggcaagcagggcagcgattgattttgctgtggagcagaaggcagatttgcttttggtacatcacggtatgttctggaaaaacgagttgccgaccgttactggttggaaaaaagaacggattgccgcactgttacggcacgacatcaatatggcaggctaccatctgcccctggatgcacatcccacactgggcaacaatgcccaactcgccgacagattgggttttgcgacagaaaaacggttcggcgaacaaaacctgctcaactcgggcagcctgaaacaagccaagacactcggcgcattggcggcgcatattgaaacagttttgcaacgtaagcctgtcgttatcggcaatcccgaacgcgaaatccgacgggttgcatggtgcagcggcggggcgcaggggttttttcagacggcaatagacgaaggtgtcgatctgtatttgacgggggaaatctctgaagcccaataccaccttgccaatgaaacgggtacggctttcatttcggcagggcatcacgcgacggaacgttacggcgtacgcgcgctggcagaatcggcggcagaggttttcgggttggaagtgtgccattttgacgaaaacaatccggcttgagtcttgagaaatatcataaaactttaccttattttaaataatgctttgagtatcactgcaaactgggtaaaattgcaacgtttaatggctcggtattcccaaaatattaggacgactgaataatggataatcaagaaatcaacaacggccgccgccgtttcctgacactcgcgacctgcggcgcgggcggagtggcagcattgggtgtggcaacgccgtttgtggccagttttttcccttcggaaaaagccaaggccgccggtgctgccgtcgaggtggatgtcagtaaaatcgaagcgggtcagctgctgaccgccgagtggcaaggcaaaccgatttgggtgctcaaccgtacagatcagcagcttaaagacctgaaaggcctgaacggcgaacttaccgatcccaattccgatgcggaacagcagccggagtatgctaaaaacgagacccgttcgattaagccgaacatccttgtcgccatcggtatctgcacccatttgggctgctcgcccaccttccgtcccgacattgcccccgccgatttgggtgcagactggaaaggcggcttcttctgcccctgccacggttcgaaattcgacttggccggccgcgtatataaaggtgttcctgccccgaccaacctggttgtcccgccatataaatacttgagcgacacaactatcttggtgggcgaagactaagaataaggaacgataattatggcaaaccaaaccaatagcaaagcaaaagcattgttaggctgggtagatgcccgttttccattaagtaaaatgtggaaagagcatctgtctgaatactatgcgcctaaaaacttcaacttctggtatttcttcggctcattgtctatgctggtgctggtgattcaaatcgtcagcggtattttcctgaccatgaactacaaaccggacggcaaccttaacgcctaccatctgcctgctgcctttaccgcagtagagtacatcatgcgcgacgtgtccggcggctggattatccgctatatgcactctaccggcgcatctttcttcttcatcgtcgtttatctgcacatgttccgtggtctgatttacggttcgtacaaaaaaccgcgcgaattggtgtggattttcggttccctgattttcttggcattgatggcagaagcctttatgggctacctgctgccttggggtcaaatgtccttctggggtgcgcaggtaattattaacctgttctccgccatccctgttatcggtcctgatttgtccacttggatccgcggtgacttcaacgtttccgatgttactttgaaccgattcttcgccctgcacgttatcgctgtacctttggtattgctcggcttggttgtggctcatatcattgccttgcatgaagtgggttccaacaaccctgacggtgtagaaatcaaaaagctgaaagatgaaaacggtgtccctctagatggcatacctttttttccgtattatgttgtgcatgatatattggcagtaacgatattcttgattgtcttctgtgccgtgatgttctttgcacctgaaggcggcggctacttcttggaagcgccaaacttcgatgcagcgaatgcgctgaaaacacctccgcacattgcgccggtatggtacttcactccgttctacgcaattctgcgtgcgattccttcctttgccggtactcaggtatggggtgtaatcggtatgggtgcagcagttgtactgatcgccttgctgccttggttggataaaggcgaggttaaatctgtccgctatcgcggcccaatcttcaaaaccgcattggttctgttcatcattgccttcatcggtttgggtattttgggtgcaatggtagcaactgatacgcgtactttggttgcacgtatcctgtctttcgtctactttgcattcttcctgggtatgccgttctataccaaactggataccaacaaaccagttcctgaacgcgtaaccatgagcactactaaacaaaaaattatgttctttgtttacgtcggtattaccgttgttggtgcttacttgtttgcaaccaatatctgatgagggcagcgaaaatgaaacaaactctgaaaaactggtttgctgccttattgctggcagtgcctatgagtgcagccgtcgccagcggcggcggacactacgaaaaagtcgatatcgacctgcgtgaccaagtcagcctgcagcacggtgcgcaaatctttacaaactactgtttgtcttgccactctgcaagcggtatgcgcttcaaccgtctgaaagacatcggtttgactgacgaagaaatcaagaaaaacctgatgtttaccaccgataatgtcggcgatgtcatgcattcggcgatgaacccgaaagatgcggcaaaatggtttggtgctgctccgcccgatttgacgttgattgcgcgttccaaaggtgcagactacctttacgcctatatgcgcggcttctataaagatccgacccgtccgagcggctggaacaatactgtattcgataaagtcggtatgccccacccgttgtgggagcaacaaggtgttcaagccgttgagttggatgccaaaggtcagccggttatggtaaaagacgaacacggcgagatgaagcctaagctgtattgggaatctaccggtttgcacagccgccgcctgcctaacggcaaagtgatccaaaaagagtacgacgcatatgtacgcgatttggtcaattaccttgtgtacatgggcgaacctgcacaactgcaacgcaaacgtataggctatgtcgtgatgattttcctatttgcggttatgctgcctttggcttacttcctaaataaagaatattggaaagacgtacactaagcgtttggaacaaaagggcaaatcctttagggtttgcccttttttcattttgcctgccgtttgaaaagcctgaatccgtatgccgtctgaacatagctgcaacatttcagacggcatcattctaaaaatgtcagacatcgggaacttaatcagggtttgtggcagattgatattgaattaggaaaaggtctgaaaccgcaagcagcatggtaaggcgatgtcgaacaggtttaaagccaatccgctatattttttggagctatgtcgaacaaacaggtagaatcggaataagcggcggttttgtccggtgtgaaaatgtttgaatattaggataattgatggaactgatgactgttttgctgcctttggcggcgttggtgtcgggcgtgttgtttacatggttgctgatgaagggccggtttcagggcgagtttgccggtttgaacgcgcacctggcggaaaaggcggcaagatgtgattttgtcgaacaggcacacggcaaaaccgtgtcggaattggcggtgttggacgggaaataccggcatttgcaggacgaaaattatgctttgggcaaccgtttttccgcagccgaaaagcagattgcccatttgcaggaaaaagaggcggagtcggcgcggctgaagcagtcgtatatcgagttgcaggaaaaggcacagggtttggcggttgaaaacgaacgtttggcaacgcagctcggacaggaacggaaggcgtttgccgaccaatatgccttggaacgccaaatccgccaaagaatcgaaaccgatttggaagaaagccgccaaactgtccgcgacgtgcaaaacgacctttccgatgtcggcaaccgttttgccgcagccgaaaaacagattgcccatttgcaggaaaaagaggcggaagcggagcggttgaggcagtcgcataccgagttgcaggaaaaggcacagggtttggcggttgaaaacgaacgtttggcaacgcaaatcgaacaggaacgccttgcttctgaagagaagctgtccttgctgggcgaggcgcgcaaaagtttgagcgatcagtttcaaaatcttgccaacacgattttggaagaaaaaagccgccgttttaccgagcagaaccgcgagcagctccatcaggttttgaacccgctaaacgaacgcatccacggtttcggcgagttggtcaagcaaacctatgataaagaatcgcgcgagcggctgacgttggaaaacgaattgaaacggcttcaggggttgaacgcgcagctgcacagcgaggcaaaggccctgaccaacgcgctgaccggtacgcagaataaggttcagggcaattggggcgagatgattctggaaacggttttggaaaattccggccttcagaaagggcgggaatatgtggttcaggcggcatccgtccgaaaagaggaagacggcggcacgcgccgcctccagcccgacgttttggtcaacctgcccgacaacaagcagattgtgattgattccaaggtctcgctgacagcttatgtgcgctacacgcaggcggcggatgcggatacggcggcacgcgaactggcggcacacgttgccagcatccgtgcacacatgaaaggcttgtcgctgaaggattacaccgatttggaaggtgtgaacacattggatttcgtctttatgtttatccctgtcgaaccggcctacctgttggcgttgcagaatgacgcgggcttgttccaagagtgtttcgacaaacggattatgctggtcggccccagtacgctgctggcgactttgaggacggtggcgaatatttggcgcaacgaacagcaaaatcagaacgcactggcgattgcggacgaaggcggcaagctgtacgacaagtttgtcggcttcgtacagacgctcgaaagcgtcggcaaaggcatcgatcaggcgcaaagcagttttcagacggcattcaagcaacttgccgaagggcgcgcgggaatctggtcggacgcgccgagaaactgcgtctgttgggcgtgaaggcaggcaaacaacttcaacgggatttggtcgagcgttccaatgaaacaacggcgttgtcggaatctttggaatacgcggcagaagatgaagcagtctgacttgtgcggaaaaatattgtttcagccggggcgggaatgccgaaagcgcggcgtaactgtactggttctgattttgggttttttgtttgaagtacttaccaaagccttgtccggcgaggtacaccggcaaggcggcggttgtctgagccttttgtgtttcagacggcatcagtgcagatgatgccgtctgaagaccgtagggaaggcggttagaaaaacggattgtgccgcttttcgtgtccgatggaagtcatacgcccgtgtccggcgacaacttgcacggtttcgggaagggtgaataatttgttgcggatattattgattaagtcggcgtggttgccgcgcggaaaatcggttctgcctatggtttcgtaaaacagcacgtcgcccgcaatcagcaattccgcctcggcacaataaaagacgatatgtcccggcgtatggcccggaatatgcagcacttgaaaggcatagcgtccgaccgtgagcgtttcgccttcttcgagccaacggttcggcgcaaaggcgggcgagacgggaaatccgtattgcgcggtggtttgcggcagcgattggagcaggaattcatcgtccggatgcggcccgaggacagggactttatgcgttttcaacatttcgaccacgccgcccgcgtgatcgagatggccgtgcgtcagccagattgccgtgagcgtaagtttgcggtttgccaacgcttgcagcaggaacggcacgtcgccgccgacatcggtcaggacggcttcgccgctttcgtcgtcccaaatcagggtgcagttttggcggaagggggtaacggggaagatttcgtaacgtagggtcatcggcgtgttcctaaacggtttttcagacggcatcgggtttgccgtttgttttatggcggtttgccgcccgttttgatattgggggaatcagatgattaagaagacaatcggcggcatcataccgatttttacggcggttttcatccctgcatcagcaggcgcggcggatttgatgctggcgcaggaatacaaagggcaggatattgccggctgggcgatgagcgagaaactcgacggcgtgcgcgcctattgggacggaaagcacctgatgagccgtcagggctacgcgtttgctccgcccaaaggttttaccgctcagtttccgccttatcctttggacggcgaattgtatagcggacgtggtcagttcgagcagatttccgctaccgtgcgttctgtttcttcagactggcgcggcatccgcctgcacgttttcgatgtacccaaggcgcagggcaacctctaccaacgtttggcagtcgcaacgcagtggctgaaaacgcatccgaacgcgccgattaccatcatcccgcaaatcaaagtgcgcgaccggcagcacgcgatggactttttaaaacaaatcgaagcgcagggcggcgaaggcgtgatgctgcgtcagcccgaatcccgttacagcggcggcaggagcagccaattattgaagctgaaaagccaatacgacgacgaatgcacggtaacgcggcactatgagggcaaagggcgaaacgccggacggctgggcgcggtcggctgcaaaaaccggcacggcgaattccgcatcggcagcggtttcaaagataaagaccgcgacaacccgcccaaaatcggcacactgattacctaccgttaccgtggctttacgcggaaaggcacgccgaaatttgccacatttgtgcgcgtgcgtaccgaccgctgagcaggacagttcagacggcatccgatactttggtttataattttccttttaccgaccgattccgacatatgaccgatttagaaaccaaacgccttgaaacacaggcgatgcttgaaaacgccgatcttttgttcgaccaaggccaatgccgtgccgcactgcaaaaagtggcggacgagattacgcgtgatttgggcggcaaatatccgctgctgctgcccgtgatgggcggcgcggtggtgtttacggggcagttgctgccgctgttgcgttttcccttagattttgattatgttcacgtttcccgttacggcgacaagctggagggcggcgcgttcaactggaagcgtatgcccgatgcggaacaaatccggggcaggcacgtcgtcgtgctggacgatattttggacgaagggcatacgatgtccgccattcaagccaaacttttggaaatgggtgcggcaagctgccgtgcggcggtgttcgccaacaagctgattgacaaacccaagcctatccgagccgattatgtcggactggatgtgccgaaccgttatgttttcggttacggcatggatgcggcgggctgctggcgcaatctgggcgagatttacgcattgggcggaaaataagggcgcgatgccgtctgaaggctgttcagacggcatcgcggccatacgccggcaggataatgaggaacaggacgcataatatgatagggcttttaatcatcacacacgaaaccataggcgaagcctaccgcaagctggcgcatcatttttttccgggcggactgcctgaaaacgtccgcatactcggcgtgcagccgacggaagaccaagacgacatcaacaacaacgccattgccgcgcttcaggaatttcccgacaacgacggcgtgctgattatgaccgatattttcggtgcgaccccctgcaatgccgcccgccgcctcgtgcgcgaaaacaaatcggcgattttgaccgggctgaacgcgccgatgatggttaaggccgtccaatattcgccggcggcggaagaccttgccgcctttaccgaatgcgtcagggaggcggcggtaaaaggcattttcgccatcacgtccgcgcccgaagatttggtgtgccggcgcagcggcgatgccgtctgaagaagcggcagggcaggaaaacattttaaacggcgtctgctgccgatatacataacacgggaatcgaaatgctcaaacaatccatcgaaatcatcaacaaactcggactccacgcccgcgcgtccaacaagttcacccaaaccgcgtcccaattcaaaagcgaagtctgggttacgaaaaacgacagccgcgtcaacggcaaaagcattatggggctgatgatgctcgccgccgccaagggtacggtcatcgaactggagacggacggcgcggacgaggcggaagcgatgcgcgccctgaccgacttaatcaacggctacttcggcgagggcgaataatgagtatcgtgctgcacggcgtggcggcgggcaaaggcattgccgtcggttgcgcccacctgattgcgcgcggtacggaggaagtgccgcagtatgatgttgcggaggcggacaccgatgccgaagccgaacgtttcgatgccgccgtcaaagccacgcgcaaagagttggaacagctccgcagcgcgattcccgaaaacgccccgaccgagttgggcgcgttcatctcgctacacctgatgctcttgaccgatgttaccttgtcgcgcgaacccgtcgatattttaagggaacaaaaaatcaacgccgagtgggcattgaagcagcagagcgacaaactcgccgcccaattcgacaatatggacgatgcctatttgcgcgaacgcaagcaggatatgctgcaagtcgtccgccgcatccacaacaacctgatcgggcagggcaacgagttggaagttgccgacaacctgtttgacgaaaccgttctgattgcaaacgacctttcgcccgccgacacggttttgtttaaagagcagcgcattgccgccttcgttaccgatgccggcggccccaccgggcatacggcgattttgggcaggagcttggacatcccgtccgtcgtcgggctgcacaacgcgcgcaaactgattaccgaaggcgaaacggtcattgtggacggtatcaacggcgtgttgattatcgcgccggatgagtcggtgttgaacgaataccgccgccgtgcccgcgaataccgcagccacaaacgcgatttgaacaagctcaaaaaaaccgccgccgccaccgccgacggggtctgcatcgagcttgtgggcaatatagaatccgccgaagacgtgaaaccgctgcacaacctcggcgcagacggcatcgggctgttccgcagcgagtttctttacctgaaccgcgatacgatgccgtctgaagacgagcagtacgaagtgtacagcgcgattgtcaaaaaaatgaaaggcaaaagcgtaacgatacggacagtcgatttaggtgtggacaaaaacccgcgctggttcgggaaaaacagcacgcccaacggcagcctcaaccccgcgctgggcatgaccggcatccgcctgtgccttgccgaaccggtcatgttccgcacccagatgcgcgccatcctccgtgcggcggtacacggccccgtgcggatgatgtggccgatgattacctccgtatccgaagtgcgccagtgcctcatccacctcgacaccgcgcaacgccagcttgccgaacgcggcgatgccttcggtaaagtcggcatcggctgtatgattgaaattccgtctgccgcgctgaccgtcggcagtattttgaaactggtcgatttcatctccgtcggtaccaacgacctgattcaatacatcttgtccgtcgatcgcggcgacgacagcgtcagccacctctaccagcccggccatcccgccgtgctgaaaatgctgcaacacgtcatccgtaccgccaaccgcatggacaaagacgtatccgtatgcggcgagatggcgggcgataccgcgtttacccgcgttttattgggtatggggctgcgccgtttttccatgaaccccaacaacatcctgcccgtcaaaaacatcattctgcacagcaatgtcggacagctcgaaagtgatattgtgaaagtcatccgctgcgaagacgaagagaagtcggaaaagctgatcaaacagatgaacagcgtgtctgtcgaggaagaagccgacttcaaggggcggaaataaatacggcaggtaaaaaatagaaatacttaacaatgcccgcaatctgaaattttgccattcttgcaaaatagaaaaccgaaacagaaacccaaaatcggccattccctcaaaaacagaaaaccaaaatcagaaacctaaaatccgtcattcccgcgcaggcgggaatctaggtttgtcggcacggaaacttatcgggaaaaacggtttctttagattttacgttctagattcccgcctgcgcgggaatgacgatgaaaagattgttgtcgcttcggataaatttttgccgtgttgggttctagattcccgctttcgcgggaatgacggcagagtggtttcagttgctctcgataaatgccgccatctcaagtctcgtcattcccttaaaacagaaaaccgaaatcagaaacctaaaatcccgtcattcccgcgcaggcgggaatctaggtctgtcggcacagaaacttgtcgggaaaaacggtttctttagattttacgttctagattcccgcctgcgcgggaatgacgatgaaaagattgttgtcgcttcggataaatttttgtcgcgttgggttctagattcccgctttcgcgggaatgacggcagagtggtttctgttgctcccgataaatgccgccatctcaagtctcgtcattcccttaaaacagaaaaccgaaatcagaaacctaaaatcccgtcattcccgcgcaggcgggaatctaggtttgtcggtgcggaaacttgttgaaaactttgcaaaatcccctaaattcccaccaagacatttaggagattttccatgagcaccttcttccagcaaaccgcacaagccatgattgccaaacacatcaaccgcttcccgctattgaagttggatcaagtgattgattggcagccgatcgaacaatacctgaaccgtcaaaaaacccgttaccttcgagaccaccgcggccgtcccgcctatccgctgctgtccatgttcaaagccgtcctgctcggacaatggcacagcctctccgatcccgaactcgaacacagcctcattacccgcatcgacttcaacctgttttgccgtttcgacgaactgagcatccccgattacagcaccttatgccgctaccgcaactggctggcgcaagacgacaccctgtccgaattgctcaaactgatcaaccgccaactgaccgaaaaaggtttaaaagtagagaaagcatccgccgccgtcattgacgccaccattattcagaccgccgacggcaaacagcgtcaggccatagaagtcgatgaagaaggacaagtcagcggccaaaccacacggagtaaggacagcgatgcgcgttggatcaagaaaaacggcctctacaaactcggttacaaacaacatacccgcaccgatgcggaaggctatatcgagaaactgcacattatagtagattaaatttaaatcaggacaaggcgacgaagccgcagacagtacagatagtacggcaaggcgaggcaacgccgtactggtttaaatttaatccactatattatgcgcaaagcctgccgcaaccgtccgctgacggaggcgcaaaccaaacgcaaccgatatttgtcgaagacccgttatgtggtcgaacagagcttcggtacgctgcaccgtaaattccgctacgcccgggcagcctatttcggactgattaaagtgagtgcgcaaagccatctgaaggcgatgtgtttgaacctgttgaaagccgccaacaggctaagtgcgcccgctgccgcctaaaaggcgaccggatgcctgattatcgggtatccggggaggattaagggggtatttgggtagaattaggaggtatttggggcgaaaatagacgaaaacctgtgtttgggtttcggctgttgtgagggaaaggaattttgcaaaggtctcagattgttgtcgcttcggataaatttttgccgcgttgggttctagattcccgcttttgcgggaatgacggcagggtggtttcagttgctcccgataaatgccgccatctcaagtctcgtcattccctcaaaaacagaaaaccaaaatcagaaacctaaaatcccgtcattcccgcgcaggcgggaatctaggtctgtcggcacagaaacttgtcgggaaaaacggtttctttagattttacgttctggattcccgcctgcgcgggaatgacgatgaaaagattgttgtcgcttcggataaatttttgccgtgttgggttctagattcccgcttttgcgggaatgacggcagggtggtttcagttgctcccgataaatgccgccatctcaagtctcgtcattccctcaaaaacagaaaaccaaaatcagaaacctaaaatccgtcattcccgcgcaggcgggaatctaggtctgtcggcacggaaacttatcgggaaaaacggtttctttagattttacgttctagattcccgcctgcgcgggaatgacgatgaaaagattgttgttgtttcggataaaattttgcagccctgataaaaaaatatggctgctttggtaaaaaaatgccgtctgaaaggttttcagacggcattttgtttttaagaagcatcagcggaagcggacgatttcccgttcttcgatatggatgcgtaccgtatccttgcccgataccgccccggcgtgccgcatatcgaggttcagccacaggatgccgtgttccggatggaggacggacaggctgaacgattcgggcaaacaggtacgggataatacgcggcactccatgccgtcttggtcgaaacgcaccgcatgttgcggaatatggcggttatcgtcggtattgggcaaacccatcagtcgggcgacctgcacgcaggatggtgttttgaccaatgtttcgggcgtaccgtattgtagaatcctccctttatgcatcacggcgatttcgtctgccgtcgtacaggcttcttcgggcgaatgcgttaccaaaacggcagggatgccgccgtttcggatacgttcggcagtcatacggcgcagcgtgccgcgcaaatgcgtgtccaaactggaaaacgattcgtccaacagcagcagggaagggcggacaaccaaagcgcgcgccaacgccagccgttgcttctcgcctccggaaagtttttcaggcttgcggtgcgcctcgttttccagtccgacttcggcaagtgccgccatggcgaggcgttcggcttcggctttcggcattttttgcattttcaaaccgaatgccgcattttccagcgcactcatatggggaaacagcgcgtaatcttgaaacatcagcgagatacggcgtttttcgggcggcatacgggtaatgttttctccgttcagccatatttccccgccgtccggccggacaatccccgcaattatattcagcagggtggattttccgcagcccgaccgccccaaaacggcgagtattttgccgcgcccgacagtcaggcagatgttgtcggcgacggttttattgccgaagcgtttgcagagtccgttcagttcaagcatggcgcatcctataaacgtatgccgtccagccactcggacagcggatgggcggcatcaatcagaccgtaacggcaaaacgcgtccagcgtaaccagttgcgcgtcgtgcatcatgtttcccgacaacatggcatccaacagaccgccgatgtccattttctcaaaacccgccacttcgccatcctgattttcaggcaggaaggtttcgggcaggacggcatcgaatacatacaggatttcattgtgtacaccccggctgacggagcgcaggctgtgcagctgcgataccgggcggatgagcggaagcagcgttttatccaaaccggcttcttcgctgctttcgcgacacacggcttcagacggcatttcgccgccggaaacaccgccggcggcagtattgtcgagtttgttgggatcgactgctttgtgcggactgcgcctgcctatccagaaatgccatcggccgtccgattcggtcagaccgttgagatggacggcgcggctgagcagtccgaaaggacggaaagcggcgcgttcgagcgtgaacaaggggttgccgccgccgtcggtcaggtcgaaacactcgttgcgccagccgtccaacagccccgcacagtgccaaccgagggcgaggtgctgtaagcgtccgcccatatcaggccagccgtccgcattcagaaaaatgccgtctgaagactccgagcagcctgcctcccagtcttttttgacgcgttccacccattccggcgacaggttgcccaaaggcagaccgttcagatacagcgttttccagcaactttctgcaccgtaacttgcttttgcccactcgaacagagcatcaaggtcttgtttgctgacggattcggtaaaacggacggtcggcatggttggctttcttgaagacaatgcggaagattgtagccaaactgcctgaatttgcaaccgcaaacagacggcggtctgccgttccgatattgcggccggaaggaaaatccggcaaaaaacggaggcggcaggaaacaggaaacaggaaacaggcaaaacaaaacccctcggcattgaaccgaggggtttgatatttggttgcgggagcaggattcgaacctacgaccttcgggttatgagcccgacgagctaccatgctgctccatcccgcgtcagaagatgaaactatacggcagattttttatgttgtcaaacattacttccgcgaaaaatcataaaattttgccgtccggcggtttatgcctgatttgaaatattattttctttacaaaagttcatgttcgtgatttaattttggttaacattgaaacaggggtgctgcctgatgtttaggcggctgagaaataccctttacacccgatcgggataatacctgcgtggggagttttcacggattctgcttttcagacggcattggttttcaaatgccgtctgaaaacgcaaaacgctcctgtttctttaattctaaacgagaaaacaggagcatttttttatgactacgccaaaaaaaaccgccaaaacttccggcaacgaagcgcgcgagcttgccgacttgagcgaagacatcggcatctgctttaaatatccgaactcggaacgcgtgtatctgcaaggcagccgcgacgacatccgcgtgcctttgcgcgaaatccgtcaggacgacacctacacggcgcaaggtacggaagccaatccgccgattcccgtctacgacaccagcggcgtgtacggcgacccggcggcgcatatcgacctgaaacaaggtctgccgcacatccgcaccgcgtggctggacgaacgcggcgataccgaaatcctgcccaagctctccagcgaatacggcatcgaacgcgcacacgatccgaaaaccgcccatctgcgtttcaaccaaatcacccgcccgcgccgcgcgaaaagcggcagcaacgtaacccagcttcactacgcgcgccaaggcattatcacgcccgaaatggagtttgtcgccatacgcgaacgtttaaaattagacgaattgtcccaaaaaccggaatacgccaaactcttggaacagcacgcggggcaaagtttcggtgcgaacatcccgacccatcccgaccaaatcacgcccgaattcgtgcgccaagaaatcgccgccggacgcgcgattattcccgccaacatcaaccaccccgaactcgaaccgatgattatcggccgcaactttcgtgtcaaaatcaacggcaacttgggcaactccgccgtcacctccagcctgaccgaagaagtcgaaaaaatggtgtggtcgctgcgttggggcgcggacacgattatggatttgtccaccggcgcgcacatccatgaaacgcgcgaatggattatccgcaacgcgcccgtccccatcggcaccgtgccgatttaccaagcgttggaaaaaaccggcggcatcgccgaagatttgacttgggatttgttccgcgacaccctcatcgaacaggcggagcaaggcgtggactatttcaccatacacgcgggcgtgttgctgcgttatgtgccgatgaccgccaaccgcctcaccggcatcgtctcgcgcggcggttcgattatggcgaaatggtgtttggcacatcatcgggaaaatttcctctacacgcatttcgacgaaatctgcgaaattatgaaagcgtatgacgtatcgttcagcctcggcgacggcctgcgccccggctgcattgccgatgccaacgacgaatcccaattcgccgaactgcacaccttgggcgaattgaccgataaagcgtggaaacatgacgtacaagtcatgatcgaaggccccggccatgtgccgctgcaacgcgtcaaagaaaacatgaccgaagagctgcaacactgctttgaagcacctttttacacgctcggcccgctcgttaccgacatcgcacccggctacgaccacatcacctcgggcataggcgcggccaatatcggctggtacggcacggcgatgctttgttacgttaccccgaaagagcatttggggctgcccgacaaagaagacgtgcgcaccggcatcatcacctacaaactcgccgcccacgccgccgatctcgccaaaggctggccgggcgcacaattacgtgacaacgccctgagcaaagcgcgtttcgagttccgctggcgcgaccaatttcgcttaagcctcgaccctgaacgtgccgagagcttccacgacgaaaccctgcctgccgaaggcgcgaaaatcgcccacttctgctcgatgtgcggccccaaattctgctcgatgaaaatcacgcaggaagtgcgcgactacgccgacaagcaaaaagcccaacggcagggcatggaggaaaaagcggtcgagttcgtcaaaaaaggcgcgaagatttacagttaaacgtcaagcaaaaaatgccgtctgaaaaccggaaaaaaggcttcagacggcattctttcgcttgtgaaaatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactataatttttaaaatttttatattcacatagatggggatgatgggatttaggattctgattttgtttttgagagaatgaaggaatttgagattgtgggcgattatcgggaaaaatagaatctttccgccgtcattcccgcgcaggcgggaatctagacattcaatgctaaggcaatttatcgggaatgactgaaactcaaaaaactagattcccactttcgtgggaatgacgggattaaagtttcaaaatttattctaaatagctgaaactcaacgcactggattcccgcctgcgcgggaatgacgaagtggaagttacccgaaacttaaaacaagcgaaaccgaacgaactagattcccactttcgtgggaatgacggcagagcggattctgttgctcccgataaatgccgcaacctcaaatcccgtcattcccgcgcaggcgggaatctaggtctgtcggtgcggaaacttatcgggtaaaacggtttcttgagattttgcgtcctggattcccactttcgtgggaatgacgggattaaagtttcaaaatttattctaaatagctgaaactcaacgcactagattcccgcctgcgcgggaatgacggcatattttgacattgaataaaaaagactaaaaacaggaaaaagccaaacagaaaaaagccaaacagaaaaaagccaaacagaaaacagcgaaacagaaaacagcgaaacagaaaacagcgaaacagaaaacagcgaaacagaaaacagcgaaacagaaaacagcgaaacagaaaacaggaaaaagccaaacagaaaacaggaaaaagccaaacagaaaaaagcctgtctggcgacaggctttttgttgataccaatctttgcagattagaatttgtggcgcagaccgacaccgccggcagtcgctacgaatttgttttcgcctttgccttcttgcaaccaaccggcagaaaccaaggcagaagtgcgtttggagaagtcgtattccgcaccgacaaccacttggtcgtattcgttgcctatgtctgcatcatcaaccaaacctttgaagccgtgggcgtaagaaactcggggcgttacgttgccgaagcggtatgccaaggtagcggcaacttcggtttgagagttgtgcgaattggaagcatcagtcagtttcgcgtcttgttgctgtacggctacggaagcgtacagggcatcattgtcgtaaccgctgaccaaacggtgaatctggtatttctcaatattcaagccctcttgcacttgatgatgtcttttataggcaccgccatattgcacgaagaagccaccgtttttgtagttgaagccggcgtggtaagattcgctgttatgtctgcctgcattgtcgttaagcgcgtattgtacgctgccgctgaggccggcaaattcgggagaatcgtagcgtacggaaatgaggcgtgcctcgggttcggcaattttgtttacacccaaatagtcgcttttgctatcccaaggattgatgtcgccggtgtctttcaggacgctgttcaaacgaccgacgcgcaatttaccgaagccgcctttcaagccgatgaaggattggcggttgccccaaccggagtcagtaccggcgatagatgctttttgctcaacctgccaaatggctttcaggccgttaccgaggtcttcttggcctttgaagccgattttcgaacccaaatcaacgatgccggtagcggttgtaacttcagtaacttggccgttctggtgaaatacagagcgggaagtttctacgccggctttgatggtgccgtacagggtaacgtcagccattgctgcaacaggaagggctgccaaagtcagggcaatcagggattttttcattgctgtattccttttttggttaagaaatttaagccggccgggctttccaagccgcttagctttgcatttaccgccgacgttttcggcgattccatgtctgaaactatagatgttcctgtctgaaaaaacaaacttctgcctgtttttgtgtggaattcgatgtgtattttgaagggcggatagagatattatgggtattttttgttttataacatatggttatttaaattttttaagatttgcatttttacaacacttactcgggagggtattggagggcattgcaaaccgggggttataaagacggcaaaaaacgcgcacgtggtttctttcggaacgggcggatgcaaaacccgcccctgcggcaggagatagtggattaacaaaaatcaggacaaggcgacgaagccgcagacagtacaaatagtacggaaccgattcacttggtgcttcagcaccttagagaatcgttctctttgagctaaggcgaggcaacgctaaccgtcattcccgccacttttcgtcattcccgctcaggcgggaatctagaatctcggactttcagataatctttgaatattgccgctgccttaaggtctggattcccgcctgcgcgggaatgacggctgcagatgcccgacggtctttagagtggattaacaaaaatcaggacaaggcgacgaagccgcagacagtacaaatagtacggaaccgattcacttggtgcttcaacaccttagagaatcgttctctttgagctaaggcgaggcaacgctaaccgtcattcccgccacttttcgtcattcccgctcaggcgggaatctagaatctcggactttcagataatctttgaatattgctgttgttctaaggtctagattcccgcctgcgcgggaatgacgaatccatccgcacggaaacctatatcccgtcattcctacgaacctacatcccgtcattccctcaaaaacagaaaaccaaaattagaaacctaaaatcccgtcattcccgcgcaggcgggaatccaaacttgtccgcacggaaacttatcggataaaacggtttcttagattccacgttctagattcccgcctgcgcgggaatgacgaatccatccgcacggaaacctatatcccgtcattcttacgaacctacatcccgtcattccctcaaaaacagaaaaccaaaattagaaacctaaaatcccgtcattcccgcgcaggcgggaatctaggtctgtcggtgcggaaacttatcgggtaaaacggtttctttagattccacgttctagattcccgcctgcgcgggaatgacggctgcagatgcccgacggtctttatagtggattaacaaaaatcaggataaggcgacgaagccgcagacagtacaaatagtacggaaccgattcacttggtgcttcaacaccttagagaatcgttctctttgagctaaggcgaggcaacaccgtactggtttaaagttaatccactataatgaacacaatccattcagactattcaatcaggcaaacatctcctgcaatactgcaaacagtttttcagccgtactgttgtctaaattgccaagatgtttgaccaatccggctttatccacagccctaatctgttcgggcaaaagcaaaccgtctttatcctgaaagcggacattgacgcggaacggggcaggacggcttccgctcgtcatgggaacgatcagcacagtcttgagatagttgtgtatttcaggaggagagactacgacacaaggacgtgtctttttgatttcgcttcctacggtcgggtctaaggagaccagatagattccgccgcgtactaccatatccattctttatccgcttcgttttcaatttcggaaaaaaaatgctcctgctcggtttcgacaagcattgcggcagcttctgcccatcccctgcgaacggtaggacagcttaaaataatattgcccttttcaactgtaacagccaagctgtctactgcccctatttgacccaataatgatttgggcagaatcacgccttgcgagtttcccattttgcgtatgttgagaatcatatacgtaccatattcacctgtttatgtaataacaatgttagtaccttgatgaggtagtgtcaacatggaaaaagattgcctgacagtttgtccgatttcaaaatctccgcgacaagcatgttttaaagccattcggggatttgggggcggatgatgccgtatgcctcgggatagtcgacgccggtcaggtaaagtccgtcgggcatgaaggtcggcggggctttgaggcggctgcgttcttgaatcagtgcggcgaagccttcgacgctgagtctgccgctgccgacataaacgagcgcgcccatgatgttgcgtaccatgtggtgcaaamaggcgttgccgtgcaaatcgaggcggacgagtcctgagctttgggtaaggttcggcgcggtagatggttttgacgggggattttgcttggcattcggcggcgcggaagctggagaagtcttgttcgccgaccaataaggcggcagcctgccgcatctgcccgatgtcgagtttgaggtgtgtccagcctgccctgtttttgagcaggggggaacggacgggggcggattcgagcaggtagcggtagtgccgtccgtatgcgtcaaatcgtgcatgaaattcgggggcgacctgtcgggcgtgcaaaacggcaatgccttcgggcaggtgggcatttacgccgcgcacccatgcctgttggggacgggcggcagttgtgtcgaagtggacgacttgggcggtggcatgcacgccggtgtcggtcctgccggcaacggtggtggaaaccgcttcccctgctatttgggcgagcgcggtttccaatgccgcctgaacggtcggtacgccgtcagcctgtttctgccagccgtaaaagcggctgccgtcataggatagggttattgcccagcgttgtttttgtgcggtatccatcggatttgggattcggataaatgttcagactgcattgtatcgcagattttgcagggaaacggcaaacgcccagggcgagcggcgttgtttggggagttgttgggggggggggatgcagttgctacgaatcgctatcctgtgaatttaccctgtcaggagtgcccgaatcgtcattcccgcgcaggcgggaatctaggacgtaaaatctaaagaaaccattttatagtggattaacaaaaaccagtacagcgttgcctcgctttagctcaaagagaacgattctctcaggtgctgaagcaccaagtgaatcggttccgtactatttgtactgtctgcggcttcgtcgccttgtcctgatttttgttaatccactatatccgataagtttccgcaccgacaaaactagattcccactttcgtgggaatgacgggatgcaggttcgtgggaatgacgcgaacagaaacctcaaatcccgtcattcccgcgcaggcgggaatctagaccttagaacaacagcaatattcaaagattatctgaaagtctgggattctggattcccactttcgtgggaatgacggaatgtaggttcgtaggaatgacgggatgcaggtttccgtatggatggattcgtcattcccgcgcaggcgggaatctaggtctgtcagtgcggaaacttatcggataaaacggtttctggagatttttcgtcctggattcccactttcgtgggaatgacgcggtgcaggtttccgtatggatggattcgtcattcccgcgcagtcgggaatctagacattcaatgctaaggcaatttatcggaaatgactgaaactcaaaaaactggattcccactttcgtgggaatgacgggatgcaggttttcttaaccccgcgttctagattcccactttcgtaggaatgacggcggtagatttggcagatgcggcggattcggcaggtctcaacccatcctacaatccaccctgaccgccttttacgaatccgccgccatcctgggaaacgcaaaaaaaatgccgtccgaaaacctttcagacggcattttcgcgggcaaatcagtaaaagacttcgcgtcagcttaagcgtttcataccgcacgtcggaccgggcgggtttcgggtttcggaagagcggtgtgaaatgaaacgcggcagacggcgtgtgtgccgccatcctgccccgaaccggcggcaaagcgtcatcgcggtttgaatcgggcgggcgcgtgcctgttccggcacggatgccgtctgaaagcggcgggtcggtccggtccgcgtcagcctaaggcgaaaagttccctgccgtggattttgagccactgtttcgctttgggcgtgtagggggcgaagcggcgggtcagttcccaaaaggcggggctgtggtcgggatgggcgaggtggcagagttcgtgtatgcagacatagtcggcaacgtattccggtgcgccgaccagccgccagttgaagcgtatgcctgtggttttgcggcacacgccccagaaggttttggcagaggtcagcgaggaggaggcggggaacagttgtgtggtgcgggcgtggcgttcgaggcggggaatcaggtaactgtgcgcctgccgttccaaaaagtcccgcagcagcgcaagctgtttttcgggtgcgccttcgggaacacggatttcagacggcatcagcaggatttgcgtgtcttgatgggcggtgagggcaagctgtctgccgtggaagaggatggattcgggcagccggttttcggcagtttgcggcggcggtgttttcgccagtgtttgccgcaggacggcttcgttttcatacagccagcggtttagagcggagacggagaagcagggtgggacgctgatgcggacggtatgtgtgccggcggggcggataatcaggtttttcttggcacggcgcttgatttcgacggtcagttccatgccgtctgaaagggtgtggacaaaggcggtcatgcggtttcagacggcattttggcggcaaacgggcctgcgccggaaataagcggttgttgcgtttcgatgagatgttcgcatttttccatcaattcggcttcgctgccgcttgcgtgcgggatggtcggacagatgacgacggtgatttcccccggatatttcagaaaggagtttttcggccaaaattcgccgctgttgagggcgacggggacgatgtccatctcaaacattttcgccatgcgcgcgccgccgagtttgtatttgccgcgttttccgggcgcaaggcgcgtgccttcggggaaaatggtaatccaatagccttcgtttttgcgcaccaacccctgttttatgagctgctcgttggcttcgcggcggttgttgcggtctatgcctatggttttgaccagtttcaagccccagccgaaaaaggggattttgaacaactcgcgtttggcaacgtaaacctgcggcggaaaaatgtcctgaagggcgagcgtttcccagccgctttggtgtttggcgcagatgacggcggggcggtcggggatgttttccgcgccgatgatgcggtatttgagcccgacgatgtgtttgagcgaccagttgagaatgccgacccagacccgcgccatcttgtgcgccccgtcccggaaaggcgaggcgagcagcataaagggaaagaggaaaatcagggtggaacagagtatcagccagtaaatcaggttgcggatgatgagcatggttttgccttgtcggaatgcggtatgttcagtcggcttgcggtgcggtgttttcctgcatgatgtattgtgagaaatcgagcagggtatcgaaaacctgtgtgtgttcgggcaattcgtgtccgtgttgggagagcgtttttttgccttttccggtcagaaccagcgcgggtttgccgccgacggcatcgattgcctgcaaatcgcgcaggctgtcgccgaccagccaggtttccgaggcttgggcgttgaagcgtccgatgatgtcttcaatcatacccggtttgggcttgcggcagttgcagttgtcggcatcggtgtgcgggcagaaccagatgccgttgatttcgccgcctgcctgacggacgaggcggtgcattttggcgtgcatttcggtaaggttttgaacggtaaaatatttgcgcccgatgccggattggttggtggcaacggcgacggtgtagcctgcctgcgtcagaaatgccaccgcatccatgctgccttcgacaggtatccactcgtcaacggatttgacgaagtcgtcgcggtcctgattgatgacgccgtcgcggtcgagaatgatgagtttcatcgcgtttcctttggattggggcaggtcgggggtggcattatactgaaatatcggtggaaatgcgcctgtgccgcgcgataacgcgcctgttccggcaaccgcttgcaatgcgcgggtacggcgtttcgggggcggttgccgatgttttcctgcctgctcctgcaacggcggattttctgccggacgtattttccgctgcaaaagtctcggcgcggaagttgcggggcaatgccgtttggggacgcggtcaggcggcaagcatttcaagaatcagcccgatgtgtttgtctaaagccgggttgtagttcagtgcccgcatcgggtcggacaggcggtgtccgccctgttttttaaggctgacggcttgggcaacggcttgcgccagggtttccgggttttggcgtgagaaaaagaagccggcttcttcgttcatgacctctgtacatgccatgttttcggagaggacgacgcgtgtgccgcataggacggattcgacgccgaccagcccgaagggttcgtacagggaagccataatggtaaagtcggcggcgcggtagagttcgggcatatcggtgcagaagcccagtccgacgacgtttttcatagggcggggaagcggggagccgacaacggcgagcttgacgggcaggctggtatgttcgaaaaagtcggcaagcagttccagacctttgcgcgtgtggccggtcgatgggaacaggaaaacggtttcatggtcggcaaagccgtatttggcgcgcaggtcggcagtttctccgggttgtggaaagaagcgttccgtatctgcggggggggggggcgacttggattctttcagggggaacgccgtacagtccgaccagttcgcgccgcatcatatgggaatgcgccataatcagtttggcggtggcgtagttgctgcggttgcggcgtatggcgaggcggtcgagcaggttcggtttttgcgccatatggtgcaggtagcccaagtgtgtgccgccgcagatgaggaggtcggcgtaatcggcgtggtggcaggcaatcagtttggcggcactgttttttctggtttgagcgagccggcttgaaaagaggaatgagcgtagttttttcagcgtccggtgttgatcgacaagatggggttcgattagggcgtattcaggaatgctgtgatcaaatttcgtcgcataaacggccggtgtgatgttttgtctgttcagaccctttaccaaatccaatgtgtagcgttccgtgccgccgccgtgtttgaagttgttggttgcaatgtctattttgagcttcatcattgttcctttatggttgcgtcccggtttgtcggggcgggatttgtgcgtgaggggcagggtaatgcgctgtgtgccggaatacggttgccgtttgttgcggcaatgccgtctgaagccgccggcgggcttcagacggcattttgcctttatcctttaaatacggggacgagttccatttggctcaatacctgtgcggcgatgttgacgatgccgaaaaggaagacccaaaccatcagccacaagccgccgtaaactttataggttttgcctgcgccgaattttttgcgcgaacggtagagcagcatggcggggatgatgcctgtccagacggttgccgccaggccgacgtagccgatggcggtaacgaagccggtggggaagagcaggcaggaaatcaggggcggcaggaaggtcagcgcggcggttttggtgcggccggagatgctgtcgttccatttgaagatgtcggcgatgtagtcgaagagtccgagcgttacgcctaaaaacgaggtggcgatcgccatataggaaaacagggacaatattttgtccatattgccggtttgggcgaatttggacagggtttcgatgaggacggagacttgcccttcggcggcgatgacgggggcgaactcgttgcgcggcaggttgccttggatggcggtttgccagaggacgtaaattaccagcgcaatcagtgtgcccgtccagatggatttagccactttgggcgcgtcgcctttaaagtatttgagcaggctggagacgttgccgtggaagccgaaggaagcgaggcagacgggcagggcggtggcggcgtaaatccagtagtttgtgccggcgggggcttgggtatcgaagaggacggacggcttggcatcggcaatcagcccgccggccgcccaaataaaggtcaataccatgccgccgataaggacgccggtgaagcggtcgaccaagcgtgcggatgcccatacgcaaaaggcgaggatgccgaagaagacgagttgtccgacggtgagtgaaacgtcgccgcctgccgcgctgcctaagcctttggcggtcaggtcgccgccgacgaagatataagcgtaagtaagcaggtataaaacgaaggcgacggcgatgccgttgatgatgttccagccgcgtccgagcaggtctttgaccatcgtgtcgaaacttgcgccgtgcggataatgggtgttgacttccaaaatcatcaggccgctggaaagcatagaaaaccaggtgtacagcaacacggccagcgagccggtaaaccatacgccggatgtggcggtcgggttggcgagcatgcctgcgccgatgaccgtgccggcgataatcatcgcgccgccgaacagtgaaggggttttgttgggcatattttgtctttctgccagaaaaagcgagccgccattatgccgtaaagtgtaaggatttgtaaggtatttgcgccgcgccgcccgaaaaggctttcagacggcattgtgttccatagtataatcttgggttttggagtgggcggttcgtcagatgggagggaaaatgtccgacaaaaaatataatgtcgatgagggggaaatcgccaaattcagccggattgccgacaaatggtgggacaagtcgggcgagttcaaaaccttgcacgacatcaatccgctgcggctggattatatcgacggacacgcggatttgtgcggcaaacgggttttggacgtgggctgcggcggcggcatcttggcggaaagtatggcgcggcgcggcgcggcgtttgtaaagggcatcgacatggcggagcagtcgttggaaaccgcccgcctgcacgcggctttgaacaatgtcgccgatatcgaatacgaatgtatccgcgtggaagaccttgccgaggcggaaccgcactcgttcgatgtggtaacgtgcatggaaatgatggaacacgtccccgatcccgccgccatcgtgcgtgcttgtgccaatctggtcaaaccggacggcatggtgtttttttccaccatcaataaaaacccgaaatcgtacctgcatctgattgtggcggcggaatatctgttgaagtttgtccccaaaggcacgcacgactggaaaaaattcatcgcacctgccgagctggcgcgaatgtgccgtcaggcaggcttggatgtggcggatacgaagggtatgacttaccatgtgttgtcgcaaacttatgccctgtgcgattcgaccgatgtgaattatatgtttgcctgccgtccggcgttctgacggcgggtttgcccgtttttgagcaagtgagttgatatgtctgtctataccagtgtttccgatgatgaaatgcgcggcttcctgagcggttacgatttgggggaatttgtttccctgcagggcatcgcgcaggggattaccaacagcaattattttctgacgacgacttcgggacgttatgtgctgaccgtgtttgaagtgttgaaacaggaagagctgccgttttttctggagcttaaccggcatttgagtatgaagggcgtggcggttgccgcgccggttgcgcgcaaagacggccggcttgattccgttttggcgggtaagcctgcctgcctggttgcctgcctgaaaggttcggataccgcgctgccgacggctgagcagtgttttcataccggtgcgatgttggcgaaaatgcaccttgccgccgccgatttccctttggaaatggaaaacccgcgttacaatgcgtggtggacggaggcgtgcgcccggctgctgcccgtcctgtcgcaagacgatgccgcactgctgtgttccgaaatcgatgcgttgaaggacaatctcggcaatcatctgccttcgggcatcatccatgccgatctgtttaaagacaatgtgttgcttgacggcggtcaggtatcgggcttcatcgatttctattacgcctgccggggcaattttatgtatgacttggcgattgcggtcaacgattgggcaaggacggcggacaataagttggatgaggcgttgaaaaaggcgtttatcggcggttatgagggcgtgcgccccttgagtgccgaagaaaaggcgtatttcccgaccgcccaacgtgccggctgcatccgtttttgggtgtcgcgcctgttggattttcattttccgcaggcgggcgagatgacgtttatcaaagacccgaacgcgttccgcaacctgctgttgagtttgggttgagtgcgtccggcgtttgacagaaatgccgtctgaaagggtttcagacggcatttttatggctgattaaaacgaaaatgagacgatagccgggtattttccattttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttttgttaatccactataaatcaatgtaatccattctgttcccgatgtttatgccgtctgaaacccatcctgtgtcgggcttcagacggcatattgcttcaaagcaggttttccgaggcaacccagttcagaatatcggcttcgaccgcttcgggcgtgccggggttggcgattttgaccccgtattcgccttcgcccagttcctcgaggatttccagttgcgaatcgagcatccctgctttcatgtaatgtcctttgcgcgacatcatgcgctcgaggttgatgtcttgcggcggactgaggtggatgaaggcagctttgccttcggctccgcgcagaatgtcgcggtagccgcgtttgagggcggaacaggttacgatggtgtggttcgcaccgttttgcgcctgttgcgtcatccagtcgcgcagattgcccaaccacggatagcggtcttcatcggtcagcggaatacccgcgcccatcttgtcgcggttggcttgggtgtggaactcgtcgccttcggcatagggacattgaccgaggtgtttctgcagggacagcgcggcggtggtcttgccgcagccgcatacgcccataacgacaaaatgcgtagtcatttactatcctttccgtctgtcagacgatggcgaacagcagtgcggacaaggcaaagccgatgagtgcgatgagggtttggttgaccgtccaggttttcagcgtggtcggtacgtccatgtccaagagacggccgaccagccagaagccggagtcgttgaagtggctgcaaccgaccgaacctgccgccgttgccaatacgatacaggcgagctgccagtcggtaaagccggcggcggcaacggcaggagccatcagcgcggcggcggtggtcagggcgacggttgccgaaccttgcgcgatacgcagtgccaaggcgacaaggaaacagcccaaaaggacgggaatgcccaaatccgccatgctgtcggcgagtgccttgccgatgccggaagcgcgcaaaacgccgccgaacataccgcccgcgccggtaatcagaatcacggaacagacgggggcgagtgcgccgtccacggttttttccaacgcgctgccgctttcgccgcgtttgcgtcccaagacaaacagtgcgaccaatacggaaatcagaagggcgatcggtgtcgaaccgattatttttgccgtctgaacccaggtttcgtccgcacttacgagtttttcgctgatgagggccgatacgccggtattcaggaaaatcagcagcatgggaatcagcatgatggcgacgaccgttcctgctttggcaggttctttcggcaggtcgttgtcttgcgtgccgccgctgagcagttcgggaacgggaacatggatggtgcgccccaacactttgccgagcatatagccgctgaaataccatgtgatgaaggcggtcggcagacccaaaatcaaaacttggccgatgttcgcgccgtaaaattcggaagcggcaatcgggcccggatggggcggcaggaagacgtgcatgacggaaaatgcgccgatggaggcaagcgcgaagggcagtacgtcctgtttcatgcgccgtgcggtggcgaacacgatgggcagcatgacgattagtccggcatcgaagaaaatcgggaagccgaaaatcagcgaggcaacgcccagcgcgaacggtgcgcgtttttcgccgaacatccggatcagcgcgtccgccagcgactgtgcgccgccggatgtttcgaccaaacgtccgagcatcgcgcccaggccgaccagaagcgccacgccgccgagcgtgccgccgaagtttttgaccagtatgtcgttgacaatgctgcctgtgggcaaaccggttgccaaagccgtcagcaggctgacgatgaccagtgtcagcagcgcgtggatgcggaatttgacgattaaaatcagaatgaggatgattgccgccgccgaaatgcccaacagggtttgcgcggacagcgtctgtgtccagccgtccatttgtaaagcctttctctgtaataaaagtacaaaattgtcaggtttttttaagttgtgcgaaaacgatagcacaaatcgggcggtaagttgtttgtctgaagttatattcctgtttatttgaacgatttatagtggattaacaaaaaccagtacggcgttgcctcgccttagctcaaagagaacgattctctaaggtgctgaagcaccgagtgaatcggttccgtactatttgtactgtctgcagcttcgtcgccttgtcctgatttttgttaatccactatatttcagacggcgggaggaaggcggatacggtatgtagtcggattgaaatatacggtatgtgggggcttttgggtacaatcgcaacatcagtgtttcaagtggggaaggcgatggatggacggcgttgggtggtatggggtgcttttgccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggccctgttcggggcggacgggctgttgtggcgcggcaggcaggatacgccgtatctgttgttgtacggcaatgtgtttttcaaccttcctgtgttggtcagggcggcgtatcaggggtttgtgcaagtgcctgcggcacggcttcagacggcacggacgttgggcgcgggggcgtggcggcggttttgggacattgaaatgcccgttttgcgcccgtggcttgccggcggcgtgtgccttgtctttctgtattgtttttccgggttcgggctggcgctgctgctgggcggcagccgttatgccacggtcgaagtggaaatttaccagttggtcatgttcgaactcgatatggcggttgcttcggtgctggtgtggctggtgttgggggtaacggcggcggcagggttgctgtatgcgtggttcggcaggcgcgcggtttcggataaggcggtttcccctgtgatgccgtcgccgccgcagtcggtcggggaatatgtgctgctggcgtttgcggcggcggtgttgtctgtgtgctgcctgtttcctttgttggcaattgttgtgaaagcgtggtcggccggcgaatcgtggcgtgtgttaatggaaagtgaaacgtggcaggcggtgtggaatactttgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctgacattgctgttggcggcgttcgcgctgggtattttcctgctgttggacggcggcgaaggcggaaaacagacggaaacgttataatgtgaaccctttttcagaggacggcaaaatgagcgagttggataacatccttgcccataaccggcagtttgtcgagtcgggcgaatatgaaaaatactttaccgacaaataccccgaacgcgggctggcagttttgtcctgtatggatgcgcggattatcgggctgctgcccgacgcgttgggtttgaaaaacggcgatgccaagctgattaaaaatgccggcgcgctggttacgcacccgtggggttcggtgatgcggagccttttggttgccgtgtttgaactgaaggtcagagagattatggtcatcgcccatcacgattgcggtatgcaggggctgaatgccgaagaattcctcgggcgcgtccgggaaagccggattcccgaagaccgtatcgaaaccctgcgttatgccggtatcgacctcgacggctggctgaccggtttcgacaacgtcgaagacagcgtgcgccacacggtggaccttatccgtaaccatccgctgatgccgcgccatatcgccgttcacggactggtcatccatcccgttaccggcaaactgacgctggttgtggacggcagtgtttcagacggcatggacttatcggaaggaatggaaacatcatgaagaaaatcggattgttcggcggtactttcgacccgatacacaacggacatcttcatatcgcccgtgcctttgccgacgaaatcggcttggacgcggttgttttcctgccgacaggcggcccgtatcacaaagacgcagcctccgcttccgccgccgaccgccttgccatggtcgaattggcgacggcagaagacgcgcgttttgccgtcagcgattgcgacatcgtccgagaaggtgcaacctatacttttgataccgtccaaatcttccgccagcagttcccatccgcgcaactctggtggctgatgggcagcgacagcctgatgaagctgcacacatggaaaaaatggcagatgctcgtgcgcgaaaccaatatcgccgtcgccatgaggcagggcgacagcctgcaccaaaccccgcgcgaactgcacgcgtggctgggcaagtcccttcaggacggcagcgtccgcatcttgtccgccccgatgcataatgtgtcgtcaacggaaatccgccgcaaccttgccggccaaggcgtttcagacggcatcccgcctgccgccgcacgctacatccgcgaacacggtttgtatgaaaaataaagtcaaatcagtaagaaacggctataatgccgtctgaaaacatcccgttaggaaaataatgaacgaacaagaactgcaagacctgcaaaaaatggtcggggtcgccgtcaacgccctcggagacatcaaagccaaagacatttccgttctcgaaacccaagacaaaacttcgctgtttgccagaatgattatcgccagcggcgacagtacgcgccaagtcaaagcactggccaacaacgttgccgtcgatttgaaagaagccggttttgaaatcctcagtaccgaaggcgacagcggcgaatggacgctggttgatgcaggagacctcgtcgtccacgtcatgctccctgccgtgcgcgacttctacgacatcgacaccctctggggcggcgagaaaccgagtttccacgccggaatgcagaagccgtggcacgcggcagactgattcccgatgccgtctgaaccttcagacggcattttcctgtaagggagaaagcattgaacatcaccgttttggcagtcggcaccaaaatgccgcgctgggttgatgaggccgtcgccgaatacgccaaacgcttcggacgcgacgtcgcctacgcactcaaagaaatcaaacccgaaaaacgcggcgcgggcgtgaatgccgcccaaggtatggcggcggaagaaaaacgcatccttgaagccattccgcaaggcgcgttcctcgtcgttcttgacgaacgcggcaaagcaccgacctccgtcgagctggcggaacacctcaaaagctggcggcaaaacggcgaacacgtctgcttcgtcatcggcggcgcggacggcatgaccgaccgcctcaaacagcaggcacgcatgatgatgcgcctgtccagcctgaccctgccgcacggcatggtgcgcgtctttctgaccgagcagctctaccgcgccgtttccatcctgcacaaccatccctatcatcgggaataagaaggcttttgtccgtatccctaatcggttaaaatcaccccgttatttctgaacacagcaaaggaatccgctatggcacgcatggtattctgcgtcaagctcaacaaagaagccgaaggcatgaaatttccgccgcttcccaacgaattgggcaagcgcatttttgaaaacgtatcgcaagaagcgtgggcggcgtggacgcgccaccaaacgatgctgattaacgaaaaccgtttaagcctcgccgatccgcgcgcgcgcgaatacctggctcagcagatggagcagtatttcttcggcgacggcgcggatgccgttcagggatacgttccgcaataacggttttccgttttgaacacaggctgtccgaaactgcttcagacggcctttaaaatacgccggacaactttatcttcacgcaaccggacaaattttgacattgggcaatgttaaaatcccccattattcccaaccgcgctttcaggagcagatgatatgcaacacgacgtttacgactacaccgcgcatacggtttctaaaaacaccgtcctgcagaaaacctaccgcctgctcggattttcatttattccggcttccgcaggcgcggcacttgccgccaatgccggtttcaatttttacgccgccttcggttcgcgctggatagggtttgccgtcgtgttggcgtttttctacggtatgatccacttcatcgagaaaaaccgttacagcaataccggcgttaccctgctgatggtattcacattcggtatgggcgtattgatcggccccgtgctgcaatacgcgctccatattgccgacggtgcgaaaatcgtcggcattgccgccgcgatgaccgccgccgtctttttaacgatgtccgccttggcgcgccgaacccggctcgatatgaacgcgctcggacgcttcctgaccgtaggtgcggtcattctgatggtcgccgtggttgccaatctgtttttgggtattcccgcactcgccctgaccatttccgccggttttgtcttgttcagttccttaatgattatgtggcaggtacgcaccgtcatcgacggcggcgaagacagccacatcagcgcggcactgacactgtttatctcgctttacaacatcttcagcagcctgctgaacatcctgttgtctttaaacggcgaggattgatgccggtaaaacgccgtccgactatgccgtctgaaaatgcttcagacggcattttactttgggcatacaatacggatgcacacgcaccaacacacagccgactatgaagccgggaggaatcaaatgttaccgaatacaccgcgccgcgccgtttatgccggcagtttcgatccgcccacattggggcatctgtggatgatacggcaggcgcaatctatgtttgacgaactcatcgtcgccatcggcattaaccccgacaaacgcagcacctataccgtcgctgaaaggcaggatatgttgtgcgatattactaaaatgtttcccaacgtcagaaccgatgtatttgaaaaccgatttctggtgcattacgcccgtgaggtagatgcaggattcatcgtgcgcggcatccgttctgcttcggattacgaatacgaacgttccatgcgccatatcaacagcgacctcgcccccgaaatatccaccgtattcctcatgccgccgcgcgaaatcgccgaagtgtcgtccactatggtcaaaggactggtcgggccggaaggctggacggaaacgatccaccgctacgtgccgcaagctgtgtacgaaaaaatccttgccgaacatcaacacgaaaattgaacccttctatttttgcaaggcatatatggatatgttggaaattttgttccgccatcaagacttcgtcgccatcaacaaaccgggcggcatatccgtccaccaagacagcggcgagaccggactggcccgaacactcgccatacagttgggcgtagagcgtgtgtggctgctgcaccgattggacaaacagaccagcggcattttactgtttgccctcaacaaagaaagcgcgtccgcccttagcggacagtttgccggcaaaagcatcaaaaaaacctatttggcactgtccgaccgcaagccgtccaaaaagcagggttggattaaaggcggaatggaaaaatccagatgtggaatgtggaagttgacgcgcaatacagaaaatatcgccgttacccgattccacagcatcagtatcgccgaaaaactgcggctgttcatcctagaaccgcatacgggcaaaacgcaccaattgagagtggcgatgaaaagtttgggcagtccgattctgggcgacagcttatacggcggaacagaatccgaaaccatgtttctgtatgcatggaaaatacaatttgactaccaaaaccgacaaatcgaaattgttgcacccttaaaaaacgaatggcagactgaaaatatccatcgggcactggaagaattctgtatggaaaataaaattgactgatataaattaaatttataaacaaatagataaatatttttaaaaaaatttctt

SEQ ID NO: 7 - DNA, 56609 bp, Neisseria meningitidis
  misc_feature (23260)..(23260): N is any nucleotide
cttgtccgagaatgacgcttttgacccggtcgaacgctgtcaggcggaatgcgttgaacacatccgccgccggcggatagatgatttgtcccgacaaacgttcctgcctgactgcatttaaaatttcctgaaaatacggctgctgtttttcgccgccgagtgcatcgtgccaagtgtccatatctgccctatcctttcaaattcggctatactgctgatattgcgttattttgtcaaacgacgcgctttgtggggaaatgtatgactgtatggtttgttgccgctgttgccgtcttaatcatcgaattattgacgggaacggtttatcttttggttgtcagcgcggctttggcgggttcgggcattgcttacgggctgaccggcagtacgcctgccgccgtcttgaccgccgctctgctttccgcgctgggtatttggttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaacactcggaggaattatggaatttttcattatcttgttggtagccgtcgccgttttcggtttcaaatcctttgttgtcatcccacaacaggaagtccacgttgtcgaaaggctggggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggcatcatctatttccaagtaaccgaccccaaactcgcctcatacggttcgagcaactacattatggcgattacccagcttgcccaaacgacgctgcgttccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataagccgtgatgaaaatgccgtctgaagtccagttttcggggttcagacggcatttttatttaaacccgggcaaggttgtattccgcttcaaatatagtggattaacaaaaaccagtacggcgttgccctatttgtactgtctgcggcttcgtcgccttgtcctgatttttgttaatccactatatgtttcggaaccgcctacctgccccggtaaaaactgccggcaaaatatttctgcacgccctcgcgaagcaagaccaaggttacggcggccaaaggcaatcccgccaacattccgacaaagcccatcagctgcccgaacgccatcagcgaaaagataacccaaaacggcgacagcccgatacggtctcccacgattttcggcgtaatgaaaaaactttcgagaaactgtcctacggcaaaaaccgcccaaaccgataggatgccgttccacgaaccgaactggagcaaggcggcgacggtggcaagcagcaatcccgtaaacgccccgagataagggacaaacaccaaaataccggcaagcataccgatggcaaaccccgaatccagcccgaccagcaccaatcccaaaccgtaaaccaagcccataatcagcattaccagaagctgcccgcgcaaaaattcgcccaatacctcgttcaaattgcctgtaatgcgcgtataagcaccggcaaaacgcctcggaaccagtttggcaatgccgcacgaccaccgctgccaatccagcaggaaatagtaaagcagcaagggaagcagcagcaggttgccgatactgctgacaatattgccgccctgcctcatcaaaacgggaaaccacgccttaagcgcgttgctcaactctcccgtatgcgcctgaagccacgcaataatagatgcctgatcgatttccacatatccgccgattgtatttttcaaccacggcagcagcgtgttctgcataaaaccgattaattggggcaggcgcgatgccaaattgttgaactgcccgaccagcatagggacgataatcaacaataatgccaacaacaaaatcaaggaaaacaccatcacagacatcgaagcggatgcacggttcaaaccctttttctgcaaccattcgaccaaagggtccaatacatacgccagcaccgccgcaaccgcaaacggagtcaaagtatcgccgagcgcgaaaaccagccagaccaaggcggcaaacgccgcaccggcacccatccacggcttgatgccccgccctttcctccgatacataaaaaccacccttctaaaaataatattgtgcgccagtatagcagaaccgccgcgccgtcaaaaaagcctccgccttcccgatagcctgttatcgcggtttaggctaaaataacgcacatccgatgccgtctgaaaggcaaacccgccttcagacggcataccgtacacgacaaggcagcacatcatgaccgaacaaaaaaacaaaacatccctcatcgaatttccctgcaccttcccattgaaagtaatgggcgcggtgcatcccgagttcgagcaggcggttttagacaccgtccgcctccacgcccccgacacgcaggcgcaccacatcaccacgcgtccgagcagcaaaggcaactatactggcgccaccgtacaggtaaaggttgaaaaccaagaacaattggacaacatctaccgtgcgctgacttcgcacgaactggtcaaagtggtactttgagatgaaaatcatacacaaaggtttggtcgaatatctgccgacttttgaagcgatgaaaacctttaatgccggacggaatgccgacaccgaagacgaactgtgggtcgtcgaacacccgcccgtgttcacacaaggactggcgggaaaacccgaacacctgctgattcgcgacgacattcccgtcgtccaaatcgaccggggcgggcagattacctatcacgggcccgggcaattggtcgtttatacgatgattgatttcaaacggcgcaaaaccagtgttagaaacatcgtttccgcgcttgaaaacagcatcatcgccacattggcagaatacggcatcgaagcggcggcagaccccaaacgccccggcgtttatgtcggagaacgcaaaatcgcctcactggggctgcgtatcaaaaacggctccgtctatcacgggcttgcgctcaacgtcaatatggatttaagcccgtttacccacatcaacccctgcggctacgccggtatggaaatgacgcaaatcgcggattttgtccaaccctgccccacgccggacgaagtcgccgccaaactcaccgcacaccttgaaacacaattcacaccgaaagcagacaacaatgagtgaaatcaaaaccgacgaccccaaacgcggcatcaaactcagaggcgcggacaaaaccgcgcgcatccccatcaaagtcgtcccccttcaggaaaaactgaaaaagcccgaatggatacgcgccaaactcccatcgcgcaaattctttgaaatcaaagacattttgcgcgaacaaaagatgcacaccgtttgcgaggaagcctcctgccccaacatcggcgaatgcttcagcaaaggcacggcgaccttcatgattatgggtgacatctgcacccgccgctgcccgttctgcgacgtgggacacggtcggcccaatatgctcgaccccgacgaaccgagaaacctcgccgaatccgtcaaagccatgaacctgcgttacgtcgtcatcacctccgtcgaccgcgacgacctgcgcgacggcggcgcacagcatttcgccgactgcatcaaagccatccgcgaaaccagcccgaacaccaaaatcgaaatcctcgtccccgacttccgaggacgcttggacatcgcactcaaaatccttgccgaaaccccgcccgacgtgatgaaccacaacctagaaacccatccgagcctgtacagaaaagcccgtcccggtgccaattatcaacattctttagacttattaaaacgttataaagaaatgatgccgcacatcccgaccaaatccggcatcatggtcggcttgggcgaaacagacgaagacgtgcgtgaaattatgcgcgatatgcgggcgcacaatatcgaaatgattaccatcggacagtacctccagccttcagacggacacctgcccgtcctgcgctacgttacgcccgagcagttcaaaatctttgaaaaagaagcatacgaactgggcttcagcaatgccgccatcggcgcgatggtacgttccagctaccacgccgacgaacaggcggcggaagccttgagggaaagccacggcggttgcgggcatcattaaacccggaacaccgcgccaaagtaaaaagcgattccctgcgcctgccgcgccgtttggcgcaagccgcacccgtgttagccgcctatgccgtctgaaagcccttcagacggcataatttattcccaaaatccgataatcttgtaaattctgacgctatttgcgactttataacgctaaatgaccgagcagatatggatcaacagccgttattgaaattgccgaattcccacataataatttggcgaatggatgggttagggaagattttttcccaattgaaaaataacgataacctgtttattgaagcctatttacgcccggttaactttcatagtaactcttttgaataaaaagaaaacttcaaaataatcatcccgacatacttctcacaattagcgtacaacatctgattatcagggtacgctgtcagttttttattgacaatttaattcaaatttcctatattttgtccttaactattccttacatttcatttaagaaaacccatcatgaacaagcgatgctacaaggttatcttcaacaagaaacgcagttgtatgatggctgtagcagagaatgttcatcgtgacggcaagagtatgcaggatagtgaggcggcttcggttcgagtgaccggtgccgcttctgtttcttctgcccgggcagccttcggtttccgtatggctgccttttctgtcatgttggctttgggtgttgctgcgttttcccctgcccctgcttccggcatcattgccgacaaatccgcccctaaaaaccaacaagccgttattcttcagacagcaaacggtttgccgcaagtcaatattcaaactccgtcatcccaaggcgtttctgttaaccgattcaagcagttcgatgttgatgaaaaaggcgtaatactaaacaacagccgcagcaatacgcaaacgcaactcggtggatggattcaaggcaatccccatctggcacgcggcgaagcgcgggtaattgtgaaccagattgacagcagtaatccttcgttgttgaacggttatatcgaagtcggcggcaaacgcgccgaagtagtcgttgccaatccgtcgggcatccgtgtgaatggcggcggattgattaatgccgcttcggttacgctgacttcgggcgttcctgttttgaataacggcaatctgacgggctttgatgtttcttcgggtaaagtcgtgattgggggcaaaggtttggatacctctgatgccgattacacccgtatccttagtcgtgctgctgaaatcaatgcgggcgtttggggtaaagatgtcaaggtggtttcgggtaagaacaaattggattttgacggctctcttgccaaaacagcttctgcgccatcttcttcggattctgttactcctaccgttgccatcgacaccgccacactgggtgggatgtacgcagacaaaatcactttaatcagcaccgacaacggcgccgtaatccgcaacaagggtcggatttttgccgcaacaggcggcgttacgttaagcgcagacggcaaattgagcaacagcggttcgattgatgctgccgaaatcaccatttccgctcaaaccgttgataaccgccaaggctttatccgcagcggcaaaggcagtgtattgaaggtttcagacggcataaataatcaagcaggcttaatcggctcggccggtttgctggatattcgcgatacaggcaaaagcagcctgcatatcaataacacagacggcacgattattgcgggcaaagatgtttccttacaggcaaaatcactggacaacgacggcatattaaccgccgcacgcgatgtttccgtttctcttcatgatgattttgccggcaaacgcgatattgaagccggacgcacactcacgttctccacccaaggccgtctgaaaaacacccgcatcatacaggcaggcgataccgtatccctgaccgccgcccaaatcgacaacactgtctccggtaaaatccaatccggaaaccgcaccgggttaaacggcaaaaacggcatcaccaacaggggtttaatcaacagcaacggtataacgctgctgcaaaccgaagccaagtcggacaatgccggcacgggcagaatttacggcagccgtgtggcagttgaggcagataccttgttgaaccgggaagaaacggtcaacggcgaaaccaaagcggcggtaattgcagcgcgggagcggttggatattggagcgcgggaaattgagaaccgagaggcggcattattgtccagctccggcgatcttcatatcggttctgcattgaatggaagccgacaggtgcaaggagcaaatacatcactgcacaaccgcagtgcggcaatcgaatcatcaggcaatatccgtatcgctacaaaagatttgcagaataccaatgagcatctgcgtttccatacggaagaaacccatcgcgaacaccgtatcgaatatcaggcggaaggcagaacagaacgctatccggaaggttctcaaaaagagttgggctgggaaatatttgaagatgagtctttacatatgcggactccggacggcagcccccactctgtctggtacaaatacgattacgaacgaatcaccgccgagagcaaaattaccgaatccaagcccggtcaaatcatcagtggcggcaatttggttttagatgccgccaagctgaaaaatcataacagccggattattgccggcggcagattgatcgtcggtacgcccgaatccgcattggacaatgatgaaactttgggaacaaaaaccataaccgataaaggggacttgcaccgttaccaccgtcatcacaagaaagggcgggattctacgggatacagtcggtctccctacgaaccggcccccgaagtcagctccatccgtatgggtatttcagcctataaaggctatgcgccccaacaggcatctgatatacccggcactgttgtacccgttgttgctgaaaacggcatccatcctacatttactctgccgaacagcagcttgtttgccattgcgccaaacaacaaaggctatttgattgaaaccgaccctgcctttaccgactaccgcaaatggctgggcagcggctatatgcttgccgcactgcaacaagacccgaaccatatccacaagcgtttgggcgacggctattacgagcagaaactggtaaacgaacaaatcgccaagctgacaggctaccgccgcttggacggttataccaatgacgaagagcaattcaaggctttgatggataacggcattaccatagccaaagaattgcagcttactccgggtattgccctgtctgccgaacaggttgcccgtctgacttccgacattgtttggctggaaaacgagaccgttaccctgcccgacgggacaactcaaaccgtattgaaacccaaagtctatgtccgcgcacgccccaaagatatgaacggacaaggggcgttgctgtccggcagcgttgttgatatcggcagcggcgccattgaaaaccggggcggcttaattgccgggcgcgaagcactaattttaaacgcacagaatattaaaaatctgcaaggtgatttgcagggcaaaaacatcttcgccgcagcaggcagcgacattacgaataccggcagcatcggcgcagaaaacgccctgctgctcaaagcgagtaacaatatagaaagccgcagcgagacccgcagcaatcagaatgagcaaggctcggtacgcaatatcggccgggtggcaggcatttatctgaccggcaggcagaatggaagcgtcttgctggatgcaggcaacaatatcgtcctgacggcttccgaattgaccaatcaatctgaagacggtcaaaccgtactgaatgccggcggcgacatccgctcggatacgacgggcatttcccgcaatcagaacactatctttgattccgacaactatgtgattcgcaaagaacaaaacgaagtcggcagcaccatccgcacccggggcaatctcagtctgaatgcaaaaggagacatccgtatccgtgcagcagaggtcggcagcgaacaaggccgtctgaaactggcagccggacgggatatcaaagtcgaagccggcaaagcccataccgaaaccgaagatgccctgaaatacaccggtagaagcgggggcggcatcaaacagaagatgacccgccatctcaagaaccaaaacggacaagccgtatccggcacgctggacggcaaagaaatcattctggtttcaggacgcgatattaccgttactggcagcaatatcattgcagacaaccataccattctctcggcaaaaaacaatatcgtccttaaagcagccgaaacacgcagccgcagtgccgaaatgaacaaaaaagaaaaatccggactgatgggcagcggcggcatcggctttacggcgggcagcaaaaaagacacgcaaaccaaccgatccgagaccgtcagccacacagaaagcgtcgtcggcagcctgaacggcaataccctgatttcggcaggaaaacattacacccaaaccggttcgaccatatcctcgccccaaggcgatgtcggcatttcctccggaaaaatcagcatcgatgccgcacaaaaccgttacagccaagagagtaagcaggtttacgaacaaaaaggcgtaaccgtcgccattagcgttccggttgtgaataccgtaatgggcgcggttgacgccgtaaaagcagtccaaaccgtcggcaaaagcaaaaacagccgggtcaatgccatggctgctgccaacgccttgaataaaggagtagattccggcgtggcactctataatgccgcccgaaatcccaaaaaagcagccggtcagggcatcagtgtctccgttacctacggcgaacagaagaacacctccgaaagccgcatcaaaggcacgcaggtgcaagagggcaaaatcaccggcggcggcaaagtttccctgactgcttcaggcgcaggcaaagactcccgcatcacgattaccggctccgatgtgtacggcggcaaaggaacacgcctcaaagcagaaaatgccgttcagattgaagccgcccgccaaacgcatcaggaacgcagcgaaaacaaatccgcaggctttaatgccggagtcgccatcgccatcaacaaaggcatcagtttcggcttcacagccggagcaaactacggcaaaggttacggcaacggcgacgaaaccgcctaccgcaacagccatatcggcagcaaagacagccaaaccgctattgaaagcggtggcgataccgtcatcaaaggcgggcagcttaaaggcaaaggcgttggcgtaacggcagagagtctgcatatcgaaagtttgcaggataccgccgtgtttaaaggcaaacaggaaaatgtttccgcccaagttacggtaggctacggctttagtgtcggtggcagctataaccgctcgaaaagcagctcggattatgcatccgtcaacgagcaaagcggtatctttgcaggaggagacggctatcggattcgcgtaaacggcaaaaccggattggtcggcgccgctgttgtttcagatgccgacaaatcaaaaaacctgctgaaaacaagcgaaatctggcataaagatattcaaaaccatgcttcggcggctgcttccgccttgggcttgagcggcggtttttcatacagcccgaagcctaccagcggacagtattccaccaaaaaagaagcagaaatcggtaaaatcggcggcaaaccggtcagcctgatgcgttttgaccaggtttcggcgaaagacgacgagttgaacgaaaaatatcgaagtgagcgtattgaaaaaggggaaacctttaaagaggcaaatttaaatcaaaacaacgccggcggcttgaaattcggtttgaagcaaaacgatatacacagcaacgacaaatacgccttggcaaaaatgggtttgggcaatctgttgggcaatgccaaagaatcagaaagccgccaatccattacccgctccgtcatcagtgagggagattggcaaattgcttccgcgcagggcaggaaaaatattgccggtattgaaaaaggcacttcatccgcacataaggcattggcaaaagcagaccgcgaaggcttgctgaaagaagtcgaactcaatagggatgttgccaaagagtttatcaatgagacgctgatcggcggcattgcagacgaagcctaccgcagccagtttattgcagaacaccgcctgatgacctttaaaatggatgaaaacggcgagccgattgaagataagcagcttgaagaggatataaataaacagtttgacaactcagtaaagttgaaaaaagaatttgcctcatttaaagattattgggaagcctataaagccattgggggaaatatctacgaattgcgcgaagtatccgaccaggaacggaaaaatctgaaaactgcccgttacaccgacccggagaccggcaaaaccgttgaaaaaatcgttgtcggcgtcaacggcattttcaataatatacaagcagccgccaaatttgccgcccaacaatatgtggggcgtttcaatcccgagaaaaaccgatatgaacgcacctatgaaaatgtttatttcctgcacaatccggaaaccaatgggcggggcttttcaaaattgcccgaaatcgccgttgcggcctttcataaaatgctcgaaggggcaaaaataggcaataagaccgttatcggcttgagcaattcaggcttggctttaggcaatatcatggaagactacgggaaggataaaaacggcctgtttgtcggctcgcacagccgtggaaccctggtggtcgacaatgtactcaataccttgaatacccaagccaatcgggataagaaaattttatccaataccgaactgaaaatggtcggccctgccgccaacgttgtccgggcagataaaaggctgtttcaactgcagcagggggtaacgacacccagaacggcagatttcgcccgtcagtccatccaaatagaaaaccacgaattagaccttatcggcatgctgattggcagaaatccggcaacagtcggaaccaatacccggcaaaaaagccaatggcaggctataagggatattataggggattacacctcgccgcataattgctacggtatggctaataaacaatgtgtaacagatggttatcgagaccctgaaaataaacaaacccaaagtccgacaggtgtatttgaaagaggagtgtccaacgaaatcgaaattatgtaccgtcctgtacgcatttatgatctgcaacatccgaaaggaaaaacaaaatgaaatatatcgtatcaatctctctggctatgggattggctgcctgttcgtttgggggattcaaacctccgcccgatgactcggcattttggagattgacaaattacgccaaactttatccgggattaacctcagcgacacttgaccaatacccacctgaagagagacgaagacaactgcatgattcttttgctagagaaaaaaaagactggaaagagtgcggctatgacccaataggtgggggcggtgggagtgaagcagatgcctgcatgagaaaaagaggttggtatcgtgtaggtaacgacatttatcccgaaaacaaaaaatacgaatggcctcgagaagaaggaaaaacaaaatgaaatatatcgtatcaatctctctggctatgggattggctgcctgttcgtttgggggatttaaaccaaatccgtgggacgccgcgtcattttgggaattgaaaaattacgccaatccctatccgggatcagcctcggcggcacttgaccaatatccatcgaaagcaagacgaaggcaactgaaagacatgcaagagtgcggctatgacccaatagacggcggaaagtctgaagcagatgcctgcctgaggaaaaaaggctggtgtcgtaagggtttcgacccttatcccgaaaacaaaaaatacgaatggcctcgagaagaaggaaaaacaaaatgaaatatatcgtatcaatctctttggctatgggattggctgcctgttcgtttgggggattcaaacctccgcccgatgactcggtatactggaagtattcccgtatagaacaagaatatccggcaatgatgagtaaaaatatcaatttacgcatatattcttatgaagaatatagcaaacaaatagatgatctttttgctaaggaaaaaaagactggaaagagtgcggctatgacccaataggtgggggaggaggaagtaaagcagatgcctgcatgagaaaaagaggttggtatcgtgtaggtgacgacatttatcccgaaaacaaaaaatacgaatggcctcgagagaactgaaacaaggctgcctgaagggaaactttcaggcagccttgttttattgtttcgacaacgctggaaacctcataatccgttttcctttttcactcccccggtggtacagccaccttatttcacgtttcggaaacagatgcaccagaattcttttcatcatacggctgtcgccgaaaggtgcgaaccagttgataagccacattctgtttccactgcaccagttttccgagtggcgcagaacatcattggattggagatattgccattcggtttcttcatcgaaataagcccaagtgcagtaggcgacggggtgtccgttgctgctgaacaaggcaaattgcccgtttttcaataccggcaagatattgacggcggcttcttgtacgccggcatgctgataaataggcgaaactgcccacaaccataccaaagcgccgaatgcttcggtttcattgaatgtttcctgcgggaacagttccggcgaaataatatcgatattttctatcttcatgattttaaatttaagttttaataaggtttggaataaatagcggatattgaccccggcagccgcgcgcttcgtcctaaaataccgggcttcttcaaagcccctgccgcaaacacatcatacgacagattgcccttcgcattaaacacaccttcaaaccgacagccgctccaagcagcgtctgtccgggcaggcatgccgtctgaaagcccctcagacggcataatttattcccaaaatccgataatctcaaaagaatctgtcggttaatgagaacgattcattataaattttgataaaaaaccgtgctctatttgttttttgctatggttaataagtgtaaatgttctttatggatgagatggattcttagttttagcagcaaaaaaaccgataagaaacagcatactgatttggaaggcatcggggaatacgccctatttcttttgataattgtttgtattttaaatagaaaatttgtcatgccgacagcttttgcatacaatgcacgcatcccgaatagcgacacagatgctgttcagacataccgaaaaccaagttacagaaagagagatattatgcaaggcaatcaagctgttgttgattatatgaacgaattgctgtctggcgagctggcggcacgcgaccaatactttatccactcccgcctctactccgaatggggctacaccaaactttttgaacgtctcaaccacgagatggaagaagaaaccacacacgccgaagacttcatccgccgcatcctgatgctgggcggtacgccgaaaatggcacgcgccgaactgaatatcggcacggacgtggtttcctgcctcaaagccgacctgcaaaccgaatatgaagtacgtgatgcgttgaaaaaaggcatcaaactgtgcgaagaggctcaagactatgttacgcgcgacctgatggttgcccaactgaaagataccgaagaagaccacgcccactggctggaacagcagcttcgcctgatcgagttaattggcgaaggcaactactaccaaagccaactgtaatccgtattcggaataaaaggagtccgtatgaaaggcgaccgtttggttatccgcgagctgaacaaaaacttaggcttgctgctggtaaccatcaaccaatatttccttcacgcccgtattttgaaaaactggggctttgaagaactgggcgaacatttcttcaaacagtccatcgttgaaatgaaagctgccgacgatttgatcgagcgcattctgttcctcgaaggtctgccgaacctgcaagaactgggcaagcttctgattggcgagtccaccgaagaaatcatcgcctgcgatttgaccaaagaacaggaaaaacacgaagccctgcttgccgccatcgccacagcagaagcgcaacaggattacgtcagccgcgatttgttggaaaaacaaaaagacaccaacgaagaacatatagactggctggagacccagcaagagcttatcggcaaaatcggtctgccgaactacctgcaaacagcggcgcaagaggactaaaacacaaaccactgccaaatacagcagtcccccgcaccatcagacggcatatccgtataaacggatatgccgtttttctttttcggtttgcgaataaaatctaaattgatttgaatcaatacctgataagggtttttgtttgataataccgatatgaaattcagggtgcttgtttgctgtttcccaatctgtcttgattttatctctttcctcttgatgtgtgtgtgtttgggtgtggctgccgccaccccttttttttggcttttatgtgaagtaaaatccgtaacagcaaatgcttaactttaaccatttatctggaagcaaatgatgggcaacaaattgactctgcctgccgaactgcctgacgaacaggatttgcgggcggtattggcatacaatatgcggcttttccgcgtgaacaagggttggtcgcaagaagaattggcgcggcaatgcggtttggacaggacttatgtgtcggcagtcgagcgcaaacgctggaacatcgccctgtcgaatatcgaaaaaatggcggcggctttgggcgtggcggcgtatcagttgctgctgccgccgcaggaacggttgaagctgatgaccaattccgccgatacccgacaaatgccgtctgaaagcggtatttgaccgccgaaccatccgcctccctttttcccgccaatcgaaagaataaaaatgcctgcaaacctgtcttcagcactggaaaccttcaaacagcagcgcgatgccgccgaagcgcattatttgaaagccaaccgcgtgtcggtatttttcagagaatacacggcggcagtcgaaaccttactggcggcattgtgggcagagtattttcaaaacagcgcgttatgcctgatggcggtaggcggcttcggacgcggcgaactgtatccctgttcggatgtggatttggcggttgtctcccctgccccgctttcagacggcattcaggaacagattgcccggtttgttcaaaccctgtgggactgcaaactgatgccgtctgtaaaaagcggcagcgttgatgaactatgtgaaagcgtgcgcaatgatattacgggggacacagcgtttttagaggctaggtttttgtttggcaaccgccaaacggtggataaactggcggaaaaaatgaacgcgcagcgcaatgtggcggcgtttgtcgaggcaaaactggtggagatggaacaccgccacgccaaatcgcaaggttcgggggcagtattggagccgaatatcaaaagctgtccgggcggtctgcgcgatatccacaccctgctttggatagcgaaggcgcaaggcttggcgaccgacctgcccgacctgctcaaacagcggattttgacgcgtgccgaagccggtatgctttcgcacggctaccgccgcctcgcccacatccgcatccatctgcatttaaacgccaagcgcgccgaagaccgcctgctgttcgatttgcagccgcaagtcgccgaaagcatgggttatgaaggcttgaacctccgccgccaaagcgaagaactgatgcgcgtgttttaccgcgcgattaaaaccgtcaaacaactgggcggcatcctcacgcctatgctgcaaagccgcgtttcctccaccccgttgcgcgttaccctgcggattgacgacgactacatccaagtcaacaaccaaatcgccgcgcggcacaccgatatttttttcagacggcccgaacacattttcaaaatcgtcgaaatcatgcagcagcgcaacgacattaccgcgctcgaaccgcaaaccctgcgcgcctggtggggcgcgacgcgcaaaatcaaccgcagcttctaccaaaatcccgaaaaccgccgccgcttcgccggttttttccgcaacggcaacgggctgacccagaccctgcgctttctcaacctctacggcgtgttgggccgctacctgcccgcgtgggaaaaaatcatcggcctgctccaacacgacctgttccacatctatcccgtggacgaccacatcctcaccgtcgtccgcaacgtccgccgccttgccttggatatgcacagccacgagctgccctacgcctctgcactgatgcagtcctttgaaaaacaagacatcctctaccttgccgcctttttccatgacatcgccaaaggacgcggcggcgaccatgccatacaaggcatcgcagacgcgcgccaatttgccgctgaccacttcctgaccggagaagaaagcgacctgctcgcctggctggtcgaaaaccacctgctgatgtctgccgtcgcccaaaaagaagacatccaagaccccagcgtactcgatgccttctgcaaacgcgtgcaaacccacgaacgcctcagcgcgctctaccttctgaccatttccgacatacgcggcaccaatcccaagctgtggaacgcatggcgcgccagcctgctggaaagcctcttccatgccgccggacgctaccttacaggcaacggcggcaacccgcacaccctcttcggccgccgccggcaggaagccgccgacttactcacccgcgccgccgtccccgaaaaacagcagaaaaaactatggaacgcgctcggttccgcctacttcgcccgccaccagtcccgcgaaatcctgtggcacgccgccaacctagtccacgactttgaaacccccatcgtccgcagccgcatcctgcccaaaagcgacagctttcaagtcatggttttcatgcccaacggcccgcgcctgttcgcccgcctctgccgcatcttcagccgccacggcttcgacatcctcgccgcccgcgccttcatcaccgaacacgactacatcctcgacaccttcatcgtgcaaatcccctcgcagcacgcccccgaagactaccccgacatccaaagcgcgctcgaagccgaactcaacagctttatccacggacacaccgttgccgaaacccaaagccgcagccgccgcatcagccgccgcagccgctatatgccgatcgcaccgagcatcaccatcacccccgaagaagactatcccgactggtattccgtcgaaatcaccgccgtcaaccgccccttcctgctcgccgatatggcggaagtctttttcgcccacaacgtcagcctgcgctatgccaaaatctccacactggatgaacgcgccgaagacagttttaccgtttttagccccgacctgaaaaacccaaaaatccagtcctcattgaagcagacgctgctggaacaattatcataacgcccgccttcagacggcattccgccgccacgccgtatgccgtctgaaagcgggggatattgtaaataatttattaatataaggatttatatgaatattattatggactcaacaagaaaatttgggattttatgggaagaaaactctgaatgtaatggttttatttatggaaaaattcagataataataggagagaatatatatcctaagatatgcccatatggatattttacgctaaatgcagtttttaatagtttgaagtcatcctttgaagagaagtattatgcaggtggaaacaatggtttagattttggagagcaactatttgatatagataaatataattctctggaattatgcaatatattttctattgatactacatatatgagtggagggggtaattgtgaaatagattgtttagtattagaaatgggatattctggtgaggaagagagacttttttatagttttgacaatgggaaaaactttaaagaaatcaggtataagaaaggtacagttgaatctgttatttttcaattgaatctataatatatggggctgtaactagattagcagatatgttaccctcgaaatattaagataatatactgaaaattaaaggaaaaaataaataaagaactactccgtttttttgtgctggaagttaccgcccgatatagggcttcaataactgagccacttaccaaaaattagaaaaaagcttttcctgaaattgaaagaacgggagcaacagtggtcggcaaaggaaaaccgagctattcaaaggggaccaaaattaaacctgataaactgtcaagccgccggtaacgtgctataatgccgtgcatcttgcacaaactgaaagaccgagcattatgcgtatcgtagaaaaagcctatactttcgacgatgttttgttggttcccgcacattcgaccgtgctgccgcgagacgttaaacttcaaaccaagctcacccgcgaaatcacactcaacctccccctgctttccgccgcgatggacactgttaccgaggcgcgcctcgccatttcgatggcacaagaaggcggcatcggcatcatccataaaaacatgccgcccgaaatgcaggcgcgcgccgtttccaaagtgaaacgccacgaaagcggcgtggtcaaagaccccgtaaccgttgcaccgacaacgctcatccgcgaagtcttggaaatgcgtgcgcagcgcaaacgcaaaatgtccggcctgcccgtcgttgaaaacggcaaagtcgtcggcatcgtaaccaaccgcgacctgcgttttgaaaaccgcgtcgatttgcccgtttccgccattatgaccccgcgcgaacgtctggttaccgtccccgaaggcacaagcatagacgaagcgcgcgaactgatgcacacgcacaaagtcgagcgcgttttggttctgaacgaaaaagacgaactcaaaggtctgattaccgtcaaagatattttaaaaaccaccgagtttcccaatgccaacaaagactccgaaggccgtctgcgcgtcggtgcggcagtcggcaccggcggcgacaccgaagagcgcgtcaaagccttggttgaggccggcgtggacgtgattgtcgtcgataccgcccacgggcacagccaaggcgtgatcgaccgcgtgcgttgggtcaaagaaacctatccgcacatccaagtcatcggcggcaacatcgccactgccaaagccgctttggatttggtcgccgccggcgcggatgccgtcaaagtcggtatcggtccgggatcgatttgcaccacccgtatcgtggcaggtgtcggcgtgccgcaactgaccgccattcacaacgttgccgaagccctcaaaggcacgggcgttccgctgattgccgatggcggcatccgcttctccggcgacatcgccaaagccctcgccgcaggcgcgtacagcgtcatgctcggcggtatgtttgcaggcacggaagaagcgccgggcgaaatcgaactctaccaaggccgctcatacaaatcctatcgcggtatgggttccttgggcgcgatgagccaaggttctgccgaccgctacttccaagacaaaaccgacagcaccgacaaatacgtccccgaaggcatcgaaggccgcgttccttacaaaggcccgattgtgaacatcatccaccaactgaccggcggactgcgctccagcatggggtatttgggttgcgccaatattgccgaaatgcacgaaaaagcagaatttgtggaaatcacttccgcaggtatgagcgaatcgcacgttcacgacgttcaaattaccaaagaagcaccgaactaccatcgctgatttgaacagccttttcaaggaaaaatgccgtctgaaacctgattttcgggtttcagacggcattttttgtccgttcaaggcaagccgcacgggctgattgcgcggacgggcaaagcaattcggacggacacgccgaaagaatgaaaatgccgtctgaacgccgtttgcgccccgtctgccgaataccgccggcctttaaaacggcggtggaaataaacgcaatctttcaatacgggcgtttcaatttgctggaaataacgctccgtccgcccacatcaaaaaatcgggtggaggcttcgggaaaatatgccccgcctcctcaagccaccccgtcagcattatgatttgcctttccgtttttttaccttaatcggaaccggtttctttgcctttttcctcgattctgcggcggcagacgcgccccttccccttactttgccgcctcgggctgtttttttctcggcggcggttttcggcttccctttccccgccgtccctgccggtttggcagacgcggatgatttaactttccgccccctgccgctccccccggcaatcaggacaaaatcgatttttccgtcatccaaatcggcacgggcgacccggacggcaaccctgtcccccatgttgaaacggatgccgctgcgttcgccttcgattgccatgatttcggggcggaagttgaaatagtcttcgcccaaatcgctgatatgcaccaagccgtcaatgtggatgccgtccagtgttacaaagataccaaaactggtcatgccggagattttaccttcgaatacttcgccgaccttatcgcgcatataataggttttcagccagttttccacgtcgcggctggcgtcgtcggcacggcgctcacagaacgaggtatgcacgcccaaagcctgccagcttttttttggcgtgtaggtttgctgattcaacacggctttgatggcgcggtgtacggtcaggtcgggatagcggcggatgggcgaggtgaagtgggcgtatgcttcgtaggcaagaccaaagtgtccgtcgcaatgcggttcgtaaaccgcctgctgcatggagcgcaacatcatgacttgcagcaattcggcatcaggtctgcctttgaattgttcgacaagcgcggcatagtctttcggcgacgggttgtcgccgccgccaagttgaagccccaacagaccgagctgctcgcgcagggtggcgagtttttcgggcgtggggcccaaatggttgcggaacaaagccgtatgcttgtttttcaacaggaaatccgctgcgcaaacattcgccgccagcatacattcttcaatcagcttgtgggcatcgttgcggacaacggggacgattttttcgattttgccgttgtcatcgaaaatcatctgggtttcgacgctttcaaactccaccgcgccgcgttcgaaacgctttttctgaaggattttgaagagtttgtaaagggtgtcgatttgggctttgtacggatggtcgatgccgtctgaaatccatttccaaacttggttgtaggtcaggcgggcatgagagcgcattacggcggggtagaagcggtattctttgatattgcccgcataggtaacgaccatatcgcacaccatacacaaacgctcgacatcgggattgagcgagcaaatgccgttagacaggttttccggcagcatcggaatcacacggcgcgggaaatatacgctggtactgcgttcttgagcatctgcatcaatcacatcgtcagggcggacataatggctgacatccgcaatcgccacgaccagacggtaattgcgtccgactttttcggcaaacaccgcgtcgtcgaaatcgcgcgccgtttcgccgtctatcgttaccaaaggcaggtcgcgcaaatcgacgcggcctttcaaatcgcttttgcgtacatggacgggaatttttttcgcagctttggcacacgcttcactgaattggtgcggcaaatgatgcttgcgcacggcaatttcaatctccatgccgctgtcggcataatcgcccaaaacttcgatgatttttgccactgccggccggttttgctcaggataaacctcaatttcgccgacgatgacctgaccggattcaggtttgaaacgcgccacgccgtccggttccaatacgatgctttggttcagacgcttgtcttccggctccaaaatcgccacgcccctatccatatagaaacggccgaccactttgctttgcgcgcgttcgacaatatccagaactgtcccttcgcggcggcccntacggtccatgccggcaggacgaacagtgacaatatcgccgtgcataatgccgcgcatctggcgttcatacaaaacaaaatcaccgtctttggcgggcgtgagcggcacggcaaaaccgaaaccgtccttatgcgcctcgacgcggcatttgaccaaatccaatttgtccgccgcgcaaaccgcgccccgacggttgattaaaacctgaccgtcccgcgccatcgccttcagacggcgttcaaaaaagacatactcgtcttccgtaatcgacagctcgcgcgcaagcgattcgatttttgaaggcacacctttgcgctccaacaattcgattatccattcccgactgggcaaaggatgttcataacgctgtttttcacgacttaaaaacgggtctttttcccgtaaatttaaagatttaatatttttattcatttggactgttgacattctctttatgaactatataatagcgacttctttgcggcaggacactgtaccgcaaaacagcaaataaagcaaagcccgggtggcggaattggtagacgcgctagcttcaggtgctagtatcctcacgggtgtggaagttcgagtcttctcccgggcaccaaatcaaatgctttgctttatttcaatatttagattgcccgggtggcggaattggtagacgcgccagcttcaggtgctggtatcctcatgggtgtggaagttcgagtcttctcccgggcaccaaataataaattatcccgattgggataatttccgccattagagaggtggatgagtggtttaagtcgcacgcctggaaagcgtgtatacgtgaatagcgtatcgagggttcgaatcccttcctctctgccaaatacaaatcccaaacttttacggtttgggattttttattattcaaacaataatttcattgggaaaacccgttattgtctataatcgtcatcaaccgcttacaactatccgttaccgttttttgtggtatgttttgcggtatgtattaccctcttcctcaacctgtaaggactcaaaaggcgtattccttcaaacggcattgttcgacatgctgccgggaagccgaacccgataccgaaacgcgacggggcgatataccgctggaaaaatggcggcagtttcttgattgggtaggaaaaacgccgtctgaaacagcttcaagaagccgcaaagcccgtccgaataaaaaatgccgtctgaaatttttcagacggcatcgcgtatcatttaaacattaatccagtaaacatcaatccagctttttaaagtggcggcggcgttccaattcgctcaagtaacgcttgcgcagacggatggattgcggcgtgatttcaacgagttcgtcatcgtcgataaactcaaccgcaccttccagcgtcagcttgattggcgtggtcaggcgaacggcttcgtcggtaccgctggcacggatgttggtaagttttttgcctttgagcgggttgaccaccaaatcgttgtcgcgactgtggatgccgataatcatgccttcgtagattttgtcgttgggcgatacgaacatacggccgcggtcttccagattccacaaggcgtaagcgactgcctcgccctgctcttgggacaccagcacgccgttgtggcggccgggcatatcgggtttgacgggcgcgtaatcgtcgaacacgtggctcatcagcccgaccccgcgcgtcagggtcataaattcgccttggaaaccgatcaagccgcgcgctggaatatggtattcgaggcgggtgcgtccgttgccgtcgctttccatattagtcagttcgccacggcggcggccgagttcttccattaccgcgccttggttgtcgtcgggtacatccacggtcaggttttcatacggttcgcatttttgaccgtcgatgtcgcggtacacgacgcgcggtttgccgacggcgagttcgtagccttcgcggcgcatgttttccagcaaaatggtcaggtgcagctcgccgcgcccggatacgcggaacacgtcggcatcggcggtatcttccacgcgcagggcgacgttggtcagcaattctttttgcaggcggtcgcggatttggcggctggttacgaatttgccttccgtacccgccagcgggctggtgttgaccataaagtccatcgtcagcgtcggttcgtccacgctcaacatcggtaggcctttgggattgtctttgtcggtgatggttacgccgataccgatgtcttcgataccggaaataatcacgatgtcgccggcttcggcttcttcaagcggcacgcgttccaaacctttgaaacccaaaagctggttgatgcggccttgggcgatttgctgatcgtggttcatgacggcaacggtttggccgggtttgatgcgtccgttcaagatacgaccgataccgaggcggccggtgtagttgtcgtagtcgagttgggaaatttgcagttgcagcgtttcgtccgcgctgccgctcggtgcaggcgtatattttaagatagtatcgaacagcggacgcatgtcgttgctctcgtcggtttcttccaatttggcgaaaccgctcaaccctgaagcgtaaacaatcgggaaatccaactgctcgtcggtcgcgcccaagttgtcgaacagctcgaaagtttggtcgataacccagctcggacgagcggacggcttgtcgattttgttgatgacgacaatcggtttcagccccaaagccaaggcttttttggtcacgaaacgggtttgcggcatcgggccttcctgcgcgtccaccaacaagacgacgcagtccaccatccccaaaacgcgctctacttcgccgccgaagtcggcgtgtcccggcgtgtcgacgatattgatgtggtagccttcgtaatcgatggcggtgtttttggcgaggatggtgatgccgcgttctttttcaaggtcgttgctgtccatcacgcgctcgtcaacctgctggttggcgcggaatgtgccggattggcgcagcagttggtcgaccaatgtggttttgccgtggtcgacgtgggcgatgatggcgatgttgcggatttgtttcataattaatgtttttcaaaaactgtaagagataactacgcattataccacgctttaccggacagtatttgggaaatgaagatgccgtctgaagcccttgcctttcagacggtatagtggattaacaaaaatcaggacaaggcgacgaagccgcagacagtacaaatagtacggaaccgattcacttggtgcttcagcaccttagagaatcgttctctttgagctaaggcgaggcaacgatgtactggtttttgttaatccactatatcttcttacatacttttagttatccggttgcgcagccaccttgccgccggagcgatttcccctgccaacagccctgccgcaatgcctgccgattcttttatgacatccgccgccgcgccgtgcagccacgcgcccgcgcaggcggcttcaaaaaccggcacgccctgtgcgagcagactgccgatgatgccgcccaatacgtcgccactgcccgccgttgccaatcccgcgttgccgctttcgttgacatagatttccgtatcgggtgaggcaaccaatgttttgtgcccctttaaaaccacggttgcgccgaaaattgcccctatcttcctcactgccgccgtccgatccgcctgaacctgcgcaaccgtcgttccaagcaggcgcgcggcttcggcggggtgtggcgttaaaatcaggtttttacacccgcgcgccagatttcgggtttcggcatcggttgataatatgttcagcgcatccgcatccaaaacgacgggcttgtccgtgtgttccgtcaaaattccggcaagcgttccgaccgccgccctacctgtacccaatccacaaccgacaacccaggcgtttatatcttgacgtttggccaaactgtccgccgtatccagcataatctcgggaaaaccggcaataacggcaaaaggtagcgtatcctgattgaaacccgcccacactttgccgcagccgagatacattgccgccgatgccgccaatacgggcgcgccgctcatccctgccgatccgccgactacggcgagcgtgccgaaagtccctttgtgcgaatcttccgcacgggctttgaaaacatggggaaaacgcaatgccgtctgaagcatctggcggcggctctcgcctgaaagatgaaaaacgggaaacattgcccctccaatcggttaaaataaggctcgaaaacaaaccgattctaccgccggaaaccgattatgaaaaacaaaaccaaagtctgggacctccccacccgccttttccactggctgcttgccgcgtccctgccctttatgtggtatagcgcgaaagccggcggcgatatgctgcaatggcacacgcgcgtcgggctgttcgtccttttcctgctcgtatttcgcctctgctggggcatttggggcagcgataccgcccgtttttcccgtttcgtccaaggctgggcaggcatacgcggctatctgaaaaacggtattcccgaacacatccagcccggacacaaccccttgggcgcactgatggtcgttgcgcttttggccgccgtgtccttccaagtcggcaccgggctttttgccgccgatgaaaacaccttcagcaccaacggctacctcaaccatttggtttccgaacatacgggcagccttatgcggaaaatccacctcaactttttcaagctgctcgccgttttttctgcaatccacatcgccgccgtcgccgcataccgcgtattcaaaaagaaaaacctcatcctcccgatgataaccggcttcaaatacatcgaaggcaaaacctcaatccgctttgcaggcaaagccgcgcttgccgccgcattatcggttgcctcgcttgccgcagccgccatcctgctcctgtcctgaaacccgacatcaatgccgtctgaagcccttttcgcccttcggacggcatcccctcaccacgcaaacggtctgaatgcccgaaacggcttcaggccgtttttcttccgaaaccgttataaaacggaaaaccgccgcatccgcagccgcccccatatagctttcagcttctaacaaatacctttttattatttaaccggggaaaatccttttgtctaaaatgacccgcattccgacaaaaatgccgcgacgcaccgtatcggaaacaaggtgcgggcaaacagcaaaggagtcagccagtgaattatttccctattttcgccaacctcgccggccgccccgtattggtcgtaggcggcggcgcggtcgccgcacgcaaaatcagcctgctgctgaaggcgggcgcagaggtcagggttgccgcaaaacacctgaatgccgaactctccgcgttggcggcggaaaacaaaatcctgtggcttgccgaagaatttcgtgccgaacacatccgcacggttttcctcatcattgcggcaagcagcgaccaagccctcaaccggcgcgttttccatcttgccgaaagctgccaaaagccggtcaacgtggtggacgaccgcgaccattgcagcttcatcttcccgtcggttatcgaccgcaacccggttcagattgccgtttccagctccggcagcgcgcccgtcctcgcccgactgctgcgtgaaaggctggaagccctgctgccgccgtctttgggcgatatggcggaaatttcaggaaggtggcgcgatgccgtcaagggcaaactgaaatccgttaccgaacgccgccgcttttgggaaaagcagtttaacggacgtttcgccgccctcgtcaaaaaccggcaaaacacccttgccgaacgggaattggcaggccaattggaacaaagtcgtcaaaatgatcaaggcggctccgtctcgctggtcggcgcgggtcccggcgatgcggggctgctgacgctcaaagggctgcaggaaatccagcaggcagacgtggtgctttacgacgcgctggtttcagacggcatactgtccctcgtccgccgcgatgcggaacggatttttgtcggcaagcgcgcccggggcgagcgcaccccgcaagaggacaccaatgcgcttatggtcaggctggcccgcgaaggcaggcgcgtggtgcgtttgaaaggcggagaccctttcgtgttcggacgcggcggcgaagaattggaaaccttggcacgccatcagattccgttttcggtcgtccccggcattaccgccgccgtcggcgcgaccgcctatgccggcatcccgctcacgcaccgcgattatgcccaaagtgcggttttcgtaaccggccaccgcaaggcggatgcgcccgacatcgaatggcagaccctcgcccgcagccgccagaccttggtgatttatatgggtgcgctcaaagccgccctgattgccgaacggctgcaacagcacggacgctcgcccgacacgccggcagccgttatcagccaaggcacgctgccggctcaaaaaaccgcaaccggcacgctcgccaaccttgccgaactcgccgaaaccgcgccgaatccggcattgattgtcataggcgaagtggtggggctgcacgaaaaactcgcctggttcggtgaaaacggcgaaggagaaaaccgggtcgggcagacgtatcccgcattgggcggactgaatgccggacaacgggcggcataaggcgggaaaaatggaaacgacactgttcaaacccgccctgtggcagataccgcatatcggatccggcggcgaaaccgcccttgcggaaaaaacggaaaccctcaaacaacgcctgcaccggattgtcggcagccaccgggatgcacggtttgccagcagccttgcggcagaagatatggtgattaccgaccttatcgccggcgaaaacctcaatatcggcatttttaccttggatacggggctgctccacacggaaaccctgaacctgctggacaggctcggacgcgcatatccccatttgcggataaagcgtttccggccggttcgagaagatgccgaccgttatgtggaaagcaaaggcaggtttgccttttacgacagcgttgaagcgcgccgcgaatgctgccgcatccgaaaaaccgaaccgctcaaccgcgccattgcaggcgcggacgcctggcttaccgggcaacgccgcgaacaatccgccacacgcacggaactgccgtttgccgaatacgatgccggacggggcatcggcaaatacaacccgattttcgactggtcggaacacgacgtgtgggcatacatcctcgccaacaatgtgccttacaacgatttgtaccggcaaggatttcccagcataggctgcgacccctgcacccgccccgtcaaggcgggcgaagacatccgcgccgggcggtggtggtgggaaggcagaaacagcaaagaatgcgggctgcacaaataattcataaatatcagacagaagaaataaggaatatggtatgacgaaaaccgaaccgaacaacgcccaactcgactggttggaatccgaatccatccacatcatccgcgaagtggcggcagaatgcgaaaaccccgccctgctcttttccggcggcaaagattccgtggtcctgctcgccctcgcctgcaaagccttccggctgggcagccggccggtgaaactgcccttcccgctggtgcatatcgacacgggacacaactaccccgaagtgattgccttccgcgacgcgcaggcggcaaaactcaatgcccgcctgatagtggggcgcgtggaagactccattgccaaaggcacggtggtcttacgcaaagaaaccgattcgcgcaatgcggcacaggcggttaccttgttggaaaccatcgaggcaaacggcttcgacgcgcttatgggcggcgcgcggcgcgacgaagaaaaagcccgcgccaaagaacggattttctcgttccgcgacgagttcggacaatgggatccgaaggcgcaacgccccgagctgtggtcgctgtacaacaccaggctgcacaaaggcgaaaatatgcgcgtcttcccgatttccaactggacggaactcgacatctggcaatacatcgcccgcgaaaacctcgagctgccgccgatttattacagccacaggcgcgaagtggtcagacgcagggggctgctggtccctgtaacgccgctcaccccgaaaatgccgtctgaaacctccgaaatccttgatgtccgcttccgcaccgtcggcgacatcagctgcacctgcccggtagaaagcaccgcgtccacgccgacggagattatcagagaaacagcggttgccgacatttccgaacgcagcgcgacccggctggacgatcaggcaagcgaggcggcaatggaaaaacgcaaaaaagaaggctatttctaaatttcaaaaaccctttaagcagatatgaggaagaaaatatgacggcacaacaccaaaccccgctccgcttcattaccgccggcagcgtcgatgacggcaaaagcaccctgatcggacgactgctctacgacagcaaagccctgctgtccgaccaaatcaaaaccttggaatccggcaaaagcaaaggtttgaaagaagccatagacttctccatcctgaccgacggactggaagccgaacgcgaacagggcattacgatcgatgtggcataccgctatttttccacggcgaaacggaaattcatcatcgccgacacgccggggcacgaacaatacacgcgcaatatggttacgggcgcaagcaccgcttcggcggcagtcgtgctggttgacgcatcccaactggatttcggcgcgcagcccttgcagcttctgccgcagaccaaacgccattccgccatcctccgccaactcaactgcccgcatattgtggtggcggtcaacaaaatggacctgctggattacagcgaagacaaattcaacgccattgtggaggcataccgccgacttgccgaacagctcggtttgaaagacgcgcatttcgtaccgatgtccgcactcttgggcgacaacattgtttaccccggcggcaatatgccttggtataaaggcgaacccttattgtccattttggaaaccctgccgggggcggacgaagtcagccgcaccgccgacgatttttatttccccgtgcaactggtcgtccgccaagatgccgacaaggccgatgatttccgaggctatcaggggcgcatcgaacgcggttcggtcgccgtcgggcaaaccgtccgcatcgaaccgaacgggctgaccgccgaagtgtccgaaatcatcacgccgaaaggggaagtggcgcaggcttttgccggcgaggcggcaaccctccggctggaccgcgacatcgatgtttcgcgcggcgacctttttgtcgataaaaattccccgctcgccccgcaaaaacatctggaagccacgctttgctggtttgacgaacgtccgctcaacaccgcgcgcaaatacctgctcaagcacggcacgcaaaccgtgccggcaaaagtcggggaaattgaaagcgttttggatgtccgcacgctggaacaagaggccggcgcggaatccttgaagatgaacgacatcgccaaagtccgcatcaaccttcaaaaacccgttacggcaacgccttatgcggaaaacaccgccgccggttcgtttatcctgatagacgaagcgacatacggcactgttgcggcaggtatgattttatgagtgaacacgatatgcagaacacaaatccgccattaccgcctctgccgcccgaaatcacgcagctcctgtcggggctggacgcggcacaatgggcgtggctgtccggctacgcttgggcaaaagcaggaaacggggcatctgcaggactgcccgcgcttcagacggcattgccggcggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccgaaagaagccgtcgtgctgcacaaactgctgaacggcaaaaaagccccgaaattggacaaactccaatttgccgtactgggtttgggcgacagttcctatccgaatttctgtcaggcaggtaaagatttcgaccggcgttttgaagaattgggcgcaaaacggctgctcgaacgcgttgatgcggatttggactttaccgcctccgcaaacgcctggacagataatatcgccgcactcttaaaagaagaagccgcaaaaaaccgggcaacgcccgcgccgcagacaacgccccccgccggccttcagacggcaccggatggcaggtactgcaaggcagccccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatccggcaacggaaatacaggcgggcggaaagatgatgccggttgcgcgcgcactttcatctcatttcgaactcacgcaaaacactccggctttcgtcaaaggctatgccgcgttcgcccattatgaagaactcgataaaatcattgccgataacgccgttttgcaggatttcgtgcaaaacacgcctattgtcgatgtgctgcaccgcttcccggcaagcctgacggcagaacaattcatccgtttactgcgtccgcttgcaccccgtttgtattcgatttcttcagcacaggcggaagtgggcgatgaagtgcatttaactgtcggcgtggttcgttttgaacacgaaggccgcgccagaacgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgattttcggcaatccgcattttgcccgtgattttctctatcaaaccgaatggcagcagtttgccaaagacggcttcctgcacaggtacgatttcgcctggtcccgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattgattaaatataatcgggaggaacacaaaatgaccgtacagaccaagacaaaaggtttggcgtggcaagaaaaaccgctatccgacaacgaacgtctgaaaaccgaaagcaattttttacgcggcacgattttggacgatttgaaagacccgctcacgggcggcttcaaaggcgacaacttccaactcatccgcttccacggtatgtatgagcaggacgaccgcgacatccgcgccgaacgcgccgaggcaaaactcgagcccttgaaatttatgcttttgcgctgccggctgccgggcgggatcatcaaaccgtcccaatggatagaactggacaaatttgcccgggaaaacagtcattaccgctccatccggctgaccaaccggcaaaccttccaatttcacggcgtgccgaaagccaagttgcagacgatgcaccgcctcttgcacaaactgggtttggattccatcgccacggcggcggatatgaaccgcaacgtgctttgcacgtccaacccgatcgagtccgaactgcaccggcaggcttacgaatacgcgaaaaagatttccgaacacctgctgccgcgcacgcgcggttatctggatgtgtgggtggacggcaaaaaagttcaaagttccgacgacttccttcaagaagacgagccgattttgggcaaaacctatctgccgcgaaaattcaaaaccgcagtcgtcatcccgcccttgaacgatgtggactgctacggcaacgatttggatttcgtcgccgtttcagacggtaacggacagcttgccggcttcaatgttttggcaggcggcgggctttcgatggaacacggcaacaccaaaacctatccgaacatttcactggaactgggtttcgtgcctccggaacacgcgctgaaggccgccgaagcggtggtaaccacgcagcgcgacttcggcaaccgcagcgaccgcaaaaacgcccgcacccgctacaccattcaaaatatgggcttggacaacttccgcgcggaagttgaacgccgtatgggtatgccgttcgaacccgtacgcccgttcaaatttaccgggcgcggcgaccgcatcggctgggtgaaaggcatagacggcaactggcatttaacccttttcatcgaaagcgggcgtttggttgacgaaggcgggaaacagcttctgaccggcgtgttggaaatcgccaaaatccacaaaggcgatttccgcatcaccgccaaccaaaacctcatcgtggcaaatgtcgccgaagcagacaaagcaaaaatcgaagaatttgcccgaacatacggattaatccgcaacgatgtcagcaagctgcgtgaaaatgcgatgtcctgcgtttcctttccgacctgcccgctggcaatggcggaagccgaacgcgtgctgccggacttcatcggcgagctggataagattatggcgaaacacggcacgtcggacgactacatcgttacccgcattaccggctgcccgaacggctgcggacgggcgatgttggcggaaatcggactggtcggcaaagccgtcggacgctacaacctccatatcggcggcgaccgtgaaggcgtacgcatcccccgtctttacaaagaaaacatcaccctgcccgaaatccttgccgaattggacgacctgatcggcaaatgggcggcagaacgcaatatcggcgaaggtttcggcgatttcgccatacggacgggcatcgtcaaacccgtattaaatgcacccgttgatttttgggacgcatccaaagccgtcgcgattgcccgcgcctgaacccgtccccgcattcctgcggggattttcttttttgccgcacgccgtttcaatcccgcaaaattccgatacttggtataaaataccctcttttcccactctaaaaaaccgtacccgataccgtctgaaacagccctgtctttcagacggtataggcacaaggaaacacactatgcctgaataccgctccaaaacctccacccacggccgcaatatggcgggcgcacgtgcattgtggcgcgccaccggcgtgatggaaaccgacttcggcaagcccatcatcgccgttgccaactccttcacccaattcgtgcccggccatgtccacctgcacaatatgggccagctggttgcccgcgaaatcgaaaaagccggcgcaatcgccaaagaattcaacaccatcgccatcgacgacggcatcgctatgggacacagcggcatgctgtactccctgcccagccgcgatttgattgccgactctatcgaatatatggtcaacgcccactgcgccgacgcgctggtgtgcatttccaactgcgacaaaatcaccccgggcatgctgattgccgcgatgcgcctgaacatccccaccatcttcgtctccggcggcccgatggaagcgggcaaggttatcggcgtggcaaacatccagcccgaacgccgtttggacttgattgacgcgatgattgaatcggcggacgacaatgtcagcaaccggcaagtcgaggaagtcgaacaaaacgcctgcccgacctgcggctcgtgttcgggtatgtttacggcaaactcgatgaactgcctgaccgaagcactcggcctttccctgcccggcaacggttcgtatttggcgacccacgccggccgcaaagaattgttcctcgaagccggccgtatgattgtcgaaatcaccaaacgctattacgagcaaaacgatgaaaccgtgttaccgcgcagcattgccaccaaaaaagcgtttgaaaacgctatgacgatggatattgcgatgggcggcagcaccaataccattttgcacctgttggccgttgccaacgaagccggtgtcgatttcaaaatggcagacatcgaccgcttaagccgcgtcgtgccctgcatctgcaaaaccgcacccaacaaccacgactactatatggaagacgtgcatcgcgccggcggtatcttcgccatcctgaaagaactggacaaagcgggcaaactgcacaccgacgtgcacaccatccacgcgccgacgctgaaagacgcgattgaacaatgggacgtgaccaatcccgaaaacacccgtgccatcgaacgcttcaaagccgcgccgggcggcgtacgcaccacccaagcgttctcgcaaaaccgtatgtggaaaaccctcgacctcgaccgcgaaaaaggctgtatccgcgacgtggcacacgcctactcgcaagacggcggtttggcggtcttgttcggcaacatcgccgagcgcggctgcgtggtaaaaaccgcaggcgtggacgagagcatcctcaaattcaccggccgcgcccgcgtgtttgaaagccaagaagacgcagtagaaggcattttgggcaaccaaatcgtcgctggcgacatcgtcatcatccgctacgaaggcccgaaaggcggcccgggcatgcaggaaatgctgtatccgacttcctacctgaaatctaaaggcctcggcaaagcctgcgctctcttaaccgacggacgcttctccggcggcacatcaggtttgtccatcggacacgcctcgcccgaagcggcggaaggtggcgcgatcggtttggtacacgaaggcgataccgtcgaaatcgacatccccaaccgcagcatccaccttgccatttccgatgaagagcttgccgcacgccgtgccgaaatggaagcgcgcggcagcaaagcatggaagcctaaaaaccgcgaccgctacgtctccgccgcattaagagcttacggcgcgatggcgacttccgccgacaaaggcgcggtgcgcgacgtagcgcaaatcgaaagataagccccaaaacgtgcggcaaatgctgtctcgtctgaacagtaaaggtctgatgatggacaaatttatctgggcgatggcggtattttccgcaattttggcctcgttatcggcagcggctttagcgcgatcgagtatgtaaaagagctgccgctcgccgccgttgccgtgatgccttgcgcgccgaagtcgttgctgtggttgttggcgaagctgaggtagtcgaatcccgcgtcggcaaggtattgcccgtatgcggagggcgttcggaatgcatagcatattttgggggtttgcacattttttcggcgtaccgccttcgtcaaacagcgtgccttcgaggttgccgacggtaatgtccgcgtcttgcaaggcagattcgacgtttttcagaatattggtatcgggcaggtaatcgaccggataattgctgccgagcataatgtcgcccacgccgataatggaaacggtatcggctgtcttttcgtcaggcgcatcctgtccgtccacatcgccggtatttgaaacgggcgcggggtttgaaccgtcaatcggcagcacggggattccgttccggcaggatgcgccgagggcttgaccccggcggtttgcggtgcggaaacggcataaagggcgaaccttgacgaattgaacatcaaatattcgggcatcgaaaacaggtttgaaaccgccatcctgaagaaaaacggcgtaagatccggcttcgtctccttcgcccccaaccttgccgccgtcaaactgaacgattatgccaaagttagaaaacggattaccaaaaccaaacagaaagccgacatcgtcattgtgatgttccacggcggcgcggaagggaaacaggcggaacacctgccgttcgataccgaaatcttctatggggaaaacaggggcaacgtcgttgagtttgcgcggcttgccgtcgattccggcgcggatgtcgtattcgggcaggggccgcacgttactcgcgccgtcgaactttaccgcgaccgcttcatctcctacagcggcggcaactttgccacctacggcgcaatcaacacctccggcatcagcggcatcgcccccatttttaaaattatcaccgacaaacaggggcggttcgtttccggcaacattatccccatcactcaagtcggcgataaaatccccaaaatcgaccccgagaaaaccgttatcgggcggattatttatctgaaccgcagcgatttccccaaggggaacgggctggatgtctcgcccgacggcagcatcacgcgccggtaaaaagatattggaaatgccgtccggacaaatgccgtctgaaagcctttttccgggtttcagacggcatttttcaatcgtcaataatccactttaatcccagaggctttttccacttcggcgacctcgccttccggttcaaactgcaagggatacaggttgagcttttccatcaggattctgtcgccgtcctcatcaggattgcccgtggtcagcagcttgtcgccgtaaaaaatcgagttcgcgcccgccataaagcacatcgcctgcattgcttcaggcatattgctgcgccctgccgacagccggacataactttgcggcatcgtaatccgcgccacggcgatggtgcggacaaattccgtccagtccaaatcttcggcatcggcaagcggcgtgccttccactttgaccaaccggttaatcggcacgctttcgggctgcgggtcgagattggcgagactggcaatcagcccggcacgttcggcgcgggtttcgttcatcccgacgatgccgccgcagcagactttcaaaccggcgttgcggactttgcccaaggtgtccattcggtcttcgtgttggcgggtgtggatgatgtcgttgtagcggtcggggtcggtgtcgaggttgtggttgtaataatccaagcccgcctctttcaagtcttccgccataccttcttcgagcataccgaacgtgccgcaggtttccatacccaagcccttgacggctttgatgattgcggaaaccgtctccacgtctttgggtttagggccgcgccacgccgcgcccatacaaaaccggcttgcgccgcgcgatttggcgattttggctttttcgacgatttcatccacatccatcatctgctctttgcccagattggtattgtggtgcgccgattgcggacaataggcgcagtcttcgggacaaccgccggttttgatggacaacagcgtggaaagctggatttcgcgcgggttgaaattttggcggtggatttcggcggcttggtaaatgaggtcgaggaagggaagtccgaacagggcttcgacatcgcattttttccaatagcgcgcggtgggatgaggcttgcactcggtcttacggcgcaaggcgacgggggatacggtcataatgtgttctttcgtatttacagcggcgcaatgacgctgacaggcaaaccgccggcgcaatgacggcggttgcgggtaatcaaatggctgaaaacagcggcggcaagtgtaacgcgtttgaaaatacggggcaaacggtttttccgcctttgtgccgcgcagccgggcgatgccgtctgaagggctttcagacggcatcgcccgggctatctcaaagcttccagcagctttccgtgtattccgccgaaaccgccgttgctcatcaccaaaatatggtcgcctacttcggcgtttttcacgatttcggcaacgaaggcatcgaagtctttgccgacgttcagcctgccgcccaaaggcgcgagggcttcggcgacgtcccagtccacgccgccggcgtagcagaacacttggtcggcttctttgaggcttacaggcagggcggacttcatcgtgcccagcttcatcgtgttggaacgcggttcgaggacggcgaggatgcgcgcgccgccgacgcgttggcgcaaaccttgaatcgtggtttcgatggcggtcgggtggtgggcgaagtcgtcgtaaacggtgatgccgtttgccgtgcctttgatttccatccggcgtttgacgtttttaaacgcgcccaaggcttcgcaggcggtctgaatatcgacaccgacatgacgcgcggcggcaatgacggcgagcgcgttcatgcggttgtgcctgcccatcaaatcccatttgacgcgtccggcggttttgccgtcgagcaacacgtcgaacgagccgtcggcattggcttcgccggcctgccagccgtgttccgtgccgaatttttccaccggcgtccagcagcctttgtccaaagtatcttgcaggctttgctgccgtccgttgcagacgattaagccttcagacggcacggtacgcacgaggtagtggaactgggtctgtatcgcgcccaagtcggcaaagatgtcggcgtggtcgaattccagattgttcaacacggcggtacgcggacggtaatgcacgaatttagaacgtttgtcgaaaaaggcggtgtcgtattcgtcggcttcgatgacgaaaaacggcgattggctgttcgggtcttggcgcggcgtttgcggcaggcgggcggaaacgccgaaattttccggtacgccgccaataaggaagcccggcgcgaggccggcatattccaagacccatgcgagcatggaggcggtggtcgttttgccgtgcgtccccgccacaccgagtacccaatgatggtgcagcacgttttccgacagccattgcgggccggaaatataaggcaggccgaggttcaaaatcgcttcaaccacatccatcccgcgcttggcgacattgccgataacgtaaacgtcggctttaaattcgtccaactgagcggcatcgaagccttcatacacgtctatacccaaggcttcgagctgggtgctcatcggcggatacatcttcgcgtcgcaaccgctgacttcaaaccccgcttctttggcaatggcggcaagcccgcccataaacgtgccgccgataccgataatatggatgtgtttcatcaaagttccccaatcgttcaaattttgccgtccgacagcgcaagggctgattcggcttcaatcagtgcggcttgatgccggcagccgaaccgtctttctgtgcatttcctttcggattttggacgtgttcgtccctcaccgtgtccgaataatcgccgacccctgcgtcttccgccctgtcttttactgccggtctaaccgaactgtacacccggtcccgccccaaacccgcgttggtacaatgttttcccggagtttggctgtaactggttttaccattatggcggcacgcgtaaacatttgccgaaaatacggtctgaaccgctgtaacaagcaacatacttccaattattttagatacgcgcatatcaacctcctttatcgttcttcttcaaaaaagggaatgtatttcaatagcacttcatctaattctttcattccctgctcataattgaacgggtattcccaaccatcccctactttgatttcagaaatatctttaaacttccgcttaagggcggacactttgtccatatcgtcatcaatttcctgtttgccgaacggtattttccgcttttccaaaacctcgtcataataacaagataaattaagcaatagcccccaagcactatttgcaattacgactaatctatgtttttccctagttaagtaatctgcaccgctatcatagattgcccttgtcgggtcataaaaaattcgcaatttttcatagcgtccccacactttaaccgattcgcaattttatatccgcgattttgcaagctgcccataaaaaccgattgcctgtcaagacggcactacttgttaaagatgcccgataatgccgcaactcttccgtatttaccgacaaacgccctatttgcttagagctgttttgttttccacaaaactttaattcgttgatttaacaaattttttaccaaattctttatttgttcggattccattagcacgattttgagcaatatctgtcaaaaccatttccaccacacccaagccaaaaccgccgccgccacggcattggacaatcagatgagtttccactgcccgtccttccgcaatgccgccttcttgggcttcaaagcacccgcataaaaaaacggcgacagcagcatagaagcgatacataagaaaatcaatacgccgtaatagattttttcagacggcatttctcttcctcaatacgccgcccgttggcgcatttgttcaaacaggcagattgtcgccgccatcgcgacatttaaagactcggttgcatcgtgcatcggtatcctgacacacttgtccgccctatctaaaactgctttaccgacccccgcgccttcgttgccaaacacccaggctgtcggttcgcacaaatcttcgccgtacaaaaccgcctgcttttcctcgcgcaaggcggtggcaaacacacggcctttatagcgcaccaaccatatttccaaatccgcctgcggataaatctccgacaagaaatgcgcgcccattccggctcgcagcactttgggcgaccacgcgtccgcacaacctttgcccaaaatgaccgcgccgattcccgccgccgccgcgcttcgcaacaccgtgccgacattgcccgggtcttgcacgccgtccaaaaccacgcaatcgccgccggccggcaaagcacccgcatctggaatatcaatcagcgcaagcacatcatccgcacaagtcaggctgctgattttcttcaatatgccgtctgaaacggaaaaaaacccgtcttccggcaaaaccgccgtcaatttacggacttcttcagacggcattttcgcttcgggaatatataccccgaccggcatcccgccggattgcaggaaaacctgaagcaggtgcacgccctccaaaacggtttgggcgtattgccgtctgaactttccttgcgacaacaggcggtgcaggtgtctgatgtgttcattattggtcgaactgatgtgtttcacttcacaagccttttagaaatatgcaaccggacaatacccgactgaacgccgccgaaatctgtttgcgatattatcaaaataaaatgggaaagtcaggatggacgggcaaaatgccgtctgaaaccgagtattggaaatccgcacaacagtttgccaacgccaatggacggtttccgctgtcggcaacaagcggccaaattgggcgcaggacaggcaaaacccgtttcccctgaaggatttttttcacatccttatggatgccgcccatggccaacgtatccgatgccgctaccgtcctcaaaattccgtcctgctccaaaagatgctcaggaagcccaaacggatgccgcttcaacacaaatccctgccccgtcaatatttcccttaaatttccgcttatctgcctgtctttcaaaaaccgcagtttatccgttttttccagtcggaacacaaacagcctgcctgcataatgatgcaattcaaagccttgcaagttccaacgtccggtttttgcctccgtcaaaacccgggcaatgtcggcaagggcattctgattcggcacgggaatgccgttttccttcagaaaatgccgcaaaatatgggttttccggcgcggggaaaacgtcagccaccgcgccgtatcgaaataaccggccccgcaaacccaacggcagtcctgaacgacgacctcgtccaacaaagccaaatcttcctgcaaagcgcggacattgttcagcacatgccgcccgaaatggggaatctgcgccgaaagttcgggcaaaatacggtgccggaagcggtttcgcaaataagccgtatcggtattgctttcatcctcgatattcggcaaaccgtgtttttgggcataatcccatatatcttggcgtgaaaaaggcagcaagggccgccagatgatgcctttttccccaaaagggcggacggcgggcatagccgccaaagcgcgcaaaccgccgccgcgcgcgaccgccagcataaaggtttcgatttgatcgtccctgtggtgcgccaacgccaaaacgtcaaagcctttttcggcaaacgcggcataacgcttttgccttgccgccgcctcgatgcccaaaccgtttttttccacgcagaccttaaccgtttccagccccaccccgagcatatcgcaatagttttggcagaaatctgcccaatcgtcggcacggggactcaagccgtgatggatatgcaatgcatccggaataaaaccgcccttttttccggcgcggacaagcagatgcagcaaaacgacggaatccaagccgccgcttaatgccaccgctgttttttttccattcagaccttgaggaaaacaatccttcaagcattgctcaaacgcatctaaagtcagcacggttccgtcccgataaagaaaaagcaagcagtttcagacaaactgcttgctgcttgttctacctgaattattgttccgaaaatttgccgtaagccataatgcggtcgaaacggcgcgaaagcaaatcggcaagcgggatgctttgcgcttcgtgcagttgtttttccaaaacggcttttacgtttttcatggtttgcccgaaatcccgatgcgcgccgcccaatggttctttgatgacggtatcgaccaagtccagcttttgcaggcggtcagcagtaatgcccaaagcctgagccgcatccgccgccttttcggcggttttccacaaaatagacgcgcagccttcgggggagataacagaataggtcgagtattgcagcatattgacgtaatcgcctagggcgaccgccaacgcaccgcctgaaccgccttcgccgatgacggtacacaaaacaggaacgcgcaggcgcgtcagttcgtacaggtttttgccgatggcttccgactgcccgcgttcttccgcgccgatgccgggatacgcgcccggcgtatcgataaaggtcattacgggcaagccgaatttttctgccgtcttcatcaggcgcagggctttgcggtagccttcaggacggggcataccgaagttgcggcggattttttctttggtgtcgcgccctttctgatgcccgacgaccatcacgctttgtccgttgaaacgcgccaatccgccgacaatcgcataatcgtcggcaaagtggcggtcgccgtgcagttcttcaaaatcggtaaacagtgcctcaatgtaatccaaagtatagggacgctgcggatgccgggaaacctgtgaaatttgggcgggtgtgagtttgctgaaaatcgatttggtcaggtcgttgctttttttctgcaaacggtgtatttcgtccgaaatatcgacggcagactcgtcttggacgaaacgcagctcatcgattttgttggtcagttcggctatgggttgttcaaaatccaaaaaaacaggtttcatagaatgaagctctcatcaacagattctgccgctatcatacgctatttgtgcatattccgcagttaatttattgtccaaaacggcttttccataccctctttttgtgttcggacagcatggaaaacagtggattagtgcatatatactagttataaggcggcgtatcttatgctaaactcgaaacaaattcaattatttcaaacaaaatcgtatgaaagacaagcacgattcttccgccatgcggctggacaaatggctttgggcggcacgttttttcaagacccgttcccttgcgcaaaagcacatcgaactgggtagggttcaagtaaacggctcgaaggtcaaaaacagtaaaaccatagacatcggcgatattatcgacctgacgctcaattcccttccctataaaatcaaggttaaaggtttgaaccaccaacgccgcccggcatccgaggcgcggcttctgtatgaagaggacgcgaaaacggcaacattgagggaagagcgcaaacagctcgaccaattcagccgcatcacttccgcctatcccgacggcagaccgaccaagcgcgaccgccgccaactggacaggctgaaaaaaggagactggtaaaaccattcccgctgcaaacagaagcacgaaccgcgtaccgccgcatttcagacggcattcccgaaacttattccgcctcgtctatccatgcctgctgcacggcttcgaggatgcgttcgccgcaacgggcggggtcgtcgtcaaattcgggcaatgccataatcaggtcgcgcagttgggtaaagcgcacggttctgggatcgatggtttcgccgtgcaggtcatagagttcttcggcgatgcgctgggtgtcggtccatttcatatgaatttccttttatcgtccggcattgaagccgtgtagaatatgtttcggcaaaactgccgccccttgaggattgctgaatgtttcaactcgccggacaacacatcaagcaccagcctatgtgtcgtcctgatctgggaggagttgtccctcccaaacaaatctgattctaccgccccgaagagcggggtttcaaccgacaaggaagattgatgaacaatatgtttgccgcaaaattgtccaaactggtttataccgcttccgaccatcctgattccctgtcggagatggaggagtttgaccgcctgattctgctgatacgcaaactgtatcaaatattggacgggcaacatatcctctccagagtaacggtttgccttcaccaccaaaaccggcgcgacctgattgccttggataaagcggctgccggttgcgattcggcaatgttgcgcgcccaacgttggctcatctacacgcaaattgcggaacgccttgccgggtcgggcggcggtttcacggttacggtagaaagcgtgtccgccgcctgtccggagcttgaaggacgctatctcgagcttgtccgccgcgccgccgtctctttcggtttcacgcaaggatgggaaaatccggcaggcgggcaggaaaaaacacaagccgtcccggatgccgcatcgggtcattccgtcagaaaaccaatcaaaatcaatatagaagcgagagtggaacgctatccggcatactgcccgaccgtcgccctaaaagtatagtggattaacaaaaatcaggacaaggcggcgagccgcagacagtacagatagtacggcaaggcgaggcaacgctgtactggtttaaatttaatccactataacccgccggcggtttttccggctgcaaaaccgataaataccggtgcatcgcgtccgagtaatccgcctcggatgccgcactggattattccgtcagaaaaccgataaaaatcaatatatagtgaattaaatttaaaccggtacagcgttacctcgccttgccgtactatctgtactgtctgcggctcgccgccttgtcctgatttttgttaattcactatagaatcgaaagttccgcctgtacgaacgcctgttttcgggcgattgcgccttatccgcgcaacaatgccgtctgaagcgtgccggcttcagacggcctgttttcagtgttcttcgcgcgcgtggttgatggtgtatttggggatttccacaatcaaatcctcgccggcgacaaccgcctgacaactcaggcgcgaatcggcttccaaaccccaagcctgatcgagcaggtcttcttccaattcggtcggctcttctaggctgtcgaaacctttgcggataatcacgtggcaggttgtgcaggcgcaggatttttcgcaggcgtgatcgacttcgatatcatggtcgagcagcacgtcaaggacggttttaccttcgggtgcgttatcgatgactgcaccctcggggcataatgtcgtgtgtggaagtacggtgattttgggcatttttattgtctttctgtaaaaagtgtttgtgttcgttttcggaaaactgtctgcctaatgtcgcggttcgagcaggtcggcaacattttgccagcccgtcaggcaggcaaaatcgagggcggtatagccttccgatgtcgttgaggcaggatttgcgccgtattcaagcatggcttgaaccataagtgcatttcctgcgatggcttcatgatgaagcggcgtatagccgtcttcgtcctgttcccgcagataatccgagttttgggacaactgttgccgaaaatcgtcaatacagttccggcacatcggatgctcttccagattttcgggatgttctttttcttcatacaccagcaatatctgcccgggatcgccgaaatcgattccccatgcggcatcgtgttcggtgcgctcctcttccgtcatctgcccgcgcattgcctgtatggtaaagccgccgtaggggatgccgttgcacacgaacatccagtcgctgatgtcgtcaaccggaacgcaaacgctttcgccttgttcgacattggtcagttcgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaaatatttgaatgttttacgggcgcgttcgtcggcacggtttaccggttcgtctgcctgttctacataataaatgacggaatcgcccatcatatctgctcctcaacgtgtacggtatctgtttgcaccttactgcggctttctgccttcggcatccgattcggatttgaaaagttccaaatattcggaataggctttttccaaatccgcccgcgaaaaacaggtgtaaatatggatgccgtctgcaatttcgtcggtcagcctcgtgccgcttttgccgaaatatgcttctttaaaaaggcggattttcgattttttcggcttgtagaatgccgcgcccgccaaaagccggggcagcgcgtaagggtattcccggtgtccgcgccgtaccaaatcaagcagttgtttgcggcctgacccggcattcccttcctgcctgcgttcgtggacgcttttttcaaattccgattccgccgtttcgtttttcgggaacacgatttcgccgcgaagcgataaaaacaaacgtttcacaaggttttcgtccacggcgaacaattcggtatcgcctatcctgcttttgctgaaaatttcatggagcaggttttctttttctttgtaattgtcggttttgacggcgaggatgcgttccaatccggcaacgttcgcataaccgttgttttccaaatggcgcattctgccttcaaaattgcttacatccgaaatgccgattttatacacgcccttgatgacggttttcatcagatagacaatgcctgacttttccatatcgatgtttttcaagtgttttcgagccttcagacggcatcggattatttctatgccgtctgaaaccgtttaagtatcaaatattatcgacactctggcctgtcagcgcgcgttggatgttgcggttcatgcgtttggcggcgaaattgtcggtgatgctgccgagtttggcggcggcggcacggatgtcttcggcttttccgtctttcagacggccttgcaaatcggcgatgccttgccgaatctgttgcaattcttcggcatccagcaaatcgctgtccaactcgagggcggcgttgacggcatcggtcaggctttcggcttcgactacggcttcggcacgggcgcgtgccgccatatcttcggcggcattgctcatgctgtctttgagcatttgggtgatggtgtcgtcgtccaagccgtaggagggtttgacttcgatttgcgcctgtacgccggtgctttgttcttgggcggaaacggacagcagcccatccgcatcgatttggaaggttacgcggatacgcgccgcacccgccgccataggcggaatgccgcgcagggtgaatttggcaaggctgcggcagtcggcaaccagttcgcgttcgccttgtacgacgtgtatcgtcatcgcggtctgaccgtctttgaaggtggtaaagtcctgcgcgcgcgcggtggggatggtggaattgcgcgggatgattttttccgccaagccgccgtaggtttccaaaccgagcgacaagggcgtaacgtccagcagcagccattcgccgtcggttttgttgcctgcgaggacgtttgcctgtatggcggcgccgagcgcgacgacttcgtcggggttgaggttgttcagcggggtttgtccgaagaaggtggcgactgcctgttggacgtgcagcatacgggtcgaaccgccgaccataatcacgcctttgacttcgtttttaccgacaccggcatctttcaacgcctgtgtgaccggttcgagcgttttcatcaccaaatgctgcgtcaggttgtggaactcggcgcgactgatgcttgtgtcgattgccatgccgtctgaaagcgtcgcctgaatgcgcgcttcggtttgcgtggttaattgttctttggcggcgcggacgagcgagagcaggagttggctgtcttgttcgttgagttgggagagtccgttttgttcgagcaggcggcagaacaggcggtggtcgaaatcgtcgccgcccaacgcgctgttgccgccggtggctttgacttcaaacagtcctttggtcagttgcaatacggatacgtcgaatgtgccgccccctaagtcgtacacgacaaacgtgccttccgaggcgttgtccagcccgtaggcgattgcggcggcggtgggttcgttgagcaggcgcaatacgttcaaacccgccagacgcgcggcatctttggtggcctggcgttgggcatcgtcgaaataggcggggacggtaatcaccacgccgaccaaatcgccgcccaaggtttcttcggcgcgcgatttaagggttttgaggatttccgccgacacttcgacaggcgttttcaccccctgccgcgtatgcagttcgataacgcgttgattgtcgccgaaacggtaaggcaggtagtgcgtattttgatgcagatcggcaagcgtccgcccgataaggcgtttggcggagctgacggtgttcagcgggtcggttttttgggcggacagggcggttttgccgacttcaatgccgccgttttccagatagcggacgacggaaggcagggtaacgcgcccttcggcatcgggcaggcaggcggcactgccgctgcggacggtggcgaccaagctgttggtcgtacccaaatcgatgcctgccgccaaacggtgccggtgcggggcggcggacatacccggttctgaaatctgcaaaagagccataaattctgcctgtcggtgcggtgtgtaaaggaaggaaagcggcattttaacagaatttgcgccgatagttgagcaaaccgctaaggattaggtcgtgccgccgaaattgccctctaccgccaaatgccgataaaatccgcctttcccgcccatcattaggaatataaatcgtgaaaggactcgactattgccgccaaaaagcagaagaaagccgctccagttttttgtcgggcttccgtttcctgactcaggaaaaacgggatgcggtaacggttttatatgctttttgccgcgaattggacgatgtggttgacgaatgttccaaccccgatgttgcacaggcgacattgaactggtggcgcggcgatttggacaaggtattcggcggcgcgatgccggaacaccccgtcaatcaggccttgcggcaagttaaggaaaccttcaagctgccgaaatatgaactggaagccttaatcgacgggatgcagatggatttggttcaagcccgttacggcagttttgaagaattgaaactgtattgccaccgcgtcgcaggcgtggtcggctgcctgattgcgcggattttggggttttcagacgaccaaacgctggaatacgccgacaagatgggacttgcgctgcaactgaccaacatcatccgcgatgtcggcgaagacgcgcgcagggggcggatttacctgccgatggaggaaatgcggcggtttgacgtacccgcaagcgtgattttgcaatgcagcccgacgggcaattttgccgaattgatggcgttccaaatcaaacgcgcccgcgaaacctaccgcgaagccgtatcgctgctgcctgatgccgataaaaaagcccaaaaagtcggactggtcatggcggcggtttattacgagctattgaacgaaatcgaccgagacggcgcacaaaacgtcctcaaatacaaaatcgccctcccttcgccgcgcaaaaaacgcattgccctgaaaacctggttattcggattcaaaccgcgccccggcacgccggaacgggcataaggcgcataccgcccgccgcccgtcaggcaaacccgattcccacagccccgccggacggggtttcaaccatcgtctgaaagtctgcatcgtaaccgcgcaatcccgttggcgttcgcgctttgaaatggaattgctgggaatttaaacaggagcagaagtaaatgaaagcagtcagggatatagccttatggctggcagtaacggtttggatcaactttttccccgacagttaccgctatgataccgttccacagggacggtacggatactggcatgcagaccatccgtggtatccctatgcgcgctttctgctgcctttatttttagcctgtatccttttctaccgtcattttcggaaacggaaatagatacggctgcaaaaccattggaggaataaatgatgaacacgccgcatccgcgcccgaaaatcgccgtcatcggcgcaggctgggcaggactgtccgccgccgtcaccttggcgcggcacgccgacgttaccctgtttgaagccggccggcaggcgggcggcagggcgcgcacactggccggaaataccgacggtttcggttttttggacaacgggcagcacattttgctcggcgcataccggggcgtgttgcgcctgatgaaaaccatcggttcggatccccgtgccgcctttttgcgcgtaccgctgcactggcatatgcacggcggtttgcagttccgcgccctccccctgcccgcgccgctgcatattttgggcggcgtgctgcttgcccggcgtgcaccgactgcattcaaagccaaactgcttgccgatatgtccgatttgcagaagtccgcacgcctcggacagcccgacacgacagtggcgcaatggctgaaacagcggaacgtgccgcgtgccgccgtgatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaagcaggatttgggcgcaatcgtcgccgaacccgccttggcggatcttcaacggctcggcgcggacatccgcctcgaaacgcgcgtatgccgtctgaacaccctcccggacgggaaagtgctcgtcaacggcgaagctttcgatgccgccgtccccgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggccttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagcccacgccgacctcaaacgcatccttccgcatttgggcgaacccgaagccgtgcgcgtcatcaccgaaaaacgcgccacaaccgcagccgatgccccgccgccggacttgtcgtggttgcaccggcaccgcatcttccccgccggcgactacctccacccggactaccccgccacgctcgaagccgccgtacaatcaggtttcgcgtcggcggaagcctgcctgcaaagcctgagcgatgccgtctgaaaacgccggccgacatcgggacgctttacaaggtgcggcaaaacgctaaaataccttaaccgacaaccaaaaaggaaaaagtatggcgacactgtccgacaaaaccatcttagtaaccggcgcatcgcaaggtctgggcgaacaggtcgccaaagcctatgcggcggcaggcgcaaccgtgattttggttgcccgtcatcagaaaaaactggaaaaagtgtatgacgcgattgtcgaagccggataccccgaaccattcgccatctgctttgaccttattagcgcggaagaaaaagaatttgaacatttcgccgccaccattgccgaagccacgcaaggcaaactggacggcatcgtccactgcgccggctatttttacgccctctcgccgctggatttccaaaccgtcgccgaatgggtcaaccaataccgcatcaacaccgtcgcacctatggggctgacccgcgccctgttcccgctgctgaagcagtcgcccgacgcgtccgtcatcttcgtcggcgaaagccacggcgaaacacccaaagcctactggggcggcttcggcgcgtccaaagccgcgttgaactacctgtgcaaagtcgccgccgacgaatgggaacgcttcggcaacctgcgcgccaacgtcctcgtccccggccccatcaattccccgcaacgcatcaaatcccatccgggcgaagccaaaagcgaacgcaaaagctacggggacgtgctgcccgcatttgtctggtgggcaagtgccgaaagcaaagggcggagtggcgaaatcgtttacctctaaatccggaaaaggcaggcatcccgcccgcgccgcgattccgtttgaaaaatatccgtaccttccgcgcgcatccgtcccgcacagacaaacaccttgacttaaatttacataaggacaataatgacaacccgttatttccttaagytgaccatagggtaaatg

SEQ ID NO: 8 - DNA, 20844 bp, Neisseria meningitidis
taccaacccggatttgccaatacgttacgcaaaatcacgttcggcacgcgggtcgagtaatagcctaaaccgatataggatctgttgatcatgaaagtcgacgcaatgccaagcaattttgccagcgcgtccgcatcggtcagggcatcgggcaaatcgagttcagacggcatacggatgctttgcggcacggtgttgccgacaaaatcgtccatacktttctcgccgacagcggcaagcaacgccgcttcgtcgccaaaactcaaatgccgcgcggcaaattcgtcggggttgaacagttcggacagtttcatttctactccttcgggtttgtagggctgccatcaggcagaatttttagacatcggatgattcgggcaagggtagcacaaaagacgggataatggcggacaatgcgccagaatgcagcaggtcaggacaagcagcgccacaagcggcagcgataagggaaagccgccgcccaaaaccatgaaacctgcaggcaccagccaagctaagggatgcgccggaagcggaaaaacaatattgagcagaaccaaaatcacgacaaacagcggcagacccgccatcaggttggcacgcctgtatgttgcgtacgggtcggatgcttcttcaggttcgcaatattccatgatttcagcctgtccgggctttatccacagcaggctcggacggtcggtcatgccgtctgaaccggcaggccgtctttttcaaaaaacgccataccgctgcaacttcatgcggctgtatggcgtaggctttgcacttcagacggcatatgcgtcccgaagcagtttggtgtcccagtcggttcatgattatataaacaacttgggtgcggataaacctttgtttatctaaacccctgttttctcaaaaattgattcaaatcttcggcaaatttccgatagcctttgccgttggcgtggatttggtcggatttcagattattatcgcccaaaatttccgcccacgcgccgccgaacagcggaatgccgtattcctcggacaaatcctcatacagcggatgatcgctcaaatgcccgaacaacgcacccagtgtgatgtgcggcacgccgacgaggacggcggggatgttttccttctgcacggtttcgatgattttcgcgatattggcgcgggtctgctccttgggaactttgcgcagaaagtcgttgccgcctatgccgacaatcacaagcttgggtttgcgtgccaacagcgcgggcaggcgcgacagggcttgggcagatgtatcgcccgatacgccgccgttgacaatattccaacccgtcagtttttgcagttgcgcggggtaggattcgccagggtttgcgccgtagccgaaggtaagcgaatcgcccaaggcaagtacggtgcttccttcgggaattttggcgtgggttcgggcggattttctgccgcaggcggtaagcagcaacgcgcctgcgccgaggaggaaggttcttctgttcattggtttttcagatggcatcgagccatttcgggtggtatttcagggtttcacggtaaaccggacagctttcggcgtgcgcgcctttgaggtagccggtactcatcagaaattcgccgacgatttcgccgccgacgaatttgaaatgttttttaaagagtttaacccattcgtctttgcttcgcggatggtgcgtgtcgagccagttcttgaacgagccgtattcttgttgcaacgcttggatttgccgtgcattgaaaatggcggcatcgattttcaggcggttgcggacaatgcccgcgtcggcaagcaggcgttcgcggtcggtgtcgtcgaaggcggcaaccgtatcgatgtcgaaaccttcaaatgccgtctgaaacgcctgccgcttcttcagcatcagcgtccagtttaatcctgcctgattgatttccaacaccagccgctcaaacaattcattgtcgtcctcaatcggaaaaccgtattgcgtgtcgtggtaatgtttgttcgggttatcggtgttttcgggaagtgaggcggcaaattcgcaatagttcacggtttactcgaccatctgttgcgccgcctgtttcagtccctgttcgagtgcggcggtcatcgcggcgtagccgtcaccctgctgttcggtttcgatatggaagggtctgttcgtaccgtcgggtaggacggcgtagccgctgatgagggttttgcccgtgtagctgccttggaatgcgtcgatatagaccgtccatttttcggtactgccgctgcgtgaggcaggaacaaagatgcgtgtgctgtccaaacggttgaatgcattgctcaacgccgcttcgagcatatcgtccaaggtgtctgcccagacgtggttttgtgcggtgttgaggcggtaggggtcggtttgatagaccagtccgccgcgtttgagcggttcggcaagacggacttcgacggcagtttcgccgccttgcgttgcaggacggatgtagcggctgtcgggcaacacgaaatattgtgtgctttgcacagtaccgcaggcggcaagcgacagggcggcggcaatcgggaaaaggcgcattatcggcttcctttcgggatagggtctttgctgctgctgttgaaaatcagcgcgttgggtttttctttcaaagtattaatcacgggttgaacgtcttttaaagttttgtccaaactttgcagcgtattttgtacgtcgccgtagataggcgattgcggcgatacgccttgcagggttgtgcgcaactctttcagggtttggttcagttcgttcggaatgttttgtgtctgcggtttgccgaccagtttgtcgatggagcttagggcggcattggcagatttgagtgtggatttgagctcggcaagcgaaccgttcaattcggcaaccgtcttatctaaaggcagtttgtcgaacttgtccagcaaatccgccaatttgacctgcaaatcgtccaaaccgccgccctgggtcgcgataacggtatcgcctgcataaacggtatgcggtcgcagcttaggtgatgcggaaggctgatcgttcaactcaatcattttgcttccggtcagcaggttgttgctggagatggtggcggtcaggcctttgtttaaggccgtctgaaattgttgtttccaatgttctttgctttgttcgtcggcattgatttccaaacgggaaggttcaatgcggatgcgtacgggtatccagccgttttcaaacaggtgcaggctgtcgttgcggtcgaaataaggaacgtcggaaaccacgccgacattcagccctttgtactcgacgggcgaaccgacggtcaggccgcgcacggattgtttgaaaaacgcggtgtagtacagcgagcggtcgtcaggcaggttggcgacttcgctgcggctgtcgtaaagcgtgaagctgtcttcgcttttgacgtttttactgtttttggttttcggcgaatcaaatgaaatcgcgcccgacagcagggcaggcagaggggcggaattgagtttgatgccgctgcctgtggtttcgatattgatgccgctttccagccaaaaacggctggcggaatgaatcagtttgtcgttggggctttggatgaagatggtgtaatgcacgctttggtcggacgggtcgaaatgcgcgctttcgacttgcccgaccataaaattttcatacaaaacagggctgttgacgttgaggatgcggtcgtttttaccaatcaaattcaagcgcagcccgctttgcccgatggcggtaacgggcggaatgtcctgcacttggaacacgtcttttgcctcgtcgcttttgccgggtgtaaaggcgatgtacgaacccgaaagcagcgtacccaaaccggttacgccgctttggtcgatacgcggcttgaccacccaaaactgggtatcgctgcggatgaggccggatacgtccgcattgagttgggcggttacttccacgcctttttggtcgtcgcgcagtttgattcgggtaacgcgtccgacatcgatgctcaatactttgatgaccgtattgttgacctcaatgccttccgcgctgtccatcaagagcgtaaccacaggccccctgttgcggatttccttaacccaaagccagccgccggcaatcagcgcgatcagcggaaccagccagacggcagagaggaaggtgttgtttttgcggacgcgtgcttgggcgtgtccgtttggaggagggctgttgtcagtcatgtttttccgtttcattgaaagcaatgccgtctgaagcgcgtttgtcccaaagcaggcgcgggtcgaaataataggcggacagcatcgtcagaatcacgaccaggcagaaatagactgccgcactgcccggaatgacgcgcgcggcataagtgtggaacgaacacatcaaaataataatcacaaaaatatcaatcatcgaccagcggccgaccgcttcggtgatgcggtagaggtgcgacaatttctttgcacccgttggcaaagcgaagcgggcggacgcaatcaaaaccgacattgccgcaatcttcagtaccggcaccaaaatactcgcgctgaaaataaccgccgcaatcagcctgtcgccctcgtcccacatataagcgatgccgttaaggatggtattgacctccgtggcggcaggattggacgaaatcataatcggcaggatattggcagggaaatacaaaataaccgccgccgtcagaaacgccgacgaaatactcagacttttcggccgtcggcggtacagttccgcaccgcacacgccgcagggggattcggcactgtcgcggaaatacaggcagcggctgcaacaggttttaccttccgatgccgtctgaaccgcattatcccccgtcagccgcccgatttgaaaatacacccaatgctggggaaccgataccgaagtccgaatcagcataactgacagcgcgaacatcagataaaacgccggcccgaagcgaacctctgccacagacgagagcttgatatacgccaccaaagtggaaacaaaaaacacatccaccatcatcgcctgtctcaagcgcaccatcacacgcgttgccaaacgcagcgcaggatacgcctgtttccgtatcagcgcggcatagacatacaggcacagcagcagaaacagaaccggcgcgccgaaagtcagcacaaacatcacttcggccaaaaaaccataatcctgaaacaccatcaggcgcatcatctcgggcagcgaaaggacggatgccgcacccggtatcccgacctcgatatacgtcataccgtaagcaaacgccattaaaatcagcgaagccgccgcataggcgggcggggcggaaaaaggatgcctgcccaccctgaagagtttgtgtccgcaacggggacagaacgccgcttctccactgtccaaccggggtacatccgcgcggcagccgcattccggacaatctaccgtatgcggcggcagggcttcgtcgcagcagttgccgcgaaggctgtgggggatattttcggcaaacggcttcatcgggaaagtggcaaatataagtggcggcattataaaggaaaaaaggcgatacacccaatcaggatgcaaaaccggcaggttcggcagtatgaacaaacccttggtgtccggcaaaaatattttttgagcggttgtccgccgactgccgaacccatttgataaaatcccgattctgtaaagaatagtaaaatacctgcttaaaaacatcacgcaaatgatattttttccaaaaatatgtgataataaatttcgtttatgattctttattatttttatagtggattaacaaaaatcaggacaaggcggcgaagccgcagacagtacaaatagtacggaaccgactcacttggtgcttcagcaccttagagaatcgttctctttgagctaaggcgaggcaacgccgtactggtttttgttaatccactatatatgcgggcaagtgcggattttgcccgcaccgcatccttatcccttaccgacaaaggaaaaaatatgagtgaaaccgaaaatcaagcattgacatttgccaaacgcttgaaggcggataccacggcggttcacgacagcgtggataacctcgttatgtctgtccaaccgtttgtcagcaaagaaaactacatcaaatttttgaaactccaatccgttttccacaaggctgtcgaccacatctataaagatgccgaattaaacaaagccattcccgagctggaatacatggcgcgatacgatgccgtaacgcaagaccttgcagatttgggtgacaaaccttacgaatacggcaaaccgctgccgcatgaaaccggcaacaaagcaatcggctggctttattgcgccgaaggatccaatttgggcgcggcatttttgttcaaacacgcccaaaaactcgattacaacggcgaacacggcgcgcgccacctcgcaccccatcccgacgggcgcggcaaacactggcgcgctttcgtcgagcatctgaacgctttgaacctgactcccgaagccgaagcggaagccatccaaggcgcgcgcgaagcctttgcattctacaaagtcgtgttgcgcgaaaccttcggcttggcagccgatgccgaagcaccggaaggaatgatgccgcacaggcactaaaaaataatcgaaccaaataaacaagaatcgaaccaaataaacaaggtctcggcatagctgtttgcagggacctttaattacacggcgcggctttgtttacatggattactgtcttattaaatattaatgattatcataaaatctattattcgctaaccgatggatgaacaatccatacatcttgagttgataatatgaaaccattacaaatgctccctatcgccgcgctggtcggcagtattttcggcaatccggtcttggcagcagatgaagctgcaactgaaaccacacccgttaaggcagagataaaagcagtgcgcgttaaaggtcagcgcaatgcgcctgcggctgtggaacgcgtcaaccttaaccgtatcaaacaagaaatgatacgcgacaataaagacttggtgcgctattccaccgatgtcggcttgagcgacagcggccgccatcaaaaaggctttgctgttcgcggcgtggaaggcaaccgtgtcggcgtgagcatagacggtgtaaacctgcctgattctgaagaaaactcgctgtacgcccgttatggcaacttcaacagctcgcgtttgtctatcgaccccgaactcgtgcgcaacatcgaaatcgtgaagggcgcagactctttcaataccggcagtggtgcattgggcggcggtgtgaattaccaaacgctgcaaggccgtgatttgctgttggacgacaggcaattcggcgtgatgatgaaaaacggttacagcacgcgtaaccgtgaatggacaaatactctcggtttcggtgtgagtaacgaccgcgtggatgctgctttgctgtattcgcaacgtcgcggtcatgaaaccgaaagtgcgggaaaccgaggctatgctgtggaaggggaaggcagtggcgcgaatatccgtggttcggcacgcggtatccctgattcgtccaaacacaaataccacagctttttgggtaagattgcttaccaaattaacgataaccaccgcatcggcgcatcgcttaacggccagcagggacataattacacggttgaagagtcttataacctgaccgcttcttcctggcgcgaagccgatgacgtaaacagacggcgcaatgccaacctcttttacgaatggatgcctgattcaaattggttgtcgtctttgaaggcggacttcgattatcagaaaaccaaagtggcggcggttaacaacaaaggctcgttcccgatggattattccacctggacgcgcaactataatcagaaggatttggacgaaatatacaaccgcagcatggacacccgattcaaacgttttactttgcgtttggacagccatccgttgcaactcgggggggggcgacaccgcctgtcgtttaaaactttcgtcagccgccgtgattttgaaaacctaaaccgcgacgattattacttcagcggccgtgttgttcgaaccaccagcagtatccagcatccggtgaaaaccaccaactacggtttctcactgtctgaccaaattcaatggaacgacgtgttcagtagccgcgcaggtatccgttacgaccacaccaaaatgacgcctcaggaattgaatgccgagtgtcatgcttgtgacaaaacaccacctgcagccaacacttataaaggctggagcggttttgtcggcttggcggcgcaactgaatcaggcttggcgtgtcggttacgacattacttccggctaccgtgtccccaatgcgtccgaagtgtatttcacttacaaccacggttcgggtaattggctgcccaatcccaacctgaaagccgagcgcagcaccacccacaccctgtctctgcaaggccgcagcgaaaaaggcatgctggatgccaacctgtatcaaagcaattaccgcaatttcctgtctgaagagcagaagctgaccaccagcggcactcccggctgtactgaggaaaatgcttactacggtatatgcagcgacccctacaaagaaaaactggattggcagatgaaaaatatcgacaaggccagaatccgcggtatcgagctgacaggccgtctgaatgtggacaaagtagcgtcttttgttcctgagggttggaaactgttcggctcgctgggttatgcgaaaagcaaactgtcgggcgacaacagcctgctgtccacacagccgctgaaagtgattgccggtatcgactatgaaagtccgagcgaaaaatggggcgtattctcccgcctgacctatctaggcgcgaaaaaggtcaaagacgcgcaatacaccgtttatgaaaacaagggctggggtacgcctttgcagaaaaaggtaaaagattacccgtggctgaacaagtcggcttatgtgtttgatatgtacggcttctacaaaccggctaaaaacctgactttgcgtgcaggcgtgtacaacctgttcaaccgcaaatacaccacttgggattccctgcgcggtttatatagctacagcaccaccaatgcggtcgaccgcgatggcaaaggcttagaccgctaccgcgccccaggccgcaattacgccgtatcgctggaatggaagttttaatctggtattattgaattaatcgccttgttgaaaattaaagccgtccgaattgtgttcaagaattcattcggacggctttttaccgtaaatctgtgtgatggggttttatattgatacagtatccgaactcaggcagggggtaatgttgcaggattaaaaatgccgtctgaaaaatgtttcagacggcattttttggttgccgatatgttaacggacgacgttggcgcgcatgaccacgcggacgtggaacgagcctgcctgacagtcgtattgtccgccttgcagcggctgcttgtcgaagtagctgtggaagccggtaacgccgcgtccgcaagggtggcggcagatgccgcattgtgtttataatgccgtgtcagacgtttgatttatgggaaaataatgatgcttaccaatcaggaagtaaccggtgtcaaactgggataccgcaaagccgttttatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactataaatagcaaggtgtgaataaaacggcggatataatcaaatatatgtaatgagattcccaaaatcttggtaatgatgtatattagtcaagttagctaatcatgagaagtgttatgtttcaagcaaatattcatcaggcaaaaaccaatttgagtcaattgattcaaagagcagaagcaggggaaatcgttattattgcgaaggcaggtaagccttgcgtccaactaatcggtattgaaaaaccggcacgaaatgcaggaaggttgaaaaaattcagtcatatggaaaatacggatatttcacgtattcttgaggatgacaatgaaacggcagctttattttttgaggagtcggctctgtgagaaagattctgcttgatacccatgcgttgctgtggtggttgttggatgacaagaaactggggatatctgcacgcaaactgatagaaaatccgagaaatgcgatctttgtcagtgcagcaagtatttgggaaatttccatcaagcagaacaaggggttgttgaaattaccggaagagttttttgatgtgcttcaagaagaggattttgaaatgttgcctataggtctgtttcatgcaaaacaggctggaagccttccggagatacacaaagaccctttcgataggatgttgattgcacaaacccaagcggaaggctttgaactgatgactgtcgatgaatatattccgcaatatggaattagagttgtcaacgcatcaagctgacaaatacaaaaactgtgtacacaagaaagaccgccgaggcggtcttttcggttattgtcttcgcttaaaagccagacttctgtcgtggactataggtgtgtcccgatctgaatctgccgcacaataaggcaaggggattaaaaatgccgtctgaaaaatgtttcagacggcataatggcttaggggttcaacacgcgtgcgatgagggctttttctttaccctgcatattggggattttgacctgaatgccgttgcccggggcaacatcgacaggctggcctttgcgggtcatttgttccaatttgatggtttggttgccgctcgggtggatgatttcgagtgaatcgctgacggcaaagcggtttttgacttccactgttgcccagccgttttcatcgatttcggtaacgtgtccgacgtattggctttgtttggcggtggaatggccggtcaggtagttttgataatcctgagtttggtggcgttcgaggaagccgctggtgtagccgcggttggcgaggccttcgagttcgctcaacaggctgtaatcaaacggacggcctgcgacggcatcatcaatcgctttgcggtaggactgggcgacgcgtgcaacataatagagcgatttggtacggccttcgactttgaggctgtccacgccgattttggcgagtttttcgacgacttcgataccgcgaaggtctttggaattcatgatgtaggtgccgtgttcgtcttccataatcggcatcatttcgcccgggcggttggattcttcaatcaggaaaactttgtcggcgtagggatggcgtttttgaccgttgatgccttcaaagttttggttggcttcttcttgggctttttcaaagttgaaaccttgcagaagctgggcatcgcctgcatcgctttccgtggcattgtgaaccttgtaatcccaacggcaggagttggtgcaggtgccttggttggggtcgcggtggttgaaatagcccgacaataggcaacggcctgaataagcgatgcacaatgcgccgtggatgaagacttcgagttcgatgtcggggcattcttggcggatttcggcgatttcttccatactcaattcgcgcgacagaataatgcgttcgacgccgatgttttgccagaatttcacgccccaatagttggtggtgttcgcctgtacggacagatggatcggcatttccggccatttttcgcgcacggtcataatcaaacccggatccgccataatcagcgcgtcgggtttcatggcaatcagcggctccatgtcggcaacgaaggttttgagtttggaattgtgcggcagggtgttgacggttaaaaagaattttttgttgcgctcgtgcgcttctttaatgccttgttctaaaacatcaagtttggcaaattcgttgttgcgggcgcgcagtgagtaacgcgggctgccggcgtaaacggcgtctgcgccgtagtcgtaggcggcgcgcattctttccaatccgccggcgggcaataagagttcgggtgctttcatcgtgtttccttttcggttgaaaccccgccctttagggcagtagaatcagactttatttgggaggggcgtaaccccttccgaatcagggcaacatatagggcgacgctttatgtgtcgtcctgtgtgttgaaacatgatttgtatgctttgtaaaaatgtttcagacggcattgctgcaaatgccgtctgaaaagggtttgaggatgggcggattatccgcctttttgtattttcggtcaattttgacgggaaatttataaggatttatcaagtatttgcctgcttgggatataatgcggtagtttgaatgcgagagagaatgtgatgaatcctaaaatcgtgtttttcgacattgacgatacgctgtaccgaaaatatacggatactttgcgcccttccgtgaaaacggcggtggcggctttgcgcggcaaaggtatattgacggcgttggcaacggggcggtctttggcgacgattcccgaaaaggtcagggatatgatggcggaagcgggaatggatgccgtggtaacgataaacggacagtttgcgctgctgcacggaaaaaccgtgcgcgaagtaccgatggatgccggtttgatgggcagggtttgcgcgcatttggatggcttgggcatggattatgcgtttgtcggcggagaggggatcgctgtgtccgcgctgtcggaatgcgtgtgccgcgccttgaagcatatcgccagcgatttttttgccgataaggattatttttcaagcaaaccggtgtatcagatgctggtgtttgcggaggaaaacgaaatgccgctttggtcggatattgtggaacgggaaggcttgaaaacggtgcgctggcacgaggaagcggtcgatctgctgcctgcgggtgcgtcgaaaacggacggcatcagaagcgtggttgaagcattgggatgggaaatggcagacgtgatggcgttcggcgacggtttgaacgatgtggaaatgctgtcagaagtcgggttcggcgtggcaatgggcaacggggaacaggcggcgaaagaagcggcgaaatatgtttgccccagcgttgatgaagacggcgtgttgaggggcttgcaagatttgggcgtgatttgaacgcatcataacaaccctgccggtttcagacggcagggtcggttttcagcccttcatacagccttcgttttgaagcagggtaaataagggcgcgccgcttgcacggatattcttgccgccttgaaggtcggtaaattccaaaatggcggcggcttcgacaatttctccgccgagtttgcggatcagttccagtccggcaagcatcgtgccgcccgtggcaatcaaatcatcgaccagcagcacgcgcgaaccgagtttgacggcatcggtgtggatttccaccgcagcttccccgtattcgagcgcgtagctttgcgatacggtttcaaaaggcagcttgccttttttgcggatggggacgaaaccgacgttgagctggtaggcgagtgccgcgccgataatgaagccgcgcgcgtccaaaccggcaacgatgtcgattttctgatccatatagcggtaaaccaataaatcaaccaaaaggcggaagtattccgcgctttgaaggacgggcgtgatgtcgtggaataagatgcctttttgcggccagttttcgattttgcggattttgtcggcaagcgcgccgacactcatagcttcgggatgaaccagcattgcgtgttccaagtttgatgtttttaacgccatattgtagccgtcagcctgtcgcttgccaaatcaatcaaaacaatagcggcaaaatatgggcatcggcaaataggaaactgggtgtccattgtgatacaatcggctggaaaatatacaggtaaaaaatatgtccgcttatcgaaaaggcaacatctttatcatttcggccgcttccggcacgggcaaaaccacgctggtgtcgcggctgttggcaaaccataacggtttgcgcgtttccgtgtcgcacacgacgcgcccgccgcgtgaaggcgaagcaaacggcgtacattatcactttgtttccaaagaagagtttgagtcgcttatcgcgcaggaagcttttttggaatacgccgacgtatttggcaactattacggcacaggcgcggagggtgtgaatgcgttggcggcggcaggctatgacgtgattttggaaatcgacgttcagggcgcggcgcaggttcgcgacgcgctgcccgaagccgtcggcatctttatcctgccgccttctttcgacgtacttgccgcgcgcctcaacggacgcgggacggacagtcgggaagttatccaaaggaggctgtcgaaggcaaggcatgaaatcgagcagtccgtattgtttgactttgtcgtggtcaatgacgacttggcgcgagcggaggaggatttgcgccatattgtgaatgcctgccgtctgaaaaggtcgcggcaactggggtttattgcagatttgttggaaaattcctagaaaacggcgaaaatacccggtttcccaatttaaatatttttgaaagaaagcaaataatatggcacgtattaccaccgaagactgtaccggaaaaatttccaaccattttgacctgacattggtagcggctcgccgcgcccgccagcttgagaacggcaacacgccgcttgtggacgatgtccgcaataacaaaccgaccgttaccgccttaagggaaatcgccgccggacatatcggtacagaactgttgacgcgcaataaataaattctgccggaaacgcacgccggaacactttgccgccgtgcagtccgacggtttgaaatgaaaaacacatacataccgaaagccgtctgaaatgcccgccccccaaccttccgccccttacgaccccctgaccgccgaagcgcgtgccctgcttttccataccgcctcctacctcaagcccgaggaacaggcggagcttgaaaaagctgtcgcctatgcgtttcgcgcccacgacgggcaaacccgcaaaagcggggagccctacatcacgcatccgattgccgttgcgacgcagctcgccctttggcatatggacatacagggtctttgtgcaggcgtgatgcacgacgtattggaagatacgggcgtgacaaaaggggaaatggcggcggtgttcggcaatacgattgccgagatggtggacggtctgtccaagcttgaaaaactcaaatttgaagatcatgcggagcatcaggcggagagtttccgcaaactgattttggcaatgaccaaagatgtgcgcgtgattgtcgtcaaacttgccgaccgcctgcacaatatgcggacgctcggttcgatgcgcccggacaaacgccgccggattgcaagggaaacccttgaaatctatgcacagattgccaaccgtataggtttgaataacgcatatcaagagcttcaggatttatcgttccaaaacctgcatcccaaccgctacgagactttaaaaaaagcgatggacaagagccggaagaaccggcaggacgttgtcggcaaagtcttgcgcgcattcggccagcggctggtaggcgcgaatatagaggccaaaatcaaaggcagggaaaaaaacctgtacggcatccatcagaaaatgatggcgaaaaagctgcgctttgccgaggttatggatatttacggtttccgcgtcattgtcaacagcattccagcctgttatgccgcactcggcgcattgcacaccctctatcagcccaagcccgggcggttcaaagactatatcgccattccgaaaagcaacgggtatcaaagtctgcatacgactttggtcggcccttacggcttgccgattgaagttcagatacgtaccaaggaaatggatgctgttgccgaaggtggaatcgccggacattggagctataaatcatattctaagacggtcgatcaggcggtgcttcacacaaaccggtggctgaaaaatatcttagatttgcaggcaagcagtgccaatgccattgagtttctcgaacacgtcaaagtcgatttgtttccgaacgaaatctacatccttacgccaaaaggaaaaatcctaactttgcccaaaggggcaacgcctgtcgattttgcttatgcggtgcataccgatatcgggcacaaaaccgttgccgcacgtatcaacaatatcatgatgccgttgcgtacgaagctcaaaaccggtgattctgttgaaattatcacatccgaacacgccaaacccaatcccgcgtggttgaatttcgccgtgtcaggcagggcgcgcagcgccatacgccaatatattaaaaaccttaaccggcacgatgcggtcgttttgggagagagcctcttacaaaaagccctgtccagtttgctgcccaaagatgtcctgctttcagacggcatcaaggaaaaatatcttgccgatctcaacgacaagcagacatcgtttgaagaagtgctgtacaacgtagggatggggcataccctgcctgtttatgtcgccatgcacattgccgagttggcaggggagcatttcggcagcgaggtcaggctcagttccattaaagtcgatgggcaggaaagcgggcatattcattttgcagagtgctgccaccctgttcccggcgattccatccgtttgctgttggttaagggaaaaggcatgattatccatagggatacctgcccgacgttgttgaagtccgatcccgaacagcagctggatgcagactgggaaaatatgaacgggcagaactaccgtgtcgggcttcaagtccaatcggaagacagccacggcctgttggcattaatggcgcaagcgatttccgattccggtgcagacattgagtcggtcgaaacaccgtctaaatcccagtcgggaacggaaggttttgtcgaattcaaattcttattgaaagtcaagaatctgaatcaattgaatcagattattcaaaatctgcatagtattccatatatccgcaaagtcatcagaagttgaagcaggtaaaacgggttgccttttgattaacaggcaacccgttttatggtttatccgttcaattgcttatttgctcaaatatacggcaagcctttcaacaatccgcattgccgcttcatctttacttgtttcgggaaaagacagttccccgtcgtccccgataatggtaatccggttggtcggtttgcccattgcgattgaaacatcattggcaacgatcatcggtagctttttcttaatacgtttttcccgcgcatatgtcattacattctccgtttcagcggcaaaaccgatgcagaacggcgggttcggtaatgaggcaatagaagccaaaatatcggggttctcatccaattcgatggataacggtttggcatttttatcttttttgaatttttgagtactcctattcttaaccctatagtctgagacggcggcaacagaaataaaagcatcttgtttgtcgattaaacgatgcactgcgcgatgcatattttcggcactgacggcttgaaccgtatcggatatgccgaaaggcagcgcggtttgaagctgtccgtgaatcaggctgacttctgcaccggcggcacggcacgcccgcgccaaagccacgcccattttcccgctggagatatttgtgatgcctcggacagggtcaatggcttcaaatgtcgcacctgcggtaatcaagacttttttgccctttaaaattttcggtgtccataaatccggaagcagatccagcaattcggcaggttccggcatccttcccataccattttctccgcaagcctgttcgcccaagcccggcatatagacagtaatgccgtctgaaaccagttgtgcgatattccgttggttggcagggttgagccacatttccacattcatcgcgggcgcgatggcaagcggacatttccgtgcggctgccagactggtcagtaggttatctgccacgccgttacagatttttgccacggtattcatacttgccggcgcaatcagaaaaacatccgcattccgggtcaggttgatatgttccataccgtttgaaccgttgccgccgtgcgtgtcggtcaggacaggattgccgcttaaagcctgaaaagtcagcggagaaacaaattcagttgccgagcggctcataaccaccgtaaccgaatgcccctgttttttcagcagtcgcaccaactcgcaagacttatacgccgcaatactgcccgttacacctaaaagaatatgtttgcccattttgacaatttctaattacgaagaaaaaacagcagccattctataacaaagtacggatacattagataccgtttggatacaaaatgccgtctgagtccccgagtttcagacagcatattcacaaaggcgcaccagccggaggagggagaggaaaggattgttggaggcggcgcagtatttagcagaaataaaaaaccttatccgacagcgacatgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaacaaaacagattaccgataagtgtgagtgccttgagtctcacactgtttgaaagacagacaagataatgttttgaacattgtcctgttggtttctttgaagcagaccagaagttaaaaagttagagattgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtaggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagagaaagaagaggctttaggcattcacacttatcggtaaactgaaaaagatgcggaagaagcttgagtgaaggcaagattcgcttaagaagagaatccgggtttgtagctcagctggttagagcacacgcttgataagcgtggggtcggaggttcaagtcctcccagacccaccaagaacgggggcatagctcagttggtagagcacctgctttgcaagcagggggtcatcggttcgatcccgtttgcctccaccaatactgtacaaatcaaaacggaagaatggaacagaatccattcagggcgacgtcacacttgaccaagaacaaaatgctgatataataatcagctcgttttgatttgcacagtagatagcaatatcgtacgcaggg

SEQ ID NO: 9 - DNA, 9941 bp, Neisseria meningitidis
gtagccggcgcacgacaagccttgcggagcggcatctgccgaacaagcctccctcgccgaagaactgggcatcagcattgaccgcaagtttaacgagcagctcaaaggcgtgtcgcgcgacgattcgctcaaacgcatcctcgcgcacggcggcaaaaccgtcagcgaagccgagttcgccgaactgacccgccgtaaaaacgacaactacgtcgagatgattcaggcagtcaaacccgaagacgtgtatcccggcattttgcccctgctggaagcattgagggcaaacggcaaaaaaatcgcccttgcgtccgccagtaaaaacggcccgttcctgctggaacgcatggggctgacccacttcttcgacgccattgccgaccctgccgccgtcgcacattccaaacccgcccccgacatcttcctcgcagcagccgagggcgtagatgcggacatccgccaatgcatcggcattgaagacgccgccgccggcgtcgccgccatcaaagccgccggcgccttgcccatcggcgtgggcaaagccgaagacttgggcagcgacatcgcgctggtctccggcaccgccgagctgacctacgcctacctgcaaagcgtgtgggaacagtcgggcaggtaaaacgcgtcagataaagtgtcaaggaagcaaaagaccgtctgaacagtgtttcagacggcctttttgcttttagaacagaatgataacccaacttacgcaaccctaaaaactaaatgccaatctcttaaccatgctattcaaatttatttgaacgattttttttctaaccagccaaccttaacaatcactattaaaatgcgcgccgatgttctgtctccgcctgtatgcggcttgggcgacggcgaggctgcattcgagcaggttgcggttttcgtattcggacgcggtgtgcggttcggcttggttttgcttccaaagctgcagttgggcgatggcgcggcgcaggccggtatcgttgcgtaggatgcctagatggcgttggttgaacgtttgcaggacggggcggctgaatgtgttttgaaggtcgtctgaaaagatgcctgcttcggcggagaggctttcagacggcctttggaatggttcggcttggaatgcttgtccgtctgcgatggcttgggcgcagagccttgcggtcacgacgcattcgagcagggagttgctggcaaggcggttggctccgtgcagcccagtgcaggcggtttcgcccaaggcgtagagctgcggcagggaggttctgccgcaggggtcggtttggatgccgccgcaggtgtagtgttgcacggggcggacggggatggcttggcgcgtgatgtctaggccgcattgggataaacagtgtcgatggatggatgggaaatgccggcggacgaacgctgcgggttgatggctgatgtcgagcgagacgaagtcttgcgtttgtttggcgatttcggctgcgatggcgcgggcaacgatgtcgcgcggtgcgagttcggcgcggcggtcgtaatgcggcataaatcgttcgcccgcttggttggtcaggatgccgccttcgccgcgcacggcttcggaaatgaggaaggtgcgtccgttttcagacggtcttgccaagcctgtggggtggaattggataaattcgaggtttccaactgcgcagcctgcgcgtatcgccatggcgatggcgtcgcccgtgcattcgggcggcgtggtggtggcggcgtaaatctgtcccaagccgccgcctgcgagtacggtatggcgggcgcggatgcggtaggtttcttgtgttcggcagtcgaggacggtcagtccgcacgccgcgcctgattcggtttgaatgtccaacgccatctgccgctcgcaaacgcggatgttcgggcggcggcgtatttgggcaatcaggctctgcatgacggcttcgcccgtgtagtcggcgacgtgggcgattcgtcggcaggtatgcccgccttcacgcgtcaggtgcaggccgttatgattccggtcgaacgccacgccctgcgccagcagccattcgattgccggtttgccctgcgacaggatggcgcggacggcggcttcatcacacaaacccgcgcccgcttccaaagtatcggcaacgtgtttttcgatgtcgtcctctcccgaccacgccgccgcaatcccgccttgcgcatgacggctggcggtgtcgtccagccggtttttgcacaaaataacgatgcggaacgattcaggcagcgacagggcgagcgtcagtgccgccagcccgtttccggcaatcaatacgtcgcaatcggtttgcatggtgttgtccttgtttgagaggccgtctgaaacggtatagtggattaatcaatgccccgacatatgcgacatggtattgagaagcaccacgcccagcaaaatcaaaccgatgctgacaatcccaatgaaatcagctttctcaccgaaaaacaccacgctgactaaagccgttaaaaccagtcccacgcctgcccaaatggcgtatgctgtagccagcggcatggttttcagtgtcatagacaaggcccaaaaacacaccgaaaagctgactaccacgccaatagaaggccacagtttgctaaacccgccactcagtttgagcatggaagaaccgcagacttcgcttaaaattgctacagtcagaaagagccagtgcatttgcatgtttttacctgataaatgaaagaaagtataattatatcaatgcaataaaataaaaaaacagtcttgttgttaaagattttttgtgtgcaaatcccgtcttgggaaagcaggcgggcggtattttcaggctgcacccattacgaacgacaaatcaggcggggcccatgccgttgaacacatcttttttcttcagccctgccgcaaagtcgagcatacgctgcaaaggcagtttggcggcttcgcccagcttcctgtccaacaggatttcgttacgtccgcttgtcagggcgtatttgatgccgcccagcgaattcatcgccatccacgggcagaacgcgcagcttttacagcttccaccgttgcccgccgtcggcgcggcgataaattgtttgtcgggcgcctgcttttgcatttcgtgcaggatgcccaaatcggtcgccacgatgaattttttttcaggacgcgatacggcggctttgagcagtttgctggtcgagccgaccacgtcgcccagttcgatgacgctttgcggcgattcaggatgaaccagcaccaccgcttcggggtgttccgccttcaacgccgccagctcttgccctttgaattcgttgtgaacgatgcacgaaccctgccacaacagcatatccgcgcccgtttcgcggcagatgtagtcgccgaggtggcggtcgggtccccaaatcagcttctcgccgcgtgatttcaaatacgatacgatttctaacgccaccgaagacgttaccacccaatcggcacgcgctttcacggcggcggaagtgttggcgtacaccaccaccgtgcggtcggggtgttggtcgcaaaacgctgaaaacgcttcttccgggcaacccaaatccaaagaacattccgcctccaaatcaggcatcagcaccgttttttcagggcagaggattttcgcgctctcgcccatgaagcgcacaccagccaccaccagcgtaccggcttcgtgttccgcaccgaagcgcgccatttccagcgaatcgcccacgcatccgcccgtctccaaagccaaatcctgaatcagcggatcaacgtaataatgcgccaccaagaccgcgtttttctccttcagcaaagccttgatttcgtctttcagacgatctgccgtctcgcggtcgggcgtgtcggcaaccttcgcccacgcctgacggatttggcaggcggaagtcggcgtttggatgagtggcatatcgtagtcgaacgagcggcgggcggcggtttgcatgatgtttccttgtagctgtttttcagacggcatgaaggtttgccgtctgtttttcaaactgtttttacattatgctcaacttgagtataatatgcaaggtcgtctgaaaacaggtttgcaataccgtaaaaccgacccgcttcgttccgacaaaccgctttggtttacaataaagcctttcccacccgcagaaagccgagcatggatgcctaccccgaagccgaagccccgccgcaaagcatcgtcgagctggttcccgtattgattgccgttaccgacggcggcctgcgggtattgaccgtcgcccaaggcatgctcctgcccaacggcccgctctcccccctgcgcaattccttgcaggcaggcgtaaaactgtgggtcgccaagcagacttcgcagcctatgggctatgtggaacagctttacacctttgtcgatacccaccgccgcaacgaacacggcatgcccgtgctgtacgtcagctatttggggctggtgcgcgaggcagccgacagcatcctgcacccggatgcgaaatggcaggactgctacggctatttcccgtgggaagacttgcgcaccgacggcgggcagcgcgacgccgtcgtcggccgcctgcgcatttgggcaaactcggcggacacggaggaagtgcgccaaaagcggctcaagcgcattcatttgtgctggggggtcgaaccggaaaactggtcggaagaatacgttttgcaacgctatgaaatgctgtatgaaagcggcctgatagcggaagccgccgagccgcaggcaaacttcgacttcgcgcttacggggcagcccatgcgccacgaccaccgccgcgtactggcgaccgccctgtctcgcctgcgcgccaaaatcaaataccgccccgtgatttttgaactgatgccgcccgaattcacgctgctgcaactgcaaaacagcgtcgaagccatcagcggcagattgctgcacaagcaaaacttccgccgccagattcagcagcaaaacctcatcgagccgtcggataccggcgtatcgggcagcaaaggccgtcccgcgcagctttgccgcttccgcgacgacgtcctgcccgacaggctgatttcggacatcggactgccgctgggcagccgttagcccgttttcagacgacctatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgtaaaatgaagttttgccccatcggtgcaacatcaatctttttcaacaaaggaaaccccatgccgtctgaaaaaaccctctttcccctgcccgacaccctgttgcgccccatagtagaacaagccttgagcgaagacttgggcaggcgcggcgatattacgtccgccgccgtcatcgcccccgacaaaaccgccaaactcttccttgtcagccgcgaagacggcgttatcgccggcatggacttggcgcgtctcgcctttcagacgatggatccgtccgtccgcttccaagccgaaatccgagacgggcaagccgtccgcgcaggtcagacgcttgccgccgtcgaaggcaacgcccgcgcgctgctcgccgccgaacgcaccgcgctcaactacctcacgcacttaagcggcatcgccaccgccaccgcgcgtgccgttgccgaagtcgccgaatacggtacagacatcgtgtgcagccgcaaaaccatccccctgctgcgtgtcctgcaaaaatacgccgtcagggcaggcggcggtgtgaaccaccgcatgggtttggacgacgccgtgctcatcaaagacaaccacctcgcctattgcggcagcatcgcccaagccgtgcagcaggcaaaacaggctgtcggagcattgacctgcgtggaaatcgaagtggatacgttggcacaactggacgaagccatcgcagcgggcgcggaacggattttgctggataacatggacgacgaaaccctgaaagaagcggcaaaccgctgccacacgcaaaccgcccacccccacaccatctattgcgaagcatcgggcggcatcggcttcgaccgcctgaagcgcgtggcgcaaaccggagtggacggcatcgccctcggctatctgacccacagcagccgttcgttggacataggtttggatttcgtggcgtgagttttagggtgcgggcggctgtctgatatgtcaggcaaggaaccgcttaaccctaatccggttattgcctcagggaggaaatgccgtctgaaagattcttcagacggcatttttcgtaaaggtcgtgatgctttagaaaaaacagcatttcaggcaggtattttgtttgcccgacagcgcggcggcatcggtagggcaggaaaaaggacggggggcggcagttttatgccgtctgaaagcccgcctttacgcttgtttgcaaaaaaagtgggaaaaggaacatacaatcctgtacaatcatccataaatatttgatttataatacgatttataaagataatcacaatcatccatatctgccgcccgtcaatccgcttggcgggcggcaaaggttttaggaataccgatgaacacaataccgctccacaccatactcaaacttatggcgcatcccgaacgtatggcgatactgattcaattgttggacagcgaacgcaatatcgccgaactggcaaaatccttatccctgccggccaccgcagtttccaaccatttgaaccgcctgcgcgtggaaggtctagtcgattttacgcgttaccaccgcattatcgaataccgcctggtttccgaagaagcggcggcgattctgcacacggttcgcgatttggaaaacaaacgcgtggcatagtgttagaatcctttccttttgccgtctgaacgtttcagacagcatttttcggaaatgttatgaaaatcaccacttggaatgtcaattcgctcaatgtgcggctgccgcaggtgcaaaacctgcttgccgacaatccgcccgatattttggttttgcaggaactcaaactcgatcaggacaaatttccggccgccgctttgcaaatgatgggctggcactgtgtttggagcgggcagaaaacctacaacggcgtggcaatcgtcagccgcagcgtgccgcaggacgtgcatttcggtttgcccgcactgccggacgatccgcaacggcgcgtgattgcggcaaccgtcagcggcgtgcgcgtcatcaatgtctattgcgtcaacggcgaggctttggacagccccaaattcaaatataaggaacagtggtttgccgcactgacggagtttgtccgcgatgaaatgacccgccacggcaaactggtgttgctgggcgatttcaatatcgcgcctgccgatgcggactgttacgaccctgaaaaatggcacgaaaaaatccactgttcgtccgtcgaacggcagtggtttcaaaacctgctggatttgggactgaccgacagcctgcgccaagtccatcccgaaggcgcgttctatacctggttcgactatcgcggcgcgatgttccaacgcaaactgggcctgcgtatcgaccatattttggtgtcgcctgcgatggcggcggcgttgaaggatgtccgcgtcgatttggagacgcgcgcgctggagcgtccgagcgaccacgcgccggtgacggcagaattcgattggtaaaagaccgtgttttgatatggcgttgacaagcatccttatcttcaatttattcaataggatagctttctatctgactgaaaaataattgcctttccccggcaaacagccgaaatcggcggattgttcaaacacagcctattttcctgaaaaatttatgaaatacatagggttaatatcagattttggagcagtaaaatttattatgtacactaatccaaaacaaaatcaaatattgaaaactagatttattttcgaataaatagaaagccgtcttatatatagtaataaattaataaccctgtttttcctattgcctttattgtgccatgcagttgagtttgatgaaactcaatataacgactgtaaagataaatctatgttatgtgctgtcagaattgattctcccaaaggcaataactatagtggattaacaaaaatcaggacaaggcgacgaagccgcagacagtacaaatagtacggcaaggcgaggcaacgacgtactggtttaaatttaatccactatataaatctatgtggtttgacaatggcaagttagtatttatatcctttactaatcaacaaatggaaaatcaaagtcgcccatctctagcgatgtttattagtgatgacaaaatatccagtaccaatattgatgaatttttagcatctttcgatcctgataaatatcgaatatttcatgatccaagatataaatttttacctagtatgtcgaactcattgtaatccttattctctttttgatattgatagcaaatataaacctgatgagaaagataaaatctttttttcaatcccgacagataacacagatttttataagggtttttatttaaataaggattatatagaaggtatatatcctagtaggcataatggcagctattacaaaatatagtggattaaatttaaaccagtacagcgttgccgtactatttgtactgtctgcggcttcgtcgccttgtcctgatttttgttaatccactatatctgcatcagtttcatgaaacgcaagtcggaagcgtcaaacaactgattgcccattttgaccggctgattgacgaattggacaaacaaatcgacgaccacacccacacgcattttgacggcaaagcccaagtggcagaacaaatcaaaggcatcggttcgataacgacggctacgctgatggcgatgctgcccgaattgaggcggctgtcgcacaaacggatagcgggtttggccggcattgccccgcacccgagggagagcggggaaaccaaattcaaaagccgctgctttggcggaaggtctgcggtgcgtaaggcactgtatatggctaccgtggcagcgacacgttttgaaccgcttattcgggatttccaccaacgcccgctgtccgagggtaagccgtataaggttgccgttacggcatgtatgcgcaaactgctgacgatatcgaatgcccggatgcgtgattattttgccgaaaacgataccgccgaaaacggtatctaaacggcttgatttgagttttggtatttttgcccgacggggtgaaaaatacagttgctacggctcgatgaatcgtcagaaatacctgcatcgtcattcccgcgcaggtgggaatccagaccggtcggtgcggaaacttatcaggtaaaacggtttcttgagatttttcgtcttggattcccactttcgtgtgaatgacggaatgtaggttcgtgggaatgacgtggtgcaggtttccgtatggatggattcgtcattcccgcgcaggcgggaatctagtctgttcggtttcagttattttcgataaatgcctgttgcttttcatttctagattcccactttcgtgggaatgacgggattttaggtttctgattttggttttctgtccttgtgggaatgacgggatgtaggttcgtaggaatgacgtggtgcaggtttccgtgcggatggattcgtcattcctgcgcaggcgggaatccagtctgttcggtttcagttatttccgataaatgcctgttgcttttcatttctagattcccactttcgtgggaatgacggttcagttgctacggttactgtcaggtttcggttatgttggaatttcgggaaacttatgaatcgtcattcccgcgcaggcggcaatctggaatttcaatgcctcaagaatttatcggaaaaaataaaacccttccgccgtcatt

SEQ ID NO: 10 - DNA, 2445 bp, Neisseria meningitidis
gtcggttcggttttgatgcagcgtatgaaagaagaaaacgacttcgcccacattcctgaagcgtttttctttaccacttccaacgtcggcggcgcagcccctgatttcggtcaggcggctaaaacattattagatgccaacaatgttgccgaactcgccaaaatggacatcatcgttacctgccaaggcggcgattacaccaaatccgtcttccaagccctgcgcgacagcggctggaacggctactggattgacgcggcgtcctcactgcgcatgaaagacgacgcgattatcgtcctcgaccctgtcaaccgcgatgtcctcgacaacggtctcaaaaacggcgtgaaaaactacattggcggcaactgcaccgtttccctgatgctgatggctttgggcggcctgttccaaaacgatttggtcgaatgggcaaccagcatgacctaccaagccgcttccggcgcgggcgcgaaaaacatgcgcgaactcatcagcggtatgggcgcggttcacgcccaagtggcggacgcgcttgccgatcctgccggctcgattctcgacatcgaccgcaaagtatccgatttcctgcgcagcgaagactatccgaaagccaacttcggcgtaccgctcgccggcagcctgattccgtggattgacgtggatttgggcaacggccagtccaaagaagaatggaaaggcggcgtggaaaccaacaaaatcctcggccgcagcgacaatccaaccgtgattgacggcctgtgcgtccgcgtcggcgcgatgcgctgccacagccaagccatcactctgaagttgaaaaaagacctgcctgtttccgaaatcgaaacgattttggcaggcgcgaatgactgggtgaaagtcatccccaatgaaaaagaagccagcatccacgagctgactcctgccaaagttaccggcacgctgtccgtccctgtcggacgcatccgcaaactgggcatgggcggcgaatacatcagcgcgttcaccgtcggcgaccaacttttgtggggcgctgccgaaccgctgcgccgcgtattgcgtatcgtgttgggcagcctgtgagccctgtttgaatggaaatgccgtctgaagcctgtttcagacggcattttccttgcaaccctgccggataacgccctgccggcactgccgacgtaaaaaataaaggattccatttccggcggtatgcggcagcccgactttatccgaacctgatgcgcctgcacgtcaatgaaaacagcccgattgcggacttcctgctacagccgaaattccgataaggcaagcgttcacgccagcaacatttcctgcatcagcttcataccccactgccagccgccgagcatgccgttcaaactgcccgaatgcggggaaaccaacaggcgggcgttccacaaatccgcctgtttttgcgcccaaccgtgcggcacgccgccgtgttcgggtacaaccaatgcggcacggcagggacagcggacgcgttggaaagcgtgttccgcatcgtcgggaaaaatatcgggacgctgcggtacaaggatgatgttggcaattttcttccgtgtcaggatgtctgcctgatacagccacgccaaaaatgcggccgcgcccgcaccgtgtgcgacaacggcgacgtatttgccgcgtatgcgttcaaatgccgtctgaagccctgcctgccattcccctatgctttgaccggccgacgcttcggacatctgcacgacgggataactgatcgcccaacggtctatccacatctgatcctctccggcatcgcgtatcagccaaagcgtcaaatcttcgagttcaaaaccctgcataccgccccgcctatttcagcaggtcccggagggtaaaggcgatgagcagcgaagcgggtacgctcaatatggcgcagacggtcaggcaggcaaaaatattcaccacccgccgccagcctttccaacccaaacatttggacgcaatcagcaggcagggcaggcaaatcagcagccacaccaacgcccatatcgggtttgccttggtcggcgcaagccagccttgcatccgcgacaacataaatatcgcccacaccaacatgggcaggataaacgcagcgacgacccatgccgcgcctattcctgtttttccgtccacattccaatcatatttacccaaaaccttattcggcagcatagtcatactccacgaccagcggcgcatggtcagaaaatttttcatctttataaacgtgtgcggacacggctttggcagcaagttcgggcgtaaccatctgataatcgatgcgccacccgacatctttcgcatacgcctgccctcggttgctccaccaagtgtagcttgcgcgttggcattgccggaagaaagcaggctgctgttgaaatcttccgtccagtcccaaatcagcccgtgcatatcataaac

SEQ ID NO: 11 - DNA, 78845 bp, Neisseria meningitidis
ggaatttcgtgtcaagctttcgtgtgtgaaaatttttgcagtggaaacgtggacgggcggtttgacgatgacataccactgtttcggaatatccatttcgtccagcctgtcgcctataccccgcgcaaacgcatttttgccgaaaataaaaaacggtacgtccgcccccagagccgcgcccgaatcaatgagctgccgctgcgtcagaccgcactgccaccaacggttcaacaccagcaaaacggttgccgcatccgagcttccgccgcccaaacccgcccctgtcgggatttttttgtccagccatatttccacgccggcggggttgcgcgcatatttttgcagcaacgatgcggcacggtagctcaaatctacttcctgcggcatgccatcaaccggattgtgcaggatgattttgccgtcgtccctcggtttcaaatatacggtatcctgcaaatctatcaggcagaatatgctttcgatattgtgataaccgtcttcccgcctgccggtaatcctcaaatcgagattcagttttgcaggtgcggaaaacgcctgccgtccgtccgcaatattcatctgtccgccttatctcgtgcgcgccgcacagcgttccggggtttcggtttcagacggcataccgatttcggtgaaaaccagcctgatgttcaaatttccgttattcagttgcaacgttcggacttgccccccactgtcggcggttctgccgacagtccaaccgtattgttccaatatgccgtccggcaggatgcggtaaggcgcgcccgccacacgcctgccatctgcccagatatgcagatattggattggcagtttgaaaccgaccagctgcctgctcaattcttccgcactttccgcctgatagacatttcctttgccgtccactgccaatgcgccgtccctgtcttgacacaactgcccgagcgtactgcccaaaggggtattgatattgatggtttccacgggcggttggtatgtccaatcgaaatttgcatacgaacctttcccttccgctttcactgccaaccgcccttctgctgcaaaactgctgatgtgttcggacggctgccacaggttttcgttattttgaggtaattgcgcgcaagcggtcaaaagcaggatgaccgatgcggatacggtgtgtttcatcagaatttccttaacggatgccatcctgccggccgatgggttcggcgtgccgtgcaaaacgcgtgcgaactgcgtgccgtttgcccgaatgccccggcttcccggcaaaccttatgccgtctgaaaggatggacctgcattatttccgaggttttcgggaaggttggggcaatgcgatgccgtgacgtttgagcgtttcccgccatattttcttgtctcccgtaaggtgtgccgcctgcgtccatacgtcaaccgcctgatcgcgttcgcccaatgcccacaacacttcgcccaaatgggcggcaacttcgggctcggggtcgttttcaaacgaataccgcagatacggcagcgcgctttccgcgtcgcctttcaggtaatacgcccagcctatgctgtcgttgacagcggtatcgtccgggttgatttggtatgccgtctgaagcagggcgaaaccttcgtccaaacgtttggaatcggtcagcaggctgtagcccagattattcataatctgagcgttatcgggtgcaagcctgaacgccctttcaagatctgaaatcatttttttccgcttgccaagccgatcgtaaacaactgaccgctgtaccaatgcctctgcctgtaactctgtattactgccggcaggcggtttttcgataatcttgtccaaccccctcaaagcctcccgtttatcgggcagcttcgacagggcgagcatctgtattttggacaaattgtctgccgtaaaataccgcccctgctgttcgggaagtttccgcaccctgccgatctgccgcaaagccgccctgccgccgtccaactcgacagccgccgcagccgccagcacacctttgtcgaacaggtattccggcgcggatacttttttcagccactgcctgactttggcgtaatccctgcggtcggcatacatcatcgccgccgttagcgccgccctgctccgctgttcctccgtccccctgccgtatgccttttcggcgtagccgtcgataacggaagcaccttcttttcggtttgccgccaatatcgctgcctgaatatacaggtctgcattcggattgcgttccaacagcacgttcaaacgcgcataggcatcatccagcctgtgcagggaaaccagattcataatttccatttcctgccagacggccgaaaggttttgggtgtctgtctgctcgaaaaagccgtcgagtatttcgggatatttgcgtgcagtcagacgcaacgtcattaaagtggggggcaatatttccgtatcgagcttcgccaaacgctgcaaagctccgattgccttttccttttcgcgtccctgtacgctgaacaccacatcggcaaccgccgcttcgggcagatgttcatatttcaacgccgcgcggcgaaccgctttcgatgctttttgcgccaacccgtcctgttgcacggcggcttgtgccaacaataaaaacaccctgcggttctgtccttcgtccgcctgagccagcacttcttccagtccgtccagatgctgatttcctctttccctcagcacgttccgcagccaccccgcccgtttttgcgccttacccggtataggctcaatctgccgccatttctgataaatcatttccgcctgttcaaacgcgttcagcgacacggccatttccaaggcgcgttcggcgacttcgggggattttgtgcgttccaacatcagcatataggttgccagagccgttcccgcctgccccttttgcaaggcggtttcccctcccagcaacgtaaatatctgattaacccgctcgcccactgccgcaagccgtgcgcgttcgtttttgatttcttcctcgctgtaacgctgctgctttctgaaaacctttccgacttccttcggctgtttcatatcccccgcaccgcctccggcggcagatacctgtccggcaatcaaggttgccgtcaacacagttaacattttgaaacggttaggtaacataatcatcctttatccgacagccgtccgaaccttcagacggcatataatcaggcgtaactttatcacaagcagaatcgtttgtagatttgcgaaaccccgttcaaaaaataaatgccgtctgaaacgcaaatccgcttcagacggcattcccgacgcttgcggtttaagggagttttatttccaaattgtcaatcaggcgcgtcgtccccagacaggcggcggccaagaccaccagtttcttatctcccgcccgcgccacttcgagcgtatcggcgcggcggatttcgacataatcgaccacccagccgtattctgtcagggattggacggcacgtttttccaaacctgcataatccaaactgccctgcaccaaggattcggcaacagcctttaattcgcggtacaggcgcggtgcttcgtcgcgttccgccgcactcaaatactggttgcggctcgacagtgccaacccgtcttccgcgcgccctgtatcaacaggcactatttcaacatcaaaattcaaatcttcgacaaaacctttaatcacggcaagctgctggtaatccttcttaccaaaacaggcaatgtccggggaaacgatgtggaacaatttagaaacaaccgttgccacaccgcgaaaatgccccgggcggaatttgccgcacaactcattttgcagattgggcggttcgacgttgtaacgctgttccacgttcggatagagttctttctcatcgggcgcgaaaacaacggcaatgccttcggcggcaagtttgtccgcatcctgttgcaaagtgcgcggatatttgtcgaaatcctcgccctgaccgaattgcaggcgattgacgaaaatgctgaccacgacactgtccgcgcgttttttcgcctcacgcacaagcgcaagatgtccttcatgcagattgcccatggtcggcacaaatgccacctttcccgcatttttacgccacgcgcgcagttctcgaatggtatgtatgatttgcataacggtaatccttatccttcgggcttcctgcccgacaaaacgcgccgattatacgcgccgcgcacggcaaaacaaaatgccgtctgaaacggctttcagacggcatgctgcatgtaaaccgctcaatctgcaaaaatatgttccgcagcagggaaggttttggctttgacttcggcaacatacgcccgaaccgccgcttgaacactatcatgcccctgcataaagtttttgacgaatttcgccgtcttacccgggaaaatgccgagcatatcgtgcatcaccaaaacctgcccgtcgcaatccgcacccgcgccgatgccgatggtcggacaggaaacagtttcagttaccttttttgccagttccgccagtacgcactccatcagcacgaccgccgcccccgcatcgtcatgcgccttggcatcgttaagcaacgcctgcgccttgccgccgcgcccctgaactttatatccgccgaaggcaaacacggattgcggggtcagaccgatgtgcgcacaaaccggaataccgcgcatttgcaaaaattcagtcgtttccgccatccacacgccgccttcgagtttaaccatatgcgcgccggcagccatcagttcggcggcggcggcaaacgcctgctccttactctgctgatatgcaccaaacggcaaatcgctgacaatcatcgcattttttgcaccgcgtgctacacattcggtgtgataacacatatcgcgcaggctgacgggcagcgtcgatttccgcccctgaaccgccatccccaaagaatcgccgaccagcagcatttccacgccggcatcgtccatcagcgcggcaaaactggattcgtaagcggtcagcatagcgattttttcgcccgccgccttcattttttgcagtgtgttcacagtaatcatcagatattgttaccccgcccttttcagacggccttttcagtttgaaacgggctattatagtgaaatgcccgcagccctgccaccgaccgtgccgcaaatgcaaaacagcccgactgttttacacaatcggactgtcaaatctggtgccggcaccaagagtcgaactcgggaccccctgattacaagtcaggtgctctaccaactgagctataccggcttactgaaatgttttgcaacaccatcagcagaaatggtgccggcaccaagagtcgaactcgggaccccctgattacaagtcaggtgctctaccaactgagctataccggcaaagaaagcgaattatgcaggcaatgccgcaccttggcaaggaatttatccgaaagccccggcaaatccgaataagtaatttatttgaaaagaaattaatttgaaacagaacaagcatcggcattctgataaaatatccgcctttcaaaccgaccgttcacaccgatggcaagacatccctaccgccgcctgcgtcctgcaaaatccggctttcccgaagtcggcatttccgaagaaggcaatatccgttcgcttcacttgggcagcgacaccgttcaaagctcgatgaacctcgaccacccgtccgagctggtgctctcttacagccgcgcgatgatgggctggctgctgtttaccgacgctcttccgcaacatatcacccaaatcggcttgggcggcggctcgtttgcacgctggatagatacctacctgcccgacacgcgccaaaccgccgtggacatcaatccgcaggtcatcgccattgcccgcaacctgttcgagttgcctttcgagggcgagaaatttgaaattattgaagcagacggtgcagaatatatcaaagtcttccgccacaacaccgatgtgattttggtggacgggttcgacggcgaacaaatcatcgatgcgctggttgaagaaccgttcttccgagactgccgcaacgcactctcttcagacggcatattcgtaaccaactggtggagcggcgacaaacgctaccaacgcttcatcgaacggttgttgagcgtttttgaagggcgcgtcttggaacttcctgccgaaagccacggcaatgtcgcggtaatggccttccaaagcagccccaaagagcaaaacatagacaaactcaaaaaacgtgccgacaaactgagcaacgcatacggattggacttccaccgtatgcttgccggcctgaaagcgtccaaccccaacaacggcaagcatttccacctttaagcaactatcttcacggctgcatcggaacatgcggaaaatcaagaggaaatcattatgctgaaacccgaaaccatacacatatccggtcctgccggcattttagaaaccatccatatcccgtccgaacaagtaccggcacgcggtgttgccgtcatcaatcatcccaaccccctccagggcggaacaaacaccaacaaagtcatccaaactgccgccaaagccttaagcaaactcggcttccactgctacctgcccaaccttcgcggcgtaggcggcagcggaggcacacatgattacggacgcggcgaaacgcaagactgcctcgccgtcatcgattatgcccgcgcccaacaccccgaagcccccgaatttgccttatccggcttctccttcggcggttatgtcgccacatttgccgcacaagcgcgcacacccgatttattgctgctcatcggcgcggcagtctgccactataccgaccgtccggaaccgtccgccgttcccaacgttgccaaaacgctgatgatacacggcgcggaagacgaagtcgtcgaaatcgggaaagcactgaaatgggcggaaccgcaagatttgcccgtcattaccatcgccggttccacgcatttctttcacggcaaactcatcgtcctgcgcgacaccatcctccgcttcgcgcccgtatgcctgaacggataaaacccctttcagacggcatcgataatgtaaaacccgtatcggcggcatccgccgatacgggtttgcgttccctctcattataggcaaaatccgctgcaaaacaccctttcccgacccgacaaaggatctgcaaacgcaatcttttttgccaatagcttcaaaggtttccgataatcctcgctgcccgcttcagacggcacgggatagagcgcgtcattcaacagcggcatacccaaacccatcatatgcacgcgcaactggtgtttcttgcccgtatgcggcgtaaggcggtaaaggctgaattcccccctgttttcaatcagttcgaccgtcgtatgtgcgtttggttcgccttccgcctcttgcgtcgtaaaaaatttctcacccctcaccaaacgcgaaaccacatcgagcggatacggcaaatccgtccttgtcggcgcaagcgcctcatacgttttccataccgttttgttttgaaacatcgtctgataggctccgcgcgtggcaggattgtgcgacagcagcatcacgcctgccgtatccttgtccaagcggtgcagcggcgtaatgtcctcaacattcaaatgctgcaattcaggccgcaaacgcaggcgcgtgagcagggtttcccgcaaaaacctgccgctggggatgacgggcagaaaatgcggtttgtccaccacaatcaaatgctcatcaatatgcaaaatcttttcttcaaacggaatacgcggctcgctctcacggctggtttcacggtaataaaacaccaccttacccggctcgaacaaagaatgttcgtccaacgccgcaccatccgaaccgaccacaaaaccgctgttcaaccgcctgcgccaatcgtccgcgcccacaaaaggaaagcggatgcacagaaaatgcagcagcggcagcccgtaaaactgcttttcatgcggcagcaccaaataactgggtttgacaccgttcaacagcggaagaggattattgcgttttttcatgcggcggattgtaaccgtttttcacaaacttttcagacggcatatcgaaacataattgacaaaaacaaacatattgttttttatgatttaaaaatttatttagacaagattatcggatattcattattattagtaaataagaattaatatcaataggagaaatatgaagcgcatctttttgcccgccttgcccgccatcctgcctttatccacttatgccgacctgcccttgacgattgaagacataatgaccgacaagggaaaatggaaactggaaacttcccttacctacctgaacagcgaaaacaaccgcgccgaacttgccgcaccggtttacattcaaaccggcgcaacctcgtttatccccattccgaccgaaatccaagaaaacggcagcaataccgatatgctcgtcggcacgctcggtttgcgctacggactgaccgggaataccgacatttacggcagcggcagctatctgtggcacgaagaacgcaaactcgacggcaacagcaaaacccgcaacaaacggatgtccgacgtatccctcggcatcagccacactttccttaaagacgacaaaaaccccgccctaatcagctttcttgaaagcacggtttacgaaaaatcgcgcaacaaagcctcgtcgggaaaatcctggctcatcggcgccaccacctacaaagccatagatccgattgtcctttccctcaccgccgcctaccgcatcaacggcagcaaaaccctttcagacggcatccgctacaaatcgggcaactacctgctgctcaaccccaacatctcatttgctgccaacgacagaatcagcctgaccggaggcatccaatggctgggcaggcagcccgaccggacggacggcaaacgggaatcctccagaaacacatccacctacgcccatttcggcgcaggtttcggtttcaccaaaaccacggctttaaacgcatccgcacgtttcaacgtttcagggcaaagcagttccgaactgaaatttggcgtacagcatacattttaagcaggttttgattttccaaccttgtaatccaaaggagttattatgaaaaaacaaattaccgcagccgtaatgatgctgtctatgattgcccccgcaatggcaaacggattggacaatcaggcatttgaaaaatacgtattccacacgcaggcagatgcgccgatgcagttggcggagctttctcaaaaggagatgaaggagactgagggggcgtttcttcctattgtggcaggtgctttgatgggaggggcaattagtgcttgggctaatcacggcatttctaaaattaaaacagggcaatttgcttcaacaagaagtaccttggctgcaaccgctggtggtatgataggcggcggatatagcagtgcgatgttgcgcggtgcagggattactactagtgtttttgcccgttctgcttggaaagggggaaatgctattcctaatgcagttattcgtgcaaatggtgcagcattaaatcagtcttctagcgccgcaatgggaaaacatagaagataaacgaaatggatgatctaatactatattttttatcaggtatattcggaaatcaagttgctgaatatattataaaaaacaaccgtgagataaaagttccctttattgtgctttacgcaatattttttacgttgatttatactgtggctttgttgtttctcagtctaatctattgggtcaatggtgcggagattgcatggaaggggataggtattttcagtatgtcggtcagtttttgtatagtcttctgtctttatttgattgacaaggcaggaagatgtaaggataagaaacaatagggatcagatgcggcagcaaacgtagattgggtctaggctcaacctgcgtttgctgcatctttggaagaaatagtggattcgaaaaaataggaagaattctgattaatggtatgcgaggtgtagcagtggggactgttgctggtggcataaatggttatgcaggttctacgggtaagaacactgacattcgccgttaaataataaataaaccaacttccaaccaaacctgctatcggtttggttggaagtgagaggaggtaaggtagtgtttgctgttattttcttttcgacattgggctgtattttagcatggataagagatattcctaaaataaaatcaaaaaaaattttggcaagatccttatatattataggaataataaatgtaataatcagctatgtattaattaaaaatatattggtttctgtttcggatggaggtggaataaaatatgttgcaatatatttatcaaatctttttttttggacagtattgatgtatgttcttgtgaaaagattatctaaaaagccaagctgaaacccagtacacaactcatcaataaaaatcccttttgcacggaacaatgacaatattcaaattgctggatttgcaatctgatttacctattgaaattgggtgtgcaacatacgttctaagcagggctttgattttccaaccttgtaatccaaaggagttattatgaaaaaacaaatcaccgcagccgtaatgatgctgtctatgattgcccccgcaatggcaaacggcttggacaatcaggcatttgaagaccaagtgttccacacgcgggcagatgcaccgatgcagttggcggagctttctcaaaaggagatgaaggagacagagggggcgtttcttccattggctatcttgggtggtgctgccattggtatgtggacacagcatggttttagttatgcaacgacaggcagaccagcttctgttagagatgttgctattgctggcggattaggcgcaattcctggtggtgtaggcgccgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttctaactcctcctttttttctatttgaagatgtgtctttggatatatttcaaggattgtcggaattggaaaagaaaatagagccgcaggatttgatggatgatgtttaccgtgcttttgattcggttggaaatattctgaatttccgtatagtagaaaaagagcaaaaagggttttgggtaagtaccaaaatcaaaacagttgtatttgattcggcagatatgtcttctgatgatctttttctgaaatgcttacagtcttcatataaggcttattttgaaactgaacctgccggtttagataaacggcagctgatgaaaacgttaattcaaaaatgcggattcagttgttgacgaaaaaatggattctgaactaacagaaactgatttcgaccatgtatgaggtaaaaaatgtctttcggctatttgattgcaacatcgcaaccttgcgaattgttgacaaaatctcgaggtgaaactttttctttaattatggataagatggatttatggatttatttcagattttgtgaaggaaatatttatacaataaggaagaatgaaactgaatcttgtcttacagaaagaggaggcgaatggttgaaacatatttatgaatttaatcggggaagttttattttttcttatgtgcttctaaaaaagagagaaagcgaagagaattttacagaaattgttttaaaatcaataaaaaataataaaattttgacagttaaggtacggtcaggcttgcattttgacttaagaaatatttatcgtattgagatgtaataatgcaattgatatgtgccgattggacaggtataggaaattttatgaaaaccttcgaaaaaacatggtctgcacaatatcgggatatggaaatttcagtacggaatttttggaatttggagcggacaggggcggaagtctatatcaacggaaggcgggtttatcataacgaagccgaaatggcgtctgcttctttgcgttagctaatgggggaatacctggaatttgaagaaagcggtacgaaaattaccgttgaaatcggcagcgcgtggcattttaatgaaactataagaaatattaatacacatttaagaggtacgaaacttccaggttctaactggagagttcaagataaggggcattttcatctttggaaaagataatagattttaaggtaagggagactaattttaatcaggcatggcgtgttatacgcgccatgcaaatagataatatatccgatgaacaggttgtgattgtcagaatgtcttgttatcttaagaaagatgaaatttttaagaatatagaaagatatggatatcagtcatcagatattaagaaaattagtcctccttttccattaaatattttacctgttcccaaaccttattatttttatctttatgatacccatttgaatcaaatttatgatttggcttggtcatgtaatgattttttaatgtttgaaatatttattttggatagggaaagcatcaaatatatagataaagataaactttttaaatctagagaaacactatattcgaattttaaatctattaaaaatcaatgcaaaaattattttttttgcggttttgattttgatgccccttactttaaaagcggtgtgagtcaggtggcagattataattttgttcctgatgcattttctttattctttatttaatcaaattatttgaataagcgtagggtgggcacttgctgcccacgcgttctgtttcaagtttattattgggtgaatatttggaatttgaagaaaacggtacaaagattgctgcggaaatcgacagtgcatggcattttttgggcgcggcttgtcggatttcaataaatggaaagtattatgcgggtaatcggattgtttggtttgccaaaaaagccgaaagctaggaataatttgacaagggcagcctgaaagattttcaggctgccctttatgtggacaatatgatgaagttcaaatatgtttttctgttggcgtgtgttgtcgtttctttatcttatcgtttgaatgctgcaccgatgtttaacgataatcctgttgtttacggaaaaatcaaagtgcagagttggaaagcgcggcgggatttcaatattgtaaagcaggatttggatttttcctgtggggcggcttcggtggcgacgcttttgaacaatttttacgggcaaacgctgacggaagaagaagtgttgaaaaagctggataaggagcagatgcgcgcgtcgtttgaggatatgcggcgcattatgcctgatttgggttttgaggcgaagggctatgccctgtctttcgagcagctcgcgcagttgaaaatccccgtcatcgtgtatctgaaataccgcaaagacgaccatttttcggtattgcgcggtatagacggcaatacggttttgcttgccgacccgtcgctggggcatgtttcaatgagcagggcgcagtttttggatgcttggcaaacccgtgagggaaatttggcaggtaagattttggctgtcataccgaaaaaagccgagacaatttcaaataaattgtttttcacacaacacccaaaacggcagacggagtttacagtcggacaaatcaggcaagcacgtgcagagtaagtcaaatgccgtccgcaaaccacctccaacctcacaaaccctttaaaatccgctataatcgcccgcaatttgatttaagcattcttacttgaaatggcacaaaaaatccaatccgtcaaaggcatgaacgaccttctgcctgtcaagcaaaaagatttcaaactgacggctgcgttttggcaggcgtttgaagatacggtcggccgctggacacgcgcttacggttatcagcaaatccgtacgccgattgtcgagcaaaccggtttgtttgtccgctccatcggcgaggaaaccgatgtggtcggcaaggaaatgtacaccttctccgattcaaacgattctttgagtttgagcttgcgtcctgaaggtacggcttcctgcctgcgtgcggtggtcgaacacaaccttctgtacaatagcccgcaaaagctgtggtatatggggccgatgttccgccgcgagcgtccgcaaaaaggccgttatcgtcagttccatcaggtcggtatcgaggctttgggttttgaagggccggatattgatgcggaaatcatcgcgatgtctgccgacttatgggaaaaattgggtatccgcgaatacctgactttggaaatcaacagcttgggcaaccgtgaggaacgcgcggcacaccgtgcggcattggttgaatatctgacccgttatgaagataaattggatgaagacagcaaacgccgtctgaaaaccaatcctttgcgcgttttggatacgaaaaacccagatttgcaggaaatctgcaacgcggcgccgcgtttggtggattacttgggcgaggattcgcaaaaccactatgtacgcttcaaggcgatgttggatggtttgggtatccaatatattgaaaatccgcgcttggttcgcggtttggattattacaatcagacggtttttgagtggacgaccgacaaactcggcgcgcaggcgactgtgtgcggcggcggccgttacgatggcttgattgaagaactcggcggcaaacctgcgccgtctatcggctttgcaatgggtatcgagcggctgctgcttttggtgagcgaatacggctctctggaagtgaacgctgcgcctgatgtctatgcaatgcaccaaggcgaaggggcggacttgcaggtgatgaaatacgcacaagccttgcgcgcgcaaggtttcaatgtaatgcagcattccggctatcaaagcctgaaagcgcaaatgaaaaaagccgacaacagcggcgcacgctttgccctgattgtcgcgcaagacgaactggcgaacggtacggttacgctcaaagacatgaacggcgcacacggtcagcaaactgtcgccgccgaggatttaacccctactttacaacaatggaagaacgcataaatggcagcccatctcgaagaacaacaagagttagacaactttaaatatttttggaaaaccacgggcaaatggctgtttgccttgctgattttggcggcactcggctacttgggatacacggtttaccaaaaccgtaaagtttcccaaaatcaggaagcggcggcggtgctggcaaacatcgtagaaaaggcgcaaagcaaagccccgcaaagcgaaatcaatgccgaattgaccaaactccaacaaagctacccgcattccatttccgccgcccaagccacactgatggcggcggcaaccgaatttgacgcgcagcgttacgatgttgccgaaggccatttgaaatgggtgttgtccaaccaaaaagacagcctgattcaagcgttggcggcgcagcgtctgggcgttgtgttgttgcaacaaaaaaaatacgatgccgcgcttgccgcgctcgatacgccggttgaagcggacttcgcccccctgctgatggaaaccaaaggcgatgtctatgccgcacagggaaaaagccaggaagccttaaaaaactacggacaggctttagaaaaaatgcctcaagattctgtcggtcgcgaattggttcaaatgaaacttgattcgctgaaataaatgccgtctgaaatgccaccctctcttcagacggcatttcagacaacactatcctacggcaattcccgtaaaacccatccgccgtgtccaacggacacctgctcgtgttcagttctcccgaacggcacttgacacagaaagactcaatcatgaaaccaaccatcgcgcttgttggtcgccccaacgtcggcaaatctactttattcaaccgtttgacgcgcaccaaagacgcgctcgtgcatgacctgcccggtctgacgcgcgaccgccattacggacacggcaaagtcggcagcaaaccttatttggtcatcgataccggcggtttcgagccggttgtggacagcggcattttgcacgaaatggcaaaacaaaccttacaggctgtcgatgaagctgatgcagttgtgtttttggtggacggccgtaccggtttaacaccgcaagacaagattattgccgaccgtttgcgccaaagtccgcgccctgtttatttggccgtgaataaaggcgaggggggcaatagggctgtacttgccgccgagttctacgaacttgctttgggcgacccttatgttatttcaggtgcacacggcgatggtgtgtattatctgattgaagatattttggaaaaattccccgagccggaagccgaagaagccgatgcaagacatcctgtttttgccgttatcggtcgtccaaacgtcggcaaatctacgctggttaacgccattctcggcgaagagcgcgtcatcaccttcgatatggcaggtacgacgcgcgacagtatccatatcgatttcgagcgcgaaggcaaaccgtttaccatcatcgataccgcaggtgtgcgccgtcgcggcaaagtggatgaagcagtggaaaaattctccgttatcaaagcgatgcaggcggttgaagcggcaaacgtcgctgttttggtattggacgcgcagcaggacatcgccgaccaagatgcgacgattgcaggtttcgctttggaggcaggccgtgctttggtggtggcggtcaataaatgggacggcatcagcgaagaacgtcgcgagcaagtgaaacgcgatatcaaccgcaaactgtatttcctcgattttgccaagttccactttatttccgcattgaaagagcgcggtatagacggtttgtttgacagcattcaggctgcctacaacgcggcgatgattaagatgccgacgccgaaaatcacgcgcgtattacaaagcgcgatcgagcgtcagcaaccgccgcgtgccggcttggtgcgtccgaaaatgcgttatgcccaccaaggcggcatgaaccctcccgtaattgtggtacacggcaattcgctgcacgcgatttccgacagctatacgcgctatctgacccaaacgttccgcaaagccttcaatctgcaaggcacgccgctcagaattcaatacaatgtttcggaaaacccgtatgaaaatgcggaagacaaaccgaagaaaaaaccgctgcgccgcgtcagcctgagcaaccgtattgagaaacgcgaaggccgaaaggaagagaaaaaccgcttcaagaagaaaaccaaagtcagtgtgaaaaaacaattcagcaaataattcccgacatttcaaacaataggaaacattatgtggttcaagcagattagtttttatccgctcaacaaagaaaagctgcctgaggcagacgtacttgccgacaaacttgctgaagctgaatttacccattgccaaggcttagactggttcagcgaaggctttaccgcaccggtttcattctcccctgaactcgttttccctgccgactttaccttgcgcgtcgccctgaaaaaagaagaaaaagtcctgcctgccggcgtcatccgcgatattttggaagagaaggtagcggaaatccaaaacaatgaagcccgcaatgtcggccgtaaagaaaaacaagagcttaaagagcaaattacagacgacctgctgccccgagcgtttacccgcagcagccgtacagaagcggtgtttaacacccgccacggctacctgctcgtcaataacgcggcttccgccaaagcagaaaacatcctgaccaagctgcgcgaagctttgggcggtttggaagcctcgctgccgaataccaagcaatcgccctcttccttgatgaccggctggctgttgcaagggcattgcgaaggcggttttgaattagacagcgattgcgaactcaaaggtacgggcgatattgttcccgtcgtcaaagtatccaaacaagatttaaccgccgacgaagtggttcaacacgtcaaaaacggtaaaaccgttacccaactgggcttggtgtggcgcgaacaaattgcctttatcctcactcaagacttcacactcaagcgcatccaatacctcgacgtattgcaggaagaagccgaaagcaacggcgacgatgccgccggccttgccttcgcctcgcaaattctgatggcggaatccgtcagcaccatgttggaagaactggtttcctatttgggcggctggcaagattgatttttcagacggctttttcacgacaaaataccgtcaaccaaaatccaatggaataacccttatgcttaaacatctcgcattcctactgcccgccatgatgttcgccctccccacttcggccgccgtcctgacttcctatcaagaaccaggctgcacctacgacggcaatgtcggcaaagacggtaaacccgccggcaaaggcacatggcgctgccaagacgggcgcaactataccggttcgtttaaaaacggcaaattcgacgggcaaggcgtttataccgttgccgccaaccgcgaaatatttatcgaaccgttcaattccgacagtaccaaattccgcaacatggtactctcgggcacgttcaaaaaaggcttggcacacggcagatttaccgtctcgcaaaacggcgaaaccctcttcattatgaaatgcgaaaacggcatgattaaagaagtgaaactgcccaaaaacaaataagccccgttttcagacggcatcccccaatgctttgtccgaacactgcaagaaacaaggaaaacattatgagcatcaagtccgacaaatggatacgccgaatgagcgaagaattcggcatgatcgaccctttcgagccgaaccaaatcaaagaagccgacggcaaacgcatcatctcytacggtacgtccagctacggctacgacatccgctgcgcaaacgaatttaaaatcttcaccaacatcaacagcaccatcgtcgatcccaaaaacttcgacccgaaaaacttcgttaccgttgaagacgactgctgcatcatcccgcccaattccttcgcactggcgcgcacggtcgaatatttccgcatcccgcgcaacgtcctgaccgtctgcttgggcaaatccacctacgcccgctgcggcattatcgtcaacgttaccccgttcgaaccggaatgggaaggctacgttaccctcgaattttccaacaccacccccctgcccgccaaaatctacgcaggcgaaggcgtggcgcaagtcctcttcttcgagagcgacgaaatctgcgaaacctcatacaaagaccgcaacggcaaatatatggggcaaaccggcgttaccctgcccaaagcctgaaatataaatgccgtctgaacccttatcgtcgggtttcagacggcatttgccgttcacctcaaatcagaactgaaccgtcccattgacgctgatgctgatttcctccacaccaggcgcggcggaatccgcaccctccatattgacgcttgccgccatcggcatggcacgaagcatttttgcctgagcagctccccctcccgcgatatggctgccgatgtgtcccaaattcaatttgacgattttataaccggacgcacccaaaacgcccgccaacttttcggcacgcgccttgaaacgcaaaacggcatccttgctgacctgatcgatgacctcgttgcggcgttcgcgcgacacatggaaatccgtatattccaacgcggcatctgcttgaatatcggcaataaaacggtttaactcatcaaaatctctaccttcgaccttaaattccgcacgctcctcccagcctgtttgaatgcgtctgccgttggtatattgatagcgcggcatcgcactgcgcgataccaattcggttttaaagctaccatttttcgattttctgatgaacttgttgaattttttaacaaactcagcattgacggcatttttgtcccgtccttccgccgtcacttggaaacgtgcggacattgtatcctgagccacctcgacacccgccgattcggaaaattcgacaatattgtaattcaatgcttcagccgctgccggaaaagataccgccgacagcgaagccgccaaaacaagacgcaacatatccgcctccttaccgataaaactgccaatctaacacaccggcgcgccaaattgcattagcgtaaggcaacaatttaaatattcggtctgcgtctgtcttataataaccgcctttccgatacggaatcccactatgcccgaacccttgcacgtcctcgtcatcccctcatggtatccgcaatccgaacaggatgtggacgggatttttttcaaaatcaggcactggcattgcagaggaaaggcatcaaaaccgccgtgcttgcaccgatgttccgctacttgcggaaagaaacagcaagcatcctgaccgacccttacggttttgcaaaatatagtggattaaatttaaaccagtacagcgttgcctcgccttgccgtactatctgtactgtctgcggcttcgtcgccttgtcctgatttttgttaatccactatatcggcaaagcggtttggacatctatgcatggcacggcatgtatttcttcccccgctttccgttcatcgacatcgaccgcatccgctgggtgtgtgcgggtttgaaagctttcaaacactacatccgcgaaaacgggctgcccgacctgattcacgcccactgtatgaactatgccggcatacttgccttcaagatttcccaaaaatacggcatcccctatgtcgtcacggaacacagcagcaccattacgcgcggtttggtgcgcccgcaccaatggcagcctatgaaaaatgcggcggcacacgccgccgcacgtctcgccgtcagccgccatttcgcacacgtcctgcaacacaaatacggctgcgaatggcagtacctcccccaacatactgggcggaatattcaaccgaccgtttgaacaaagagaaaaaaaacaacaaaccgcatttcgtgttctgcaccgtctcgcaccttcgccgtctcaaaggacacgatgtcctactcactgcctttgcccgggcgttggcacaatgcccgcaactgcgcctgaacatcggcggcagcggacaggaagaacagcggctgaaacagcaggcggcagacttgggcattacccatgccgttacatttttgggcgcattgcagcccgaagcagtcttggatttgatgaggaacagcgacgcattcgtccttgccagccgcacagaaaccttcggcgtagtctatatcgaagcactgtcccaaggattgcccgtcattgcaacacgctgcggcggtgcggaatctattgtttcagacggcaacggatatttggttcctgttgacgacgacgatgcccttgccgacgcactcatcaaaatgtgtgaacaccactctgatttcgaacctgcccgacttagagaaaactgtctgaacgaatttggcgaaaatgccgttataggcaggttgatcggcattttccgacaggcaatcgcagaatacggtaagaaaataccggtgaaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttaaatctaatccactatagattaaaatcacacaatatccaactattcggaccttcatatgacacataccgtccacctgcatttagaagaaaccgacaacttggcgttgcagcgtctgtgcggttcttttgacaacaaccttgatttacttgccaaagcactcgatatccacatcagccgccgttttgaacatttcactttcaacggcgcatttgcacacgccggcaaacgcgcactgctcaaactcttggaaacggcgcagacgcgcgacctaaacgacggcgacatcaggcttgccgccgtcgaagcccaaaccgaagatgccggtcatcaagaaaaaaaccatgaccacgcctattatttccgcaccaagcgcggcagcatcggcggcagaacgccacggcaaaacggctatatccgcgccctgctcaaccacgacatcgtattcggtctcgggccggcaggtacgggcaaaacctatctcgccgttgccgccgccgtcgatgcgatggaaaaacaccaagtcgaacgcatcattttagtgcgcccagccgtcgaagccggcgagaaactgggcttcctgcccggagacctgacccagaaagtcgatccctaccttcgtccgctttatgatgccctctatgacctgatgggctttgaccgtgtaaccaagctgattgaaaaaggcctgattgaaatcgccccgctcgcctatatgcgcggcaggacgctcaacggcgcatacatcatcctcgacgaagcgcaaaacaccacgcccgaacaaatgaaaatgttcctgacccgcatcggcttcggcgcgaaagccgtcattaccggcgacaccagccaaatcgacctgcccaaaaacatcaaatcgggattaaaagatgcgcgtgagaaactgcacaacgtggaagggctgtatttccacacctttaccggcgaagacgttgtccggcatcctttggtgcaaaaaatcgtcgaagcctacgaatcggcagaacacgactgacattccaatgccgtctgaaacccgatgcatggaaaatcaggcagagaaaaacagatacggaagccaagctccgtatccgtatccgtttctttatccgtccaaccgatacatcaatcgaattttctgcatcggattgcctcatcttcgcaaaacattgccgaagtttcgcggttgcacgcctgacgcactttctgccgcgccacgccttcattccgatcgcttgcctcaaacgtcttctgaaaaggcgtaacgctgcatacatacatggtggaatttgaaccgaaaaggtcgattttgacggtattgccgccgctttccaatacggcgacacggtgttccaactgcgccagacgtgcttccaaatcgccgattctgtcggcaaatgcaggcatggcggcacacgcggtcaaaatgcccaaaatacattttttcatcaatttttccttgttgcttgaaccctgcccacccggacatcctttttccgagaggcagggttagactttatttacggggatgaatccccttacaaatcaggataatgcatagaacggcactttatgcttcatcccatgtgttgaaacttcattgctccatgtctgttgacccttattcccaatccgttcccacaaccttcggcttgggtttgcgcctgcgacggcggcgttttttcgcctgtccttcgtttttttcgtgtcgggcggcggcttcgtttttggtcatctccgaccgctgttccgtcgatgccgtctgaaacgccgtccaccactcggcaagggcgcggtccgcattgccggtttcggcgcgcaagagcaggaaatcataggcggcacggaaacgcgcctgtgcaaacagtttgtgcggccttgcgcctttgcggttttcaaactgcggctggaacatccaaatttcgcgcatcgtggcggaaaagcgttgcggcacgccccaaccgcgttcgacggtttcgcgcatcgtattgattgcatcggacagggcgggcgcgggtttcaaaccctgttgcagattgcttttccaatggcgttccaactcgggccacatcagagccgccaatacaaaaccgaccgaaaccgatttgtcggcacgcagccgctcatcggtatttttcagggcaagcaccgtcatttttccggcgatgccgtctgaaacgcgcaaggcattgagcagcagatggatgtcgtccggtatgtcaaatccgttcaaacgttttagacactcgcgagcgtgccctgaaaacagcaatttcataatttcgtcgaacagcctcgctaccggttcgtgcttcagacggcatatcgattcggcaatcggtgcggcggtttcttccgacagctcaaagcccaatttgcccgacaggcggatggcgcgcaaaatcctgacagggtcttcctgatagcgttcggcggcatcgccaatcataaccagcctgtgggcggcaacatcggcaatcccgttgtggaaatccaaaatctcttctttttcaggatcgtaatacaaggcattgcaggtaaaatcgcgccgcatcgcatcttcttcgatgctgccataggtattgtctttcataatcctgccgcgtgcattctgatgtactttcgcaccgccgcgaaacgtcgttacttcgatagtctctgcaccgttcatcacatggacaatctgaaaacgcctgccgatgatgcggctgcggcggaagagtttgtgcacctgttcgggcgtggcatcggttgcgacatcgaaatctttgggttcgatgccgagcagcaggtccctgaccgcgccgccgaccacataagcctgaaaccccgtccctttcaggcggcgtatgacgttttcggcggcaaagctcaacatttcggcacggatgttgtgtctttcggcaggaatgaccgttttactttccgcttttttactgctccgaccggaaggcagcatcttattcaaccattttttcagcataaatattctgacccgaagagcggcatctccacaggcaaccgtgttcagacggcatcaggcgcggtttgcaagatgccgtaaccataaacaaaaggcgtagaaactacgccgtccgaatcacgccgccctcgcggcggcaacgcgtcattataacagattgccctccaaaaaaatcagaccctgcttttgtggcagagtctgaaatttgatgcgccttctccgattgggaacattcccgtcgtacaaacaggcaaatgaaggaacagaaatcacattcaaacagtgttccgccgcctctacgcggcttcccagtaatcgatatacagctgcaattcgagattgttgcgccattcgttggcaacggggcggtaaaccgtgcggatgtattcgggaatgtcttcgctgcaacgccaaaacatcgcttcaaattcgcagccgtctttttgcagccagacttttttgtgtttgccctccgcgcccaaaggttgctggcggacgacgtggaactcgtcggtaaagctcggcggcgcgaagccctgcccccaaacgtgacgggcaaggttttgcgcctgttccaacgtgatgtcgcaggcgggcaggctgccgtcggtgatgaaggtttgcgacaaatcgtcttcgcacaccatttcgcgcacggcttcttcaaaggtcgtctgaaacgcgggaatgttgtgttcaagtatgctcaaacccgccgccatcgcgtgtccgccgaatttcaaaatcaaatcgggatggcgtttggacaccaagtccaaagcatcgcgcaggtgcaaattgggaatggaacgtcccgaaccgcgtacttcgccgttgtcggcaggcgcaaacacgatggtcggacgataaaaacggtctttgaggcggctggcgacaatgccgaccacaccttgatggaagtcgtcgcgatacgccaccaaagtcatctgacctgaaggcagggtttcggggaaatcattcagtgcgtcttgcagcatagactgctcgatttcgcggcgctcgatattgaggttgtttaactgagccgccagttcctgagcttcggaatcatctcgcgccaacaggcaggcgatgccgaccgacatatcgtccagccgtccggcggcgttgatgcgcgggcccaacgcaaaacccatatcaaacggctgcgccttgcgccaatcgcgccgcgccacttcaaacaaggcgcggataccggggcgcattttgccggagcgcatccgtttcaaaccttgcgacacgaggatgcggttgttgtggtcgagagggacgacatcggcaaccgtgccgagtgcgaccaaatccaaaagttcgcccaaattcggctctttgatgccgtctgaaaaataattgcggcggcgcaattcggcacgcaacgccatcaatacataaaaaatcacgcccacgcccgccaagcttttgcttggaaaaccgcagcctttttggttcggattgacgatgatgcagtcgggcacggtctcggccggcaagtggtggtcagtaacgatgacatccaaacccagagcctgcgccctcgccacgcctgcgatgctggcgataccgttatccaccgtaatcagcaaatccacgccctgcgcggcagcgatttcggcaagttcgggcgttaagccgtagccgtgttcaaagcggttgggcacaaggaaatccactttcgcccccatcgccgccaaaccgctcataccgacggcacacgccgtcgcaccgtcggcatcatagtcggcaacaatcaggattttttccttgcgcccaaccgcatccgccaaacggcgggcggcggcttcgcaattcgtcaacgattgataaggcaggagggaagcgagtttgtcgtccaattcggcaggactttgcacaccgcgcgaagcacaaagctgggcgattaaaggatcggcaccggcggtgagcaaatgattaaaaacgtcggtattgacggatcgggtttggattttgactgacataacgtggggttttactgtgcgtgtgtgcttaaaatgccgtctgaaagcttttcagacggcattgctgttcatttgcgggcggcatccacgaccgcacccagagccgccgcaggcaaggccagtaccgcgcccgccgcatccagtatcaaaaaggggggcgtatataagatatttgcaaacagcttggatttgtcggtatgttcttcagtaaccgtgtaataaatatcggcaggcacactttgctcaaaatggtaatcggcgttcagtttttgcggtgtggcgtagtatttgcctttggcggatacgcagcgcgtgtaaatggtccgattgtcgagtttgaccgcttcaaacccgagctgtttcagcttggcgatgtcggcaggcttgtcggtatcgtagcgcaggcaaaggccttcggtactgaaattctggctgccaggcgattcgagtttgaccggcagggcttggtggcgagcatagctcggggtatcctcaactatttggaagggtttgtccagccctgccttcaaaatgcccgtcagcttcgccgaatcttcgggattgacgacgaaccagtattttccgcccatcatcaccaggctgcccttttccaattgggcattgtcttcggcaaccacaccgaaggcgcggatttggtctttgtcaacgtgtttgcgggtgattgtttcgctgaccgggttgttcattccccacaacatcaacgtacagccgttcagcatcaaggttgccgccaaaacggcggcggtcgttttacggaacaacattttatcctccaatctaaataacggcggatgtcgtctgaaaatatgcctaaatttccgcgtccccgttttccatcacggttttcaactcttgaaacagggcgcggaaattttttggtggtttgttttgctcctgctcttttttggtattgcggatgagtgtcctcagcttgcccgcgtccgcatgcggaaaatccgacataaactgcgtcaacgcgccgtcgtctgccaacagccgtacgcgcgcctgttccacgcgttgcaaaaaggcgttgtgcgccgcatcgtcgccgcgcagcttggcaagaaacgcctcgatgggcgcgggatcggtatcgcgcatcagcctgccgataaattgtgcctggcgtttgagcgcgccgttggatgtgatttttttataggcggttaccgcctcgtacaaatccgcatccaaaccgatttttttcagcgtatcgtttgagagcttggtcaacgccatacccaaatcctgcaaatcgttcatctgctttttcatttgggttttgctgatccattcgtcttcttgttcaaacatcttgattctcgaatttttccaatagcgcattttaacagaatgccgccgcgttcagacggcattttgcaccgtccgccctgcaaacggcgcgcttttgcccctgccgcccgaaacggttaaaatgccgcaaagcatcatcaagaaagatttctatgctgttcaaccacaccgcttccgaactcctcgacctctgccgccgcacgctcgacttggcaaaagcgacgggcgcaaccgccgccgaagccgatttcagcgaatcattgggacaaagcgtcagcgtgcggctgggcgaaatcgaacaaatcgagttccagcaggacaagtcgctggacattaccgtttacgtcggcaaacgcaaaggccgcgccagtactgccgacttctccgaaaaagccctgcaagacaccgtcaaagccgccatcgacatcgcccgccacaccgccgaagacggttgcgccggacttgccgatgcctgtctgatggcaaaacacatcggcgaccccgacctttaccacgaatgggatttggatacggaagccgccgtcggcttggcaaaacaatgcgaacaagccgccctgaacgaggatgagcgcatcgaaaactccgaaggcgcggcggtgcaaaccggccattaccaatacgtttacggcaacacccacggttttgccgcacaccggcaaggcacgcaccacagcatttcctgcagcgtcgttgccgccgacgaaaacggcatgcagcgcgactactggtacgattccgcctgccgccatccggatatggacagccccgaaaccatcggtcaaaccgccgcccgccgcactttgcgccgactcggcagccgcagcatcccgacaggcagctaccccgtcctcttcgataccaccgtttcgggcggtcttatcggacacctcgtcggcgcactctccggcggcgcgctctaccgccaaagcagtttcctgatcgacagcatcggcaaaaaagtcctgcccgatttcctcaacctgcgcgaagaaccgcacatcccccgctctttccgcagcagctattttgatgcggaaggcgttgccaccgcaccgcgcttcgtgattcaaaacggcattgtcgaaggctatttcctcagcagttacagcgcgcgcaaactcggtatgcagaccacgggcaacgccggcggcgcgcacaacctgtatttgaaccatacgcacgaaacgcaatccgacctgctgaaagaaatggggacgggattgttggtaaccgaactgatgggacagggcgcgaacaccattaccggtgactactcgcgcggcgcggcgggtttttgggtggaaaacggcgtgattgcctaccccgtccacgagattaccgtagccggacgcttgcaggatatgtaccgcgacattgtcggcgtggcggatgacgctttgcggcgttcgtccaacaaaatcggctcgattctgattgcggggatgacggttgccggaagctgaacgccctgccgatgccgtctgaagacgaaggcagcacgttttgccccgtgcctacccgtttgccgttttatgccgcaccgccttttgccgacaacattgcacattttttcatcagcactgattttcccttatccgtcaaaatactaagccacttgtccacaacagggtacacacaagttcaggataaggcgtgcggggattggggtttttccgccgccggcaaaacggcagacaaaaacggcgggacattgcctgtcccgccgttttcaaatatacatttgaccgtacatcaggaattaagcagcctgaatgttggcggcctgtttgcctttagggccggtggttacgtcgaaagagacgcgttggccttctttcagggttttgaaaccttccatattgattgctgagaagtgagcgaacaaatcttcgccgccttcatcaggcgtgatgaaaccaaaacctttagcgtcgttaaaccattttacgataccggttgccattagaaacttcctatactcaaaaattaacaaaatcagcaaaacaaggcatacggcaaaccgagccgtctggcgttccttccagcttgatatactcggcggatgcccaatcctgcttaaccgtctttttacatttgttaagacaaaacgtcaagctatgttttcaaaaaagtgggaaaataggcaaaagtaccgaaaatacaacaaaaatgccgtctgaacgcggctttcaaatgggacacactatgaccgcgcaacaccaatccgacacgctcttgcaccgtctgaacaccctgccgccgaaacgttacggcgttttcctattgaacgacgattacaccacgatggaatttgtcgtcgaaatcctgaccgaaatctttatgctcggacaagaacaggcggtagcggtaatgctcttggttcatcacgaaggcaaaggcctgtgcggcacttacacgcgcgatattgcccaaaccaaacaacaacaagtcatgcagcgggcaaaagccgaagggcatccgctgcaatgtattgtcgaggagatttaatatgcttgcacccgaattggaacagattttgcagcagctttaccgcgaggcgcgtaaggctcattatgaatttatcagcctcgagcatctgcttttggtactcatcgaagaagatgcctccgtccacaacgtcctcaagctctgcggcgcggatttgaaagtggtgtccgaacagctcgccgccagcgttgccgaaaacacccccctgattcccgaacaccttttagacacggtcgaaacccggcccacgctcggcttccaacgcgtgatgcaacgggcgatggtgcatacccagtctgccggaaaagccgcagtcgaaccgttggacgttttggtcgcgctgatgagcgaaaccgacagccacaccgtctatttcctcaagctgcaatcggttacgcgttttgaagttttgcgctgtattgcccacggcwctcccgatgaagatgaagatgaagatgaagatgaagacgatggcaactattcttcagacggcatggacgacgataatggaaaccgcaccaaaccgggcaaaaaccctttatcggcgtacaccgtcaacctcaacgccgaagtcaaagccggccgtatcgaccctttgattggtcgcaaacacgaaatggaacggctggtgcaaatcctatgccgccgccgcaaaaacaatccgcttttggtcggcgaagcgggcgtgggcaaaaccgcgctggcggaaggtttggcacatcaaatcgtcaacggcggcattccagacgcgcttaaagatgccgaagtgtacgcgctggatatgggctcgctgttggcgggcacgaaataccgcggcgactttgaagcgcgggtcaaatccgtcttgaaacagctcgaaaaaatcccgcacgccattttgtttatcgacgaaatccacaccatcatcggcgcgggcagcaccagcggcggcaccatggacgcgtccaacctgctcaaacccgcgctggcaaaaggttcgctgcgctgcatcggcgcgaccacctacgacgaataccgcaccattttcgacaaagaccatgccttaagccgccgcttccaaaaaatcgacgtggtcgaacccaccgtttccgaaaccgttcaaatcctgcgcggcttgaaaccgatgtttgaagccttccaccaagtccgctacactcaaggcgcactcgaagccgccgccgaactctccgcacgctacatcaacgagcgtttcctgcccgacaaagccatcgacgtgatggacgaagcaggcgcggagcaacggattctgcccaaatccaaacagaaaaaagtcatcggcaaagcgcaaatcgaaaccgtcatcgccaaagtcgcgcggattccagaaaaaaccgtgtcgcacgacgacaaacaggtgctgcaattcctcggccgcgatttgaaaaacatggtttacggtcaggaaaacgccatcgacgcgttggttgctgccgtcaaaatgtcgcgttccggccttgccctgcccgacaaaccgataggcagtttcctcttctccggtccgactggcgtcggcaaaaccgaagtcgccaaacagcttgcctactcgatgggcgtaccgctgcaacgctttgatatgtccgaatatatggaacgccacgccgtatcgcgcctcatcggcgcaccaccgggctacgtcggctttgaacaaggcggccttttgaccgaagccatcaacaaacagccgcattgcgtattgctcttggacgaaatcgaaaaagcccaccccgacattttcaacgtcctcctgcaagtcatggacgcaggcaaactgaccgacaacaacggcaagagtgccgatttccgcaacgtcatcctaattatgaccactaacgcaggtgcggagagtctcagccgacccagcctcggctttaccgccaaacgcgagcgcggcgacgaaatgcaggctatcaacaagctcttcacgcccgagttccgcaaccgcttggatgcgattatcccgtttgcgcccttatccgaacccgtcatcaccaaagtcgtggacaaattcctgctccagctcgaacaccggctcctcgacaaaaaagtcgaagccgaattcacgtcggcattgcacaaatatctggcggaaaaaggttttgacccgcaaatgggcgcgcgcccgatgcaccgcctgattcaggaaaaaatccgcaaaccgctcgccgacgaactcctgttcggcaaactatccgacggcggcttcgtacggatagactgggatgcggcaaaagaagaagccgtgttgaagtttaagaaaagcaaggtcaaaataaaaaccgcctccgcataaaatcaaaaatgccgtctgaaatttcagacggcattttgtcaaatatcggtccctattccggcaaacttctccacaaacgccgcaatcttttgaaaaacactttgtttcttcgtcagatattgcgggttgagcggactcattttcggcagggtttcggtcagttccgtgccgttttcgctggcatagccgcgtttgagcgagctgattaaatagcgtttggcggcggtttcgttcaggccttcggcggcaatcaatcctgccgcttcgtgccgcatcacctcttgcgcgtaggtgtagaaggtttccagtatggcgggaacgtcgggtactttgtccaaatccgtatcgttgatgaaatccacaatcagaccctctttggcgcggtggccgatgctggcgcggatgatgcggcggatttcttccaccagctccgctttgcctttgatttttttgtggtgttcgaaaaccagttgcaggatgtaatccagattgatttcctgtgatttgagcaaatccacctcaaaaaccacatcgtcccagtcgatttttgattgctctttctgttcgcctgctttttggcggcgcagccagtcgcggatgtcattgtaggcggaacggtagtcctgcaccgccctttcagacggcatcggcacttgccgcatttcctgcacgtcttcatcgctcaggtagtatttttcttgaaacgccttcatcgcatcttcgtccgccgcgtccacactctgcaactcgcgcagcgcggcaaattcatcgtagttctgcaatacgttttccgcccgcaggtattcgccgaagagtttggcaaaatcttttttgtctttttccgtttcgattttgtcgggatcggggaaacgctcgcgcaattcttttgccacatccagataaccgcgccgtgcttcgccggtctggctgtcggtatagccgttcatgtattcttcgtaacttttttccagcaccacgtttttggtgtttttgtcgccaaacaaggtaatcgcatcaatggttgcctgctccaaatcgcggaagcagacaatattgccgaaggttttggtggcatcgtaaatgcggttggtgcgcgaaaacgcctgcatcaggccgtgatagcgcaggtttttatcgacgaacaacgtgttcagcgtcggcgcgtcaaaacccgtcaaaaacatgccgaccacaatcagcaaatctatttcctgatttttcacccgttttgccaaatctcggtagtagttttgaaaggctttgctgtccgtgccgaaattggttttgaaacaggcgttgtaatcgttgatggcagcctgcaaaaattcttttgcgctgctgtccatcgcttccggttcaaaagtctcatcgacaatttcaccgacggcgttttgctcttcgttggccgcaaaggaaaaaatggtggccactttcagcgggtgcaagctgcctgcctgttgtgttttgaacgcttcgtaatagcacttcgccgcatccacgctgctgacggcaaacatcgcgttaaagcctttgccacccgcattcagccggtgcgttttctgcctgaactgattcaggatatattgcgtgatttcgcggatgcgttcagggtgcagcagggctttgtggttttcggcggcactcagtttcttctcgtcctgttccgcttccacggctttgaactgcgggcgcacgtcgttgtaatccactttgaatttcaatactttttcatcgcggatggcatcggtaatcacataagaatgcagctcccgcccgaacacgcccgccgtggtttccgcgcccaaagcgttttcgggaaaaatcggcgtgccggtaaagccgaactggcagaattttttaaatttctttttcaggtttttttgcgcttcgccgaattgcgagcggtggcattcgtcgaaaataaagacaactcgctgatggtaaaccggcagattatcttcgcccttcatcaggttgttcagcttttggatggtggtaacgatgattttgttgtcgtctttttccaaattgcgtttcaagcctgccgtgctttccgaaccgttcacgctgtcgggcgaaaaacgttggtattccttcatcgtctgatagtccaaatccttcctgtccaccacgaagaaaaccttgtcgataaatgccgattccgtcgccagacgcgccgccttaaagctggtcagcgttttgccgctgcccgtggtgtgccagacatagccgccgctttccggtttgctccaattcttcgcctgcgccgagctgttgattttccacaaaatgcgttcggcggcggcaatctgatacggccgcataatcagcagcgtatcattcgcatcgaacacgctgtaatgcagcaaaacgcccagcaatacgcttttctgcaggaacgtggcggtaaagtctttcaaatccttaatcggatgattgtccgaccgcgcccaattcatcgtgaaatcgaagctgtttttgtcgcgcttggtggtgttggcgaaatagcgcgtgtccgtgccgttggaaatcacgaagatttgcaggaatttgaacagcgaattttcgctgttgaagctctctttgctgtaacggtgcacctgattgaatgcctcgcgcaccgccacaccgcgctttttcaattcaatctgcaccagcggcaggccgtttaccaacacggtaacgtcatagcggtttgcatgcgtgcccgtctgctcaaactggttgataacctgcacatggttgcgggcaaggtttttcttgtccagcagataaatgtttttcagacgacggcggattcgcatttgaagtgcaactttccctaacagaaaaaggccagtatgcggtagcatacgacctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggaccgtcatcaaaagcgaaatcgtaaatatggtcgtcgtggattttgcgggttttatcggtaatgttttcagacggcctgtccagatattccgtcaaaaaccgcgcccattcgccgtctgaaaacgccacatcgttcagccgctgcaactgcgcgcgcaggttttccagcagcctgctttggctgttcaaatccttgcggtattcgtaaccctgattctgcaaatcggcgattaactccgcttccaaccggttttccgattggtagctgcccgactgttcgattttttcatattggtcgagcacgatgaaattcggcgtttcagcgatgggtttggtttcgaggttcatggcttatctctttgttcatcatcttgaaaaaaattatagttatccagcaagtgttgcaaaagcaatttgacagtttcttgttcttgtggtgttggctcggcaaatgcctcattagataatgtagaatgacttgtaaagttaataatacgttgaaaatagtttcgtctgctgtcttcgggcaaaatatcagacctttgcttatagcctaaaaaattagctgttttttcatacaggtttctcagcaacataaaatgaaaccgttctacctgctgattctcgatagctttttcaataactccttttaagtgaaggtgatatgaaaaacttttattggaatcaccttgtttttcaagaatatcaaaactaccatcttcattttttaacagaagataacttttcttttccttttctaatttttttagttcattgtatagaacgttgtaaaataaaacattatgtgtagtaatgataaactttaacctcggtttgctaagctttatcaaatcagccaaatcaaccgcttgctgaatcagatgattttcatccaaagagctgacagggtcatcaataaaaatatattccaaatcgtcaaactgatctgtggaacgtccttcttcgctatcttctggaatattcaattcagcgatgacttgtctgattaatacatagaaaatgctccaaataaaattactttcttcacctttggaaattttgatattttcaatctgctcatcattaccacgagcaaaataaaatgcaatttctgaaaaatcatcattaaaatcaggagtcaacttatcatctgtataatattgaaagtttttaataacagctccatccagtccattatccctaagcaaccagtcggtaaaactattcttttgaatttttaatcttggagcttcgttcgctaacaaatcattgtcccaaaagaataaatcctcagtaaatgcattatagtagagaaattttcttcttgttggctctccgtctggctcttctgaactggttggagcaattaaattcttaaactctctggacaaacgtgttttccctgttccgttaaaagcatagattagctggacttttttatcgtttccttttagttcctcagcaatttcggttaaactttttcccatgatatttccttatcaatatttttcagacggcatgatttaaagaccagctatgacttttcaggcagcctttgggaagctcaacaactgcccgcggtaatattcgtattgtttccggcgcagggcaatttcgtacggtaggccctcgctgatggagtgggtcagggtgtcgaatttgtcgaggatggcgacgattttttcctgttcggggagtggagggatggggattgaaatatcttttatcattggtttcgttagctgtggaataccgctttcaggaactttataatttgattcaatacttttcataaagtagtaggcatattttaggtttaattcaatttttggtgttaacactaacaggcgtactattgggaaaaaaggtttattctgaaagctagcccaacctatagttcctctagctgatatagttaagctaggttgattgattttagcaacattagtccagccatatagtgccttacttcctataccattagataaaatggggatacaaaattcttccgtttccacttcagagaaagcgtcttttggtacgtcgcctccagcaaaaatattaaatacctcccccaacgtcttccaaaccacatctttcagacggcctttatagccatcagctatcccccccgatttgattgttaaaatctaaaagaaagtcgcggtaataccggtattggcgtttgcgcagggttaattccgcttccagcgtagcttccagcgtagcttacagctctgtgaatttgtcaagtatttttacaattttttgttgggtttccaggggtgggatggggatcgaaatattttcaactactaatctatcaatagtaggaactccaccaactctcttttgggattttatatatccttctcttgtttttaaaaagtagaatataaacttatcatcaagatagtttggtgtttgaatcacaaaagtaccatcagatgaccagaaatctacgccactccatataacttcaccaatacttcccgtattaataatcatcgtttgattagctctacgattaaactggtcaaaccaaccaagaggaatcaatccgccatgaaaaaccggatatttcccaccttcaattagctctttctttgtcaaacgttttcctcttaatactttcgccacttcccccaacggcttccactccaccggtgccgtctgaatcatctcaatcaattttttcgctttgttttgcatatccatggttgttttccgtttctttcccgttgcggcgggatgtggggcagttgcggggtgcttcggctcactctgtccgtttgccgttatttctgcgggctgaagtccgtcctgctttcaggctgcctgcaatggtgtgcaggctgctttttcaggtagcctgaatggtagttattttgtgcggtcttttttctgtttgatctgttgcacggctgttttttccaacgctttaacgctttccagataggcttgctccaccggcgacaggatgcgcgcttcataggcgcggtattcgcgttcggctttctgctctgcctgtttgcggctgatgctgcctgcaccctgtaatgtgccttgtccgtacagcccggaaaatttgtccaattcggctatccagtcgcgcatatacatggggctttgctcctgcgctttgatttccgctaggtcgaagaaggcggaaaccagacggttcaggcggaacagttcgtcttcggtcagatagtttttggcgattttggcttcattcagcgtggggattgcgccttgaaaggtggtcagccccataaagtctttgctgctgtcggcacggctgtatatcagctcagctgcggtttgccggctggcggcatagtgcagtttgttttgaacggcggcaaaaaaggtttggctttcgctgcttttggggttgtagtcttggctggtggcatataaatcaagcacttgccggtatagggctttttcgctgctgcggatgtcgcgaatgcggttgagcagttctttccaatagtcgccgccgcctgtgcctttcaggcgttcgtcgtctatggcaaagcctttggtcagatattcgtccagccgttcggttgcccattggcggaattggatgccccgcgcggaacggacgcggtagccgacggcaataatcatgggcagggaataatgggcgattttgcggtttaccttgcgcccgttttcattttgaactgtcaactggaagttgacagttgccttctcttccaattcttgctctgcaagaatggttttaatgtgtttgctgatattttgtttggtggtttggtacagttctgccatgtccgcctgcgtcagccaaagctgtccgccaaattcctgcaaggcaaattgggcagtgccgtcgttggcggtgtataggatgatgctcatgcttcaatctctgcaatcacttcgtcaatttcacgccgcagccgttcgattttggcgacggtttcgccgatttcggcgttgagctgtttgatgtcgataatttcgcgtgtgtcttcggcttcgacatagctgctgacggcgaggttgtagccgttgtctttgacggtttgctgggcagcgttttgggcgatatgcggcacatcggctttatcggcgaagagtttgacgatttcagcaatgtgttcttcgattaagacgttgttgttggtttcttttttaaagaagccgcttgcgtcgatgaattggatgtcggtattgtctttgtgtttggacaaaaccaggatattgacggcgatgccggtgccgtaaaagagattgggcgcaagggcaatcacggtttccacgtagttgccctccaccagatattggcggattttctgttctgcgccgccgcgatagaaaatgccggggaatgagacgatggcggcgcggcctctgccggaaaggtagttcagtgcgtgcaggatgaaggcaaaatcggctttggatttcggggcaagtacgcctgcgggggcaaagcggtcgtcgttgattaaggtggggtcgtcgctgcctatccagttgatggaataaggcggattggaaacgatggcatcaaagggtttgctgtctttgagctttgggttggtcagtgtgtcgcccaattcgatgtggaattggttgtaattgacgttgtgcaggaacatgttcatgcgggcgaggttgtaggtggtgtggttgatttcctgcccgaagaagccttcttcgatgatgtgctcgtcaaactgttttttcgcctgcaagagcagactgcccgagccgcaagctgggtcgtagattttgttgactttctcctgtccgtgcaccgccagccgcgcaatcagcttggatacgctttgcggggtgaaaaattcgccgccggatttgcctgcgttggcagcgtagttggaaatcaggtattcgtaggcatcgccgaaaaggtcgatgtggtggttttcaaaattgccgaaatcgagttccgccacgcctttgaggacggcggcaaggcgtttgttcttgtcggcaacagtgctgccgagccggctgctggtggtgtcgaagtcgtcaaacaggcctttgatgtcctgttcggacggatagccggaggcggagctttcaatcgcggtaaaaatttctttcagcttggtgttgagctcttcgttttgatgggcttcggcggcaatattgcaaaaaagctggccggggtagatgaaatagcctttaactttgacggcatcgtctttgatttcgggcgtgatgatgctgtccggcatagcggcgtaatcaatactgctgtcgcctgcctgcatatagtcggtgaagttttcgctgataaagcggtagaaaagtgtgccgagaacgtattgtttaaagtcccagccatccaccgcgccgcgtacttcgtcggcaattttccaaatttggcggtgcagttgggcgcgttgttgcatttcggtcatcatcgaaatccatataaaagttaaacaaatcaaaatcgcctgatattttcagacgatttttttacgggcattcaaattaagccaaattttccagcatccatttgacgtagcggtcgacgcctgatttgacatcgaaaaattcttccttatatccggcttcgcgcaatttggtgatgtcggcttgggtgaagctttggtatttgcctttgagcgcgtcggggaagggaatgtagcggataagttcttcttctaccaactctttcaagctcatttcaggtttgccttcggcggcgcggcatgcgttgacggtggcggcggcgagttcgttgaactgttggctgcggccggtaccgaggttgtagatgccggaaagttcgggatggtcgaagaagtagaggttgactttggcaacgtcttcgacgctgacgaagtcgcgggtttgttcgccgttgccgtagccgtcgttactgccgaacaggttgacgtaaccgtgttcgcggtattggtggaagtggtggaaggcgacggatgccatgcggcctttgtgttgttcgtgttgtccgtaaacattgaagtagcggaagccgacgacttgggcggtgagaccttctttcatgcggcgacgcaatacttggtcgaacaggaatttggagtagccgtacacgttgagcggtttttcgagttcgcgctcttcgcggaagatttctcctttgccgtaaaccgccgcactggaggcataaaggaaggggatgcgttcgtcctgacaccagtccagcaaatccagcgtgtactggtagttgttgtccatcatatacaaaccgtcgtggttcatcgtatcggaacacgcgccttgatggaaaacggcttcgatgttttgataaggtaaaatgtgttccctcacttggcggatgaattcgtgtttgtcgagataatgggcgatttcgcactcggcaaggtttttgaatttttcgcctttgctcaaattatcgacggcaacaatgtcagtaataccgcgttgattaagtgctttgacgatgttgctgccgataaagccggccgcgcctgttacgatgatggtcatattcggtttcctttgttttgagtaaaattaataaacttagttacaagaaatcatcgatattgtcctgaaacacaaatttgcgatgatattccaaatatttttctcttccttcgggatatattctcatcttaattttttgcatttggattgatattaagtttttcccatgtgtaacggcttagtcgagtaccgcaaatcaaacgaccatcatccaagaaagtaatataaccttgatcgaacaaccaatcataagtcggcgttaaagctaacccatttaaataatctaatgcctctttctcatttttctcagtaatacaaaccatataaggtttaatatgactagcccttaacaaaatctcatctgtaattaatgtaaatggacattgcgacatatgatttataacatccttgcgatatttctgctgcccttttctacttttctgtttaatgatttcttgctctacgaattgattaaattctgaagccggtatttctaatttttctcttgataagagttgcgggtgcacgatagagcgaaattgataatccaaaaatattcggaaataaaataatggttctgaatcttctatatctttgacaggcaatagtttaagaattgataaataactaattttgggcaatacaatcttacgccaaattgaccatatatcatcctccgaacggatataacccctacggtaacctttagaattttccaaatggtctgatacatcatggattgaaaagaaaatattttctgtaggcagattattaatacttaaaacgtaatcatcataaaaccttgaaatatcatgatgatatttctgttcttgtttgtgatattcaacttttgcatcaaccaaataacgctgtaaatttttcttataaaaaaaacaatttttctgaatgaaaggatattctaccctccttccattttttgtctcagtaatcccccaattttcatactcaaaaaatgtacttagttttcgaccactatcatcaatataactacctacatatttgcgtgcttccccattaccaccaaaaacagataacttgttattcctgtgaataaaactatcttccgcacgtaaattttgaatactatcgacaataaaatactctatgttttcaatagtaattctttgaaaatccggcattttactctccataaagcgtaatatccatttgttttaatatagcgattaatacatcaacaacaatactgtttcccgcttggcgatacatttgagtatcactaactaaaattttaaaatcatctctaaaacccattagccgcaaacattccctaggtgttaatttacgaatacgtccacgattatgagtaacataattatcaaccccggcacgatgcattttatgcatagtttgcaataatgggcgagctacaggcaaatcagtttccgtactggttttaaaattttttgttcctcctgccaaaacataatttttgattttttcagaaagataatatttttcctcaacgttatttacatcaaaaataaagtcatcaaattcagattcgcgggctgcctgaaaaataaaatcaccatgccaattaaattgttgatttgctttttggcataaggcaatttctccattaatctgtgtataacgtttttgtctatttttagaactggtaacaaatttcgcacccttttcacgtaaaaaatatttgctatcagtatagtcctccaaaaaatcttgcatagtatgttctaattcaatcttttcaggaaactgaaaaccatttataggaggggtatgaaagccaacaacaaaaatacgctcacgatgttgaggaatcccataatccttactattcattatttggaaatataagtcataaccaagtgaataaaaaacactttttacaactttccaagtttttccattatcatgattaagcaagccctttacattttcataaataaatatctttggttggacttcatccacaacgcgagcaaattcatagaataatgttcctcgtgtatcttctaatcctgcacgtttgccaaccatggaaaatgcttggcaaggactgcctccaactaaaatatcaacttgatttctaaactttctcgcatcaaattgagtaatgtcgttatgccaaaaatcttcatttaatttatagtttccaagataactttttttaacgtatggatcaatatctcctgaaaaaacaatggtatggtttaaatttaatcggtggaatgcctgttcaaccgcaccaatcccgctgaatacggttgctaatctaatatgtgaatcaggtttaagaaaagttttagatttccaaccttgttgactgggaaagagcaaagttttttgtaatcgagtatcgtgtgtctgtgccattgtcgaaatagtcatacttatatcgttctgtttatcttatcaatatgaaaactacattgttgattgccctgacaatgccttgatcaattcggcaaacgagcaaaccgccgtaccgagtttcgccacgacaaccccggccgcagtattggcaaggtacatggcttcgggcatggtgcagcctgccgccaaacccaagcccattccggcaatgacggtgtcgcccgcaccggatacgtcgtaaacttcttgggcgcgggtgggctggtaaatcggttcgccttcgctgaacaaggtcatgccttcttcgcttcgggtcagtaaaacggcggtcaggtcgaggtggcggcgcaggttttgcgctttttcggtcagctcgctttcgtttttccaactgccgaccacttctttcaattcggcgcggttaggcgtaatcagagttgcaccgacatatttttcgtaatcgtcgcctttggggtcgattaagacggttttgccggcgtgtttcgcccaatcgatcatatcggagatatgcgacaggccgcctttgccgtagtctgaaaaaatgattgcgtcgtattcgggcaagatttcgcggtatttctgcttgatttgttccaacacttcgcagttgggatgttcttcaaaatcaagacggataagctgctggttgcgggcgacgacgcgcagtttgacggtggtggcgatttgtttgtcgcgcatcagataggaggcgacgccgtcctgcaccatcagcgcatcgagcgcgtcggcggcttcgtcgttgccggttacggacaacagccctgccctgccgcccaacgaagcgatgttgcgcgcgacatttgccgctccgcccgcgcgttggtcgattcgtccgattttcgccaccggcacgggggcttcgggcgaaatacgggacacatcgccgaaccaatagcggtcgagcatcacgtcgccgacaaccaggactttggcttgcgcgaaacgggatttgagggtttcttgttggaacttggcggacatattgcctccgttgtattttttcagacggcctcagcctgtaaggccgtctgaaaatcagtttgcttcaaggtttgccacgcggttcacttcgcgcaatacggctaccggatcggcagcttgggttacaggacgacccattaccaaataagtcgaaccggcagccaaggcttcggccggtgtcatgatgcggcgctggtcatcattattgccggcaacgtccaagcggatgccgggcgtgaccaagacaaaatcctgtcccaattcgcggcgcagcggcgcggcttcttgggcggaacagaccacgccgtccaagcccgaactttgcgccagttttgccaagcggatgacttgttcttcaggggcggtgttcaaaccgatttccgccaaatcactttgttccatgctggtcaacacggttacgccgattaagagcggcttcgtgccgtatccggcaacggcttctgctgcggcttccatcatacggcggccgcccgatgcgtgcatatcgaccatccaaacgcccatatcggcagcgactttgcaggcttgcgcgacggtgtggggaatatcgtggtatttcaaatcgaggaaaagtttgaaaccttgattgattaagctttctgccaaattgcgtcccgtcgcggtaaacagctctttgccgattttgatttgacacaatgtcgggtcaaggttgcggacgaatccgagcgtgtctttttcgttggaaaaatcaagggcgacgataacgggggtgcgttgttgcggagtttggaagtcggagattaaaggattcatggtgttttcgtttcgggttttcagacgacctttatcgtctttttcgcagtatagtggattaactttaaaccggtacggcgttgtctcgccttagttcaaagagaacgcttctctaaggtgctgaagcacaaagtgaatcggttccgtactatctgtactgcctgcggcttcgtcgccttgtcctgatttttgttaatccactataacaacgtaaattcaaaccgtaggtcgggcattgatgtccgacctacgcggactcaagcctccgacaaactgtttcggataaatttgaaccggtacatcagccgtcattcccgcgcaggcgggaatccattgataaaactcagttcatcagatttaaacagcgattgcccaaattcagaaatggattcccgcctgcgcgggaatgacgccaaatgattatttttcggttgcaacacgctgtttatcaaaaacaggtcgtctgaaaacctgattttctgttttcagagtgcgaagcctgcccgtgggtacgaccttttcgatttatttgcccaatgcgcccaatacttcggctttcacggcttctactgcttgggtgccgtcaactttgatgtatttaggcgcgtgttcgccttccagtttgctgtaaaaatcgaccaaaacttcggtttgctcgtggtaaacggcaaggcgttttttcacggtttcttctttgtcgtcgtcgcgctgaatcaaatcttcgccggttacgtcgtctttgccttcaactttgggcgggttgtaggtaacgtggtaagtacggccggaagccaaatgcacgcggcggccgctcatgcggtcgacaatcacgctgtcaggcacatcgatttcaacgactgcatccaaatccacgcctgcttcaaccatcgcttcggcttgtgccaatgtgcgcgggaaaccgtcaaacaagaaaccgtttttgcagtcgtcttgcgcgatgcgttctttgaccatgccgataatgatgtcgtcgcgcaccaagccgccttcgtcaatgatttttttcgcttccaaacccaagggcgtgcctgccttaatcgcggcacggagcatgtcgccggtagagatttgcggaatgccgaacgctgcggtgatgaattgcgcctgagtgcctttgcccgcgcccggcgcgcctaaaagtaatgctttcatgaagtgatcctttgaaatgtgtttattggaatcaaacagatggtttacgattctacacggcttggcacaatagttcaaaaaccaactgcacaaactgccatttgcaagcaaatgttttgcatacctttgccgagtctgatattcacaagccggcaactttttgggacaatcccccaaaatttcaaaacatcacaccctaccaaaaaggaacatccgtgaaacgaatttttctgtttttggctaccaatatcgctgttttggtcgtaatcaacattgttttggcggttttgggcatcaacagccggggcggcacgggcagcctgttggcgtattccgccgtcgtcggcttcactggttcgattatttcgctgctgatgtccaaatttatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgatgcgggcgcggcaaaactggtcggcgcgccgaaaatgatttccgccctgcaaaggctcaaaggcaacccggtcgatttgcccgaagaaatgaacgcaatgggcatcgccggagatacgcgcgactccctgctcagcacccacccttcgctggacaaccgtatcgcccgcctcaaatcgctttaaaccgatttgaaacggcaaaaaccgtacgcgcaagcagtacggttttttgtatatgctgtctgaaaacatcaggtttccataccgacaccaaccgtatccatttccgcaccggatacgccgcattgatataccctgataaaccgtatccggacagaaaatatagtggattaacaaaaaccagtacggcgttgcctcgccttagctcaaagaaaacgattctctaaggtgctgaagcaccaagtgaatcggttccgtactatttatactgtctgcggcttcgtcgccttgtcctgatttttgttaatcccctatatcagataaaacagcggtaaaattgccgtctgaaaccaactctgcgccatacgggacacgctctgcacgtctatttgcctccgatatatcctccctactgtaggaacgtctgccgatttgcacgaaatcggcacctctagcacccttcaggatggcggacgttatccgttcttgggattctgcaagacggtcgacggcattatacagacgctcggtctgatacccttccgaagcaacctgcttcaggtattccaaataaccgtaacccaacgcccctccgacaagcagggtcgtcaacgctaccagcgttgccgaacggattttagggggcatatcttgaagcatatctctaccgaaccgaaccaaagtctctttaaagtcggactctacacgcgtagaaccctcggaaatcttgaagttcaactcatactgcttccgtttgtccgctgtcaaccgcttgaggttgtcatccccgtattggacggttgacacaaccctgtacagactgtcctgtatttcgaccagcgtctgtgcaaagttggcggtcataactggattcccaacccttgccgccgattctgatactcaaaacggtatccaggcgttccagcagggcttcgggagacagcagtgcgtattcttcaatattttccataggttgattatagcagaaccttatacctgttacagacaaggttgtcgggatttgaacgtccgtcgagcttggttcgtatagagccgtagggggtgtttagggctttggcggcagcttgtacgctggggaacgtgagtgtttcgcctgtggcggtgtcgaggatggagacaggtttttggttttggggaggcgtattttccttcattttaagtttcccgcactccggacacccatactttgactttatagctgtgtcgtaatacaaaagttggacaaccccgtgcgtaggacatctaacactggaaggtttataaatgccactgaactccaacaattctaaatgtggaaatttctcttgaaagcgtgatttggcggtatcgaaagtcattcgcttacccataatttgtctccataggttatgtgcaaatggattacacaaccaaaatatagaaattttcaaattttttgagacctacctgaaatcctgcgcaagcacaatgtaaagaaaaatggtatacgtctttactaaatctttacataaattaactctaaccgggatttgaacgtccgtcgagcttggttcgtaggatttagggtgttgtgaaccttacctatcgtacccaagcactttgtacctgtttgaaataaggttgtcgggcgacgttcgacccttgagcctgtgattgatttgttggaaatgtacacctaaagcagcacctgcggcagtaacgcttgggaacgtgagtgtttcgttggtcgttgtgtcgaggatgaggaggggcttccctacatttggaggtgtttgggtttttgacatcttagcacactcaggacacccgtactttgactttataagggcattaaatgtcgaataacgaacgttcccgtgcataggacaattaacggttactgggtaattcacaccgtcaaagccggttagagagatattagggaatatatcagtaagttcagaagctgcttggttgaaagatttggccatttgagactccaaaattgattgtcaaatggatttaatagcaaatttataaaaatgtcaaatttttcgagaagcacctgatagtggcgaggggtatacactgttaaaaagtgtatacgtcatttagtgcagatgtgaaccttatacctccctgcaagtaaagtctctgtgtgaacccgaccttttatacggtcagtgatagctgctgggtttatacccaatgaccttgcagcagatgctcttgaggggaatgtaagtgtttcgccagttacagtatcctccaatactgtatttttagataatttatctattgtatcttctggaattttgtgggaattgacaccataagatgcacattttggacacccacttttagagtccaacatacttttgaatgtagagcaagtaaccctcccgtgtataggacagacgattaccgtcgggtaacgaacgccattgaactccacaagattcaaatgtggaaatttagaggttagcttagaaactgcttgagtaaatgtaagtgccatagtggttgtgaacttactttaccaacctataacgatacctaatcaatcggtcaaacggagtgcgtccgcttaaacgtacagctaaagtgctgttggagcaaccgataaatttactggcagccagtgtacttgcaaactcgtagatttcccctgtctctgtgtcctccaacctaatggcaacggcgtttggagagggcttttcgggatttcgagtacattcaggacatcctgttgaggatttcatggcagcttgtagattcccgtaaacaaccgacccatgcaaagggcattggattgttaccggttcgtagtttttagtgaacttcaaaaccgtcttatcaggaaatttactggaaaaccttaactgaacatcttgtagcgagagtgattttggcattatagacctttctaaaatgaaagcattatacaaccaaaatatagaaattttcaaattttctctgaacgcactggtatccgatggagctaaatgtaaagaaaagggtatatgtccttactaaatatttacacattttaactgtatagtgtttgacaaaaaacaggcataggcgcataatgcacccgtagttagatagatagtaaggagataaccaatgacttagcacctgcccccctctctctcgcgcaccccgcccctcgcttgcggctaatgggctttgcgcgacatatacactttcatctcctgcatggcttaaccgcctatgcaatagtacacacatcaacaaatcaggctggcacgtcttggcattggctgacgtaccattgtagcccgaaatgttgataccctactatttatgaccaacggcggattagggcttcagacggcaattttactgcaaaaccttatgcgaacggatgatgcagcacaatcgtttcttctcggtcggggccggtggagacgatggcgaccggcgcgccgcagacttcttcaatccgtttcaaatatgctttggcgttttcgggcaatgcgccgtagtccttcacgccgaaagtggattcgcgccagccgggcatggtttcgtaaatcggcttgcaggtttccaccgcatcggaaccgcaaggcaggatgtcggttttgccgccgtcgggcaattcatagccgacgcagatattgatggtttcaacgccgtccattacatcgagtttagtaatacacataccggaaatgccgttgatttggatggagcgtttcagggcggcggcatcaaaccagccgcagcggcgtgcgcgtccggttaccgaaccgaattcgtgtccgcgttctgccaaacctacgcctacttcgtcgaacaattcggtcgggaacgggcccgaaccgacgcgcgtggtataggctttgacgatgcccaaaacataatccagcatttgaggacctacgcccgcgcctgccgaagctgcgcccgccagacagttggacgaggtaacgaagggataagtgccgtagtcgatgtccaacaacgcaccttgcgcgccttcaaacagcagtttttcgccgtttttgtttttctcgttcaacacgcgggacacgtcggtaatcatcggcgcaatgcgcggcgcgactttttcgataaccgccatcacgtcttccgctttaaccggctcggcattgtgcagatgttgcagttggacattgtaataggcaaggacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccaaactttcatgcaggatgccgctcggaatcaggcgcaaaatggtttttttgccgccgacaaccaaggtatggcccgcattgtggccgccttggaagcgcaccacgccgccggcttcttccgccagccagtcaacgattttacctttaccctcgtcgccccactgtgcgccgattactacaacatttttagccatagccatataacctatcgatattaaaaattattgcggaaatccccaaaccggtgcggctttgcgccccgccacgatttgcctttcatccgccatgaacgggtatttagcgtttcacgacctgccaaacgccgtccgtctttttcagacggcctgcaagctcttccgaaacattgtgtccgataccgtaatcgattacgacacactgcccttgttcacgcaaggcttcgaccgcttcgtgcgccgcttcggcatcttccgcatcgaccaacacggcgggctgccgttcgatggcgggcaaacgcccgataaagctgcgcaagtcgaaactgaatcccgttgccgggcgcgccctaccgaaatatccgcccaatccgtcataacgcccgccgcgcgcgaccgcgtcgtggaaatcggcggcataggcggcatacagcaagcccgtgtggtaattgtcgacacgcagctcggacaagtcgatatggatttcacaatcggggaatgcgtcgcacaccgcctgcaattcgcccaacgcgccgccgaccgccgacaaatccggcaaccgtccgcgcgcgtcggacaacacttcacgcccgccgtacaggcgcggcaacagcgagaatgcttttgcccacatgccgtccagcttccaagccttgacctgcgcttcgaccgccccggtatctttatcctgcatcaaggcaagcagcgttgcggactgccccgcatccaaatgtgccgcatcggacaaggcgcgaaatatgccgatatgccccagcgaaagcagcactttgcccatatcggcaattttcatgcttttcagcatcaggtctatcagctcgatgtcgccacggatgtcagcaaaaccgtacatttctgcccctgcctgcaagggttcgcgcatattcagcagaccgtcgggctgcgcgtgcaacaccggaccggcataacacaaccggttaatcccttggttggcggataaaagatgggcatcgatacgcgccacctgcggcgtgatgtcggcgcgtatgcccaactgcctgccgctgagcctgtccgttaccaaaatggttttcagggaaagccccgcatcgatatgcgtcagcagggaatgtgcgtactccatcagcggaggctgtaccagttcataaccgtgtacgcggaacagtgccaacaactgctccctcgcgctttcaagctgccgcgcgttcgtgggcagtacgtcggcgatatgttccggaagctgccatgtctgcatgagaatctgccttctattttatcctgtaaacacaaaagactgcccgatccgcaatcagacggcatctttgccgcaacgcatcacgccgctgtcaaaacggcggtgcttctttccgattcagaatccgaacagcccctgtccgacggctcaatgccgtcaagtcgttaaaaccaaactttaccataaaatacacacaatctgaatatacttttataccctgtatccgccgtctgacggcacggcatttttttacgatataatgtgcaccattatttctcatcacttcctgctgccgttttctgcttcagacggcatttttgttgattgaacacttatgctgctcgacctcaaccgcttttcctttcccgtcttcctgaaagaagtccgcctgctgaccactcttgccctgcccatgctgttggcgcaggtcgcgcaggtgggcatcggttttgtcgatactgtgatggcgggcggtgcgggcaaggaagacttggcggcggtggctttgggcagcagcgcgtttgccacggtttatattacctttatgggcattatggcggcgctgaacccgatgattgcccagctttacggcgcgggtaaaaccgacgaagtgggcgaaacggggcggcaggggatttggttcgggctgtttttgggcgtgttcggcatggtcttgatgtgggcggcgattacgccgttccgcaactggctgaccttgagcgattatgtggaaggcacgatggcgcagtatatgttgttcaccagcttggcgatgccggcggcaatggtacaccgcgcgctgcacgcctacacttccagcctgaaccgcccgcgcctgattatgttggtcagctttgcggcgtttgtgttgaacgtgccgctgaactatattttcgtttacggcaaattcggtatgcccgctttgggcggcgcaggctgcggactggcgacgatggcggtgttttggttcagcgcgctggcattgtggatttatatcgccaaggaaaatttcttccgcccattcggactgacggcgaaattcggcaaaccggattgggcggtgttcaaacagatttggaaaatcggcgcacccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcggggacggtgcgcatcggcttttcgcttgggcggcgcgaattttcgcgggcgcgttatatttcgggcgtgtcactggtgttaggatggatgctcgccgtgattaccgtgctttccttggtattattccgttcgccgctggtaagtatgtacaacaatgatccggcggttttaagcatcgccgccaccgtcttactgttcgccggcttgttccaaccggcagacttcacccaatgtatcgcctcctacgccttgcgcggctacaaagttacaaaggtgccgatgttcatccacgccgccgccttttggggctgcggcctgctgccgggctatctgctcgcctaccgtttcaatatgggcatttacggcttctggacggcattgattgcctcgctcaccatcgccgccatcgccttggtgtggtgcttggaattgtgcagtagggagatggtcagatcgcataaggccgtctgaaaacgcagtacacttcaattcaaatacagttaaagttcaaaccatgcaacccatccgataccgaaccgaccttaccccctacaacaccttcggtcttcgcgcccaagcccgggcctttatcgcgctcgaacatgccgacgagttgcgcgacatcgtccgactgctggagttcgaccgcgatactgttttatggctgggcggcggcagcaacatccttttgatgcaggattacgccggactggtcgtacacatggaaaacaaaggcatacgcgagattgcgcgttcagacggcatggttctgattgaagcgcaggcgggcgaaatttggcacgattttgtcctgcacaccgttgcgctgggtttgagcggtttggaaaacctgagcctgattccgggtacggtcggcgcatcgcccgtgcagaacatcggcgcatacggcgtggaggcgaaagacgtgattcacagcgtgcgctgctttgatttggatacggagacctttgtcgagcttgccaatgccgactgccgcttcgcctaccgcgaaagcctgttcaagcaggagggtaaagggcgttatgtgattgtttcggtcgtatttgcattaaaaacgcattttgtgccgactttgggttacggcgatttggcggccgccgttgccgaactgagcgcgggcagggtcccgacggcgaaagatgtttccgatgcagtgtgtgcaatccgcaacagtaaacttcctaatcctaacgtgcttggcaatgtcggcagtttctttaaaaaccccgtcgtcagcgcagaaaaagccgccaccttgttgcagcggcatcctgatatgccgcgctatccgcagcccgacggttcggtcaaactcgccgccggctggctgatcgaccaatgccgtctgaaaggcttccaaatcggcggcgcggcggtacatgacaggcaggctttggtcttagtgaacaaaaacaacgcctcggcaaacgatgtccggcagttggcgcaacacatcaaatttacagtatttgctcggtttcaggtagaattgcacgccgaacctaattggctgcctgcttcgttcagcctgtaaatccaaggagtatgcccgtgacccgccccgccaaaatcaatacttacacacgcatcatcgacgccagccttgcgcttttcaacgaggaaggcgagcgcaacatcagcaccaaccatattgccgcccacttgggcatcagtccgggcaacctctattaccacttccgcaacaaagacgaaatcatcgtccaactgttcaaacgttacagcgaagccctgctggcatacctgaatgaagccgtgttgccgtctgatgtggaagactccatcaattatatggccggtatttatgatgtgatgtgggaataccgcttcctattcagcgacgtgaacaccctgcttgcacgcagtgccgaattgttgggcgaacacaataccttcacccaagccaaagtctccccgctcttggtcaacctgctcacccaactcaacggtctgaacatcatccaagccgaccaaaccgccatgaacgatctcgccgtcaatatgtggatggtcacgaaatactggttcgacttcgacagctccctgcgcggccgcaccaagctgaccgaagactccaaagcacgcggcatccgccgcaccttaagcctccttcgtccttatcttttgcccgaacaccgcaagaaatacgaccggaaaatcggcaacggcaacccgtaaacccacagcgtccgaatcagccttcagacggcacttacccgacggtatcagcgaatgcgcgcagtccccccgccccatatctccatcacaggcctaggttacctcggcctgccgctggcacaaaagttttaccaacacggcagccgcgttgccgccgtcaaacgcagcctgacttcggacgatatcaatctgcccatacacctcgataccatcgacctcaatcaagacagcgcgtttcaaagcgcgaaccttgcccgagatacaagcttttggcggcaccatgccaacaaacccgtttggttctgcctcttgccgccatcatcgctgacacattacgccgataccgtcaaacaatgggcagaacttgcccgggcgtgcaacgtgcaacacctgattttcacaagcagtaccagcgtttacggcgatacagcgcgcgaatgcgacgaaatcgccctacccgatccgcaaaccgagtccgcccgccaaatcctcgccgccgaacaacacctgctcgacagcggcgttccgaacatcgacatcctgcggctgggcgggctttattgcgccgaacgccatcccgtcggccgccttgttcaaaagcaaaacatcccgggcggcaaccgccccatcaacatcgtccaccgtaatatcgccgtcgaaagcctgtttcagacggcatttaaccccggcggcaggcggctgaaaaacattatcgaaccgcgccacccgacacgacgcgaattctatacggaagaagccgccaaactcggcttgcccgcgccggattttgcacccgacgacagcgtgggcaaaatcatccgtaccgtttgcgataacggcttaagcctgtaaaataagcggcaacagcaacaaacaggcattctccgccccgatcagaaaatatgtccgccctcctccccatcatcaaccgcctgattctgcaaagcccggacagccgctcggaacttgccgcctttgcaggcaaaacactgaccctgaacattgccgggctgaaactggcgggacgcatcacggaagacggtttgctctcggcgggaaacggctttgcagacaccgaaattaccttccgcaacagcgcggtacagaaaatcctccaaggaggcgaacccggggcgggcgacatcgggctcgaaggcgacctcatcctcggcatcgcggtactgtccctgctcggcagcctgcgttcccgcgcatcggacgaattggcacggattttcggcacgcaggcagacatcggcagccgtgccgccgacatcggacacggcatcaaacaaatcggcaggaacatcgccgaacaaatcggcggattttcccgcgaatccgagtccgcaaacatcggcaacgaagcccttgccgactgcctcgacgaaataagcagactgcgcgacggcgtggaacgcctcaacgaacgcctcgaccggctcgaacgcgacatttggatagactaaccttcagacggcatccgacatgaacagcccttttcacaacatcggcatcgtaacccgccccaacacgcccgacatccaagacaccgcacacacgctgattacctttttgaagcagcacggctttaccgtctatctcgacgaagtcggcataaaggaaggctgcatctatacccaagacaccgtcggctgccatatcgtcaacaagaccgaactggggcaatactgcgacctggtcgccgttttaggcggagacggcacctttctctccgtcgcccgcgaaatcgccctgcgcgccgttccgattatcggcatcaaccaagggcatttgggcttcctgacccaaattccccgcgaatatatgacggacaagctattgcccgttttagaagggaaataccttgccgaagagcgcatcctgattgaggccgcactcatccgcgaaggcaaaaccgccgaacgcgccatcgccctcaacgatgccgtcctctcccgtggcggtgccggacagatgattgagtttgaagtcttcgtcaatcgggaattcgtctatacccagcgttcggacgggctgattgtctccacccccaccggatcgaccgcctattcgcttgccgccggcggccccatcatgcaggcaggattacacgccttcacgctcgtccccatctgcccacaatccatgaccaaccgccccatcgccattccagacacgtccgaaatcgaaatcctcgttacccaaggcggcgacgcgcgcgtccatttcgacggtcaaacccatatcgacgtgcaaaacctcgaccgcatcaccatccgccgctaccgaaatcccttacgcattttgcacccgaccgactaccaatatttcaaaaccctgcgccaaaaactgcactggggcgagcaattagtctaagccggcctttacccgaaagtatccatgaatcccaaaatttcctccgaccatacagaagatgccgtgcgcctctccaaacgcatggcgcaactggggctttgttcacgccgcgaagccgacggctatatcgaacagggttgggtaacggtcaacggcaaaaccgccgtactcggtcagaaagtttcaccggcagaccgtatcgaactgaacaagaaagcccacgaacagcaggcggcacgcattaccatcctgttgaacaaacccgtcggctatgtcagcgcacaagcggaaaaaggctataaatccgccgccgaactgattacccctgaaaatcactgggaaggcgataccggccgcatccgtttcgatccgaaacacaaaatcggcctcgcccccgccggcaggctggacatcgactcggtcggattgctggtattgactcaggacggccgtatcgccaagcagcttatcggcgaaaacagcggcagtgaaaaagaatatttggtgcgcgtgcgcggcaaattggacgaaaaaggacttgccttactgaatcacggattgagtttggacggcgagaaactgcgtcccgcccaagtagaatggcaaaacgaagaccaactgcgcttcgtgttgaaacagggtaaaaagcggcaaatccgccgtatgtgcgaactggtcggactgcgcgtcgtcgggctgaaacgcatccgcatgggcaaggtcaaactcggcaggctgccgcccggcaaatggcgttatctcgctcccggcgaatcgttttaaataagcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtggctcatggcaatctttcttgcaggaaaggccgtatgctaccgcatactggcctttttctgttagggaaagttgcacttcaaatgcgaatccgccaagcattaaaaaatgccgtctgaaaatccttgcgttttcagacggcattgccttatgcccaaataacggtttcttccaagggcctacgcgctttcgtggcgatttcctgaacgcggtagccgaatgtcgcggcgacggacacgccccattctgccgcatcgaacaaaccaaactgcccggacaatatgcgctccatctcggcatagttgaaaccttccaccgggcaggaatcgatacctgccatcgccgcacccgtcatcatgttggctaacgcgatataggtctgacggcaacaccagtcaaacaaggcgcgagaatcgtccaaaatcttgatgtcgtcagcttgaaacgcctgataccttgccaaagattttgctacggcatccggttcggtaacgccgcgccgtttgaggctttccaacataaacgggctgtcggagcgggcatttttcttcgccaaaaacaccaccaaatgactggcggtatccaaagcatccgccataccccaagaaaacggcttgattgcctgtcggatttcagggttttgaaccacaataaactgccaaggctccgaaccgaccgaactgggcgacaaacgcccgagttctaaaataaactgaaaatcctcggcactgattttgcgtgccgcatcgtaatgccggcatgatttacggtttttaaatgcggatagaacctgctctttgcttaatactgtcatcgtgcatccttttattacttgtattgcaaattgatttccgatacggcggcagattcgccaataacgcccaaacgcctttcagacggcatttggttcatcgcaaacgcgcctacgggtaggcgatataggcataagccgaatggttgtggatagactcgaaattctcgctctcgacgacgaaactcttgatgcgtttgtcggcaatcagcgaagtagcgacatcgcgcaccatatcttccacgaatttcgggttttcgtaggctttttcggtaacgtatttttcatcggggcgtttgagcaggccgtagagttggcagctcgcctgcgcctccacataatcgatgacttcctcgataccgacttcggcatcggcagtcaggctgacggtaacgtgcgaacgctggttgtgcgcgccgtattgggaaatttctttggaacacgggcaaagcgaggttacgggaatcatgaccttcatactgtggccgtatgccccgtctttgatttcgcccgtgagacagacatcataatccagtaaggaccgaataccggaaaccggggcggttttcttgcggaaaaatgggaaagaaacgctgattttgccggcgcgggaatctaaaagcgcgaccatttcggtagtcagcttgcgcaattgtgcaaaatccaaggcttcggcatgttgctccatcaatgcgacaaaacgcgacatatgcgtccccttctgctcagcaggcaggtaaaccgtcatggtcagacgggcaatggtggactggatgccttctgcagtttgcagggtaatcggaaagcgcaggtctttgataccgacctgattgatcggcagattgcgcaaatctcggctggattgcacgtctgcaatagtgttcatgagttgtttttccttaatattcatgtaattgttgagatgtgtgcatggtatggcgtttccgccggggaatataccgtcaatctgcaaatgcgagattatatcactcgcttttagcagctgcattgattgtttctatttttcagatagtgataaaatcttcgattattcacatctacataggcagagaccaaatgaaattcgccacgaaagccattcattccagctacgattgcgacgaacacaaccgcgcgctgatgccgccgatttatcaaaacagtatgtttgcgttgcacgagattggcgaaaatgtgccttaccgttattcgcgcctgagcaacccgacccgtcagattttagaagacaccgttgccgatttggaacacggtgcggcaggttttgcgttttccagcggtatggcgggaattgatgccgtatggcgcactttcctgcgcccgggcgataccattgtcgccgtcgccgatatttacggcggcgcttatgatttattggtcgatgtttatcaaaaatggggggtgaacgttgtttttgccgatttaggcaatccggataatttggacgaactgcttaaagcgcacaaggtcaaactggtttggctggaaacgccgtccaatccacttttacgcttggtagacatcaaagtccttgccgcaaaagccaaagcagccggtgcgctggtcggtatcgacaacacttttgccacgccgtatctgcaacagccgttggatatgggttgcgattttgtattccattccgctaccaaatatttgtgcggccattccgacgtgttgatgggcatcgtcgttgccaaaaccaaagaactggcgcagcctttgcacgatatgatggtgcataccggcgcggttgccggcccgctggactgctggctggtgttgcgcggcatcaaaacactggctctgcgcatgaacgcccattgccaaaacgcactcgaaatcgcgcgccgtttggaagcccatcctgccattgaaaaagtgttccatcccggcctgccgtctcacgaacattacgaactggcgaaaacacaaatgcccaaaggcatcggcggcgtggttacggtttatctcaaaaacgacacgcgtgaagcggcaaacagcgtgattaaaaacatgaaactggtcaaaatggcttccagcctcggcggtgtggaaagtttggtcaaccattgctattcccagtcccacagcggcgtaccgcatgatgtgaaaatggaaatgggcatcaaagtcggtctgctgcgtttctccatcggcatcgaagacgcggacgatatttggaacgatatttccgccgcactcgatacaactttgtaaactgtaaaaatgccgtctgaaaccatggtttcagacggcatttcaattaacccggccgaaaatcaacgcttcaacatctttgccgcctcaatagcgtaataggtcaaaatcccgtccgcacccgcacgtttgaatgccagcaggctttccaaaaccactttgccgccgtccagccagccgttggcaatcgctgcctgcaacatcgcgtattctcccgaaacctgataggcataagtcggcacaccgaactcgtcctttacgcggcggacaacgtccaaatacggcaaaccgggcttgaccattaccatatccgcaccttcctgaatgtccaacgccacttcgtgcaacgcctcatcggtatttgccggatccatctggtaggtctttttatctgccttgcccaaattgcccgaactgcctaccgcatcacggaaagggccgtaaaatgcagaagcatatttggcggaatacgccataatccgcgtatggatatgcccggcatcctccaacgcctcgcgaatcgcaccgatacgcccgtccatcatatcggaaggggcaaccacctgcgcgcccgcttcagcgtggcacaaagcctgcttgaccaaaacctctacggtttcatcgttcatcacataaccgttttcgtccgtcagcccgtcctgaccgtgaaccgtataaggatcgagcgcgacatccgtcataatgcccagttcgggaaacctctcgcgcaaggcgcggacagttgacggcacgagtccttcgggattgtacgcctcctgcgcacgctcggttttgtttgccgtaaccacggggaacagtgccaacatcggaataccgagctttaccgcctcttccgccgtaaacagcagcctgtccaaactttgacgcttcacacccggcatagaaggcacatcctcctcgcgcgccgacccctccaatacgaacaccggataaatcaaatcatcggcggtcagcgtgtgttcgcgcatcaggcggcgtgaaaaatcgtccctgcgcatacggcgcatacgcgaagccggaacattgcggtaaggaaactgcataagccctccaatcatcctgtcaacaattcaaaccatacggaagccgccgcaacttgcagacagcatcgggcggcaatcaaaatccgttttcaccggaaagggtttcggcccgccgaaatgccgcgccgaaggacggcgtcccgcccgttaaagaacaatagcaaaacaactgcttcaggctgtcaggcttcgatattcttacgccacaataccaaaagttttccgatatgctgaaccagttgcgcatcaaccgcctcacataaggcagtgcagatttcgatacgttcggcacggtcgtcgccgaatacgcgcactttaatcagctcatgcgccgtcaatgccgcatcggtttccttgatgaccgcgtccgtcagaccctgctgaccgaccatcacaacaggatggagatggtgcgcgcgcgctttcagttccaaaatttctttggtgttcaatttggtatccgtcattttcctactgcttgaataaaaagaataatgcggcattgtacgcgatttggcacgacatcggcaaaattaacgtacaatacgcggtttccattccgacccgcgaaccactatggctgtacgttccaaatcctcaaaagcgtggctgcacgaacacgtcaacgaccactacgtccatatggcgcaaaaagacggctaccgcgcccgtgccgcatacaaacttttggaaatcaacgaaaaagacaaattaatcaaacccggcacggtacttgccgacttgggcagcgcgccgggaagctggtcgcaggttgccgccaagctgacgggtacttccggagcagttttcgccttggacatcctgcctatggaagccatagggggcgtctccttcattcagggcgacttccgcgagaacgacgtactggcacaattcgaaaccttgttggacaaccgcccgctcgaccttgtaatttgcgatatggcgcccaatatgtcgggaaacgccgtaagcgatcaggcacgcagcttttatctgtgcgaactggctttagacttcgcctcgcaacacctgaaaaccggcggcagctttttggtcaaagtctttcagggtgcaggctatcaggaatacatggcagccatgcgcgaaattttcggcacggtgcagacgcgcaaacccgaagcctcgcgcaatcgctccagtgagatttatttattgggcaaaaataaacgctgacaatacagacggcgtgctttacaatcatttccgttttacacctcaattatggagccttgctaagtggggaacacctttaaatcaatccttgtctgggtcgccttgggtatcggcctgatggctgcgttcaacgctttagacggtaaaaaagaagacaacgggcaaatcgaatactctcagttcatccaacaggtcaacaacggcgaagtatccggcgtcaacatcgaaggatccgtcgtcagcggctacctgattaagggcgagcgcaccgacaaaagcactttcttcaccaacgcgcctttggacgacaacctaattaaaacactgctcgacaaaaacgtccgcgtaaaagtaacgccggaagaaaaaccgagcgcgctggctgccctgttttacagcctgctgcccgtcctgctgctgattggcgcatggttctacttcatgcgtatgcagacgggcggcggcggaaaaggcggcgcattctcattcggtaaaagccgcgcccgcctgctggacaaagatgccaacaaagtgacctttgccgatgtcgccggctgcgacgaagccaaagaagaagtacaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcgagccgcgtccgcgatatgttcgagcaggcgaagaaaaacgccccctgcatcatctttatcgacgagattgacgcagtcggccgccaacgcggcgcaggtttgggcggcggcaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgagggcgcgaacagattttgaacgtccattctaaaaaagtgcctttggacgaatctgtggatttattgtccctcgcgcgcggcacgccgggtttttccggcgcggatttggcgaacttggtcaacgaagccgccctgtttgccggccgccgcaataaagtcaaagtcgatcagagcgattttgaagacgccaaagacaaaatctatatgggtccggaacgccgcagtatggtgatgcacgaagacgaaaaacgtgcgacggcgtatcacgaatccggacacgcgattgttgccgaaagcctgccctttaccgaccccgtccacaaagtaaccattatgccgcgcggacgtgcgctgggtctgacttggcagcttccggagcgcgaccgcatcagtatgtataaagatcagatgttgagccagctctccatcctgttcggcggacggattgccgaagacatcttcgtcggacgcatctccaccggcgcatcaaacgactttgaacgcgcaacccaaatggcgcgcgaaatggtaacgcgctacggcatgagcgacaaaatgggcgtgatggtttatgcggaaaacgaaggcgaagtcttcttgggacgcagcgtaacccgttcgcaaaacatttccgagaaaacccagcaggacatcgacgcggaaatccgccggattttggacgagcaatatcaggttgcctacaaaatcctcgatgaaaaccgcgacaagatggaaacgatgtgcaaagccctgatggaatgggaaaccatcgaccgcgatcaggtactggaaatcatggcgggcaaacaacccagcccgcccaaagattacagccacaacctgcgcgagaatgcggacgcggcggaagataacgcgccgcacgctccgactcgggaagaaaccgaagcacctgccccggcagacaccgcttcgacagagtccgagcagcagcctgaaaacaaggcttaacttcccgaacaaacggcagcccgcaagctgccgttttcccatcccgttttcagacggcattttccactcaatgccgtctgaaacgccaaagccgtatcggtttttacgaatctgcgatatggcggtttaaattgaaatcagaacggggcaaggctgtaccggtttaaaattaaaccgctataataccgcccttcgaatacacgcccgcattggtgatgcccgtgaaaaaagttgaaaaaaacatcttggtgctgcacggcgcggacaaaatgttcgagctggtcgacaaggttgaagactatccgcactttctgccgtggtacagcaagaccgaagtcatcgggcgtagcggcaacgaactgaaggcgcggctgtttatggattatatgcacgttcgccaatcgtttgccacgcacaaccgcaacattccgggcagggaaatccgtatggaactgctcgagggtccgttcaaaaccttacgtggaacgtggaaatttatcgatttgggcgacgatatgtgcaaaatcgaattcaatttggaatacgatttttccaatgccgttttgtccgccttaatttcccccgtcttcaaccacctttccaccacgctggtcgaagcgttcgtcaaagaggcagaccgccgttatgcttgaaattgagattgtgtacgggctgcccgaccgacaggttttgaaaaccatgcagcttgccgagggaacaaccgtccgcgccgccgcactgcaaagcggtttggacggcatatttgaagatttaaacctgcattccgcgcctttgggcattttcggcaaagccgtcaaagacgacacgccgctgcgcgacggcgaccgcatcgaagtgtaccgcccgctgttgatcgaccccaaagaagcgcgccgcaaacgcgttcaaaatcaagaagaataaccatgccgtctgaagccttcagacagcattcgacagaaacacggaaaatatcatgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgccgccctgcccgacggcgacgtttggctgctcaaacctgccacgttcatgaaccgttccggacaggcagttgccgcgcttgcacagttctacaaaatcaaacccgaagaaatcctcgtcgtccacgacgaactcgacattccctgcggacggatcaaattcaaactcggcggcggcaacggcggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgggaagaagcaacccgcttcctgcacagcaaatgacccgatgccgtctgaagccctttcagacggcatgttcccgatttccatatccgaacagtcatgaccgaactcaagcagcttatccaaaccgaatccatccccgtcatcgaagaaaccctcgatttcctgctctacgaatgcagcatagacgatgccccctccgccgaagaaattgccgtttggcgcgatatgctggccgcacgcggcggaaaattcctgcgcctatccaaactatgccagacatggcttgaagaggaacaagcatgaatctgccacgcaaccgctttatcctgctctcggcattgtggtttgcaggcagcatttactcactgcttttcaaagctgccgaaaccgcgccaccgccttttccgcattttgacaaagtggcgcacctcgccctgtttttcgcacaaatctggcttctgaccaaagcattcagaaccgacaaccgccccatcccctatcgcagcctgatggtctttgccctctgtttcgccctcttcagcgaatgcgcgcaggcatggtttaccgcaacgagaaccggcagtttgggcgatgtccttgccgacctgacgggcgcagcccttgccctctttaccgcgcgagctgcctgccgcccggactaaatcggtttattttccccaaacaggatgcacctcttcccgatatatcctatttttccccttacatatcaatcccatctcataaacaaaaccgacaaatcgtttacaatatatttacactacatcagattacaaatatactcgaaccagttgcagaagcggcgattccacaaaccgtttcggattgcacgacacaaaagaaaaaccgattttgttgccttaaaggagtattcatgaacctgcatgcaaaggacaaaacccagcatcccgaaaacgtcgagctgctcagtgcgcagaagccgattaccgactttaagggcctgctgaccaccattatttccgccgtcgtctgtttcggcatttaccacatcctgccttacagccccgatgccaataaaggtatcgcgctgctgattttcgttgccgcactttggtttaccgaggccgtccacattaccgtaaccgcactgatggtgccgattctcgccgtcgtactcggtttccccgacatggacatcaaaaaggcgatggctgatttttccaacccgattatctacatttttttcggcggcttcgcgcttgccaccgccctgcatatgcagcggctggaccgtaaaatcgccgtcagcctgttgcgcctgtcgcgcggcaatatgaaagtggcggttttgatgttgttcctcgttaccgcctttctgtccatgtggatcagcaacaccgccaccgccgcgatgatgctgcctctagcaatgggtatgctgagccacctcgaccaggaaaaagaacacaaaacctacgtcttcctcctgctcggcatcgcctattgcgccagcatcggcggcttgggcacgctcgtcggctcgccgcccaacctgattgccgccaaagccctaaatctggacttcgtcggctggatgaagctcggcctgccgatgatgctgttgattctgcccttgatgctgctctccctgtacgtcatcctcaaacctaatttgaacgaacgcgtggaaatcaaagccgaatccatcccttggacgctgcaccgcgtgatcgcgctgttgattttccttgccacagccgccgcgtggatattcagctccaaaatcaaaaccgccttcggcatttccaatcccgacaccgttatcgccctgagtgccgccgtcgccgtcgtcgtcttcggcgtggcgcaatggaaggaagtcgcccgcaataccgactggggcgtgttgatgctcttcggcggcggcatcagcctgagcacgctgttgaaaacatccggcgcgtccgaagccttgggacagcaggttgccgccaccttttccggcgcgcccgcatttttggtgatactcatcgtcgccgccttcattatttttctgaccgagttcaccagcaacaccgcctccgccgcattgcttgtaccgattttctccggcatcgctatgcagatggggctgcccgaacaagtcttggtattcgtcatcggcatcggcgcatcttgtgccttcatgctgccggttgccacaccgcctaacgcgattgtgttcggcacgggcttaatcaagcaacgcgaaatgatgaatgtcggcatactgctgaacatcctctgcgtagtattggttgctctgtgggcttatgctgtactgatgtaaaccatcgacctaaacaacaagaccgtctgaaagaatatttttcagacgaccttgaagtttgtcgttcagacacaatttgtcgaatcattcaaaaccagattctaacgaaaggaaacccatgattatcctgcacaccaacaaaggcgacatcaaaatcgaactcgatttcgacaaagcccctgttaccgccaaaaacttcgagcaatacgtcaaagacggcttctacgacggcgtaatcttccaccgcgtcatcaaaggcttcatgattcaaggcggcggcatggatgaaaacatgaacgaaaaagaaacccgcgatccgattcaaaacgaagcgtccaacggcctgcccaacgataaatacaccatcgccatggcacgcacttccgacccccattccgccagcgcgcaattcttcatcaacactgccgacaacgctttcctgaacttccgttctaaagagctgtacggcaaaaccgtcgtccaagactggggctatgccgtattcggtaaagtcgttgacggttttgacgttgtcgatgccatcgaaggcgtttctaccaaacgtcatggttaccacgacgacgtaccgagcgaacctgtcgtcatcattaaagccgaagcggtataaaccgacaatccgaaagcagcctgcacaaaggctgcttttatttcagacggcatgttatttgatgtaaccgtgctatgccgtctgaaaaccggacgcaagccttcagacggcataccgctatgttaaaatatgcccgtttttcctaaacggacacaaaggaaaccttatggcaagcatcgcccgcgacatcttcaaagcctacgacatccggggtattgtcggcaaaaccctgaccgacgaagccgcctaccttatcggcaaagccatcgccgccaaagccgccgaaaaaggcattacccgcatcgcgctcggacgcgacggacgcttgagcggtcccgaactgatggaacacatccggcgcggctttaccgacagcggcatcaatgtcctcaatgtcggtatggttgccactcctatgctctacttcgccgccgtcaacgaatgcggcggcagcggcgtgatgattaccggcagccacaatccgcccgattacaacggctttaaaatgatgctcggcggcgacacgcttgccggcgaagccatccaagaacttttgtccatcattgaaaaagacggttttgctgccgccggcaaacaaggcagcgtcaccgaaaaagacatctccggcgaatacctcaaacacattaccggacacatcaggctcaaacgcccgatgaacatcgccattgacgcgggcaacggcgtgggcggcgcgtttgccggcaaactctacaaaggcttgggcaacaaagtaaccgagcttttctgcgacgtggacggcactttccccaaccaccatcccgacccatccaaaccgaaaaacctgcaagatttgattgccgcgctgaaaaacggtgatgccgaaatcggcttggcgtttgacggcgatgccgaccgcttgggtgtggttaccaaagacggcaacattatttatcccgaccgccaactgatgctgttcgcccaagacgttttgaaccgcaatcccggcgcgaaagtcattttcgacgtgaagtccacccgcctgcttgcgccttggattaaagaacacggcggcaaagccataatggaaaaaaccggccacagctttatcaaatccgccatgaaagaaaccggcgcgccggttgccggcgaaatgagcggacacatcttcttcaaagaacgctggttcggcttcgacgacggtctgtacgccggcgcacgcctcttggaaatcctgtctgcctccgataatccgtccgaagtgttaaacaacctgccgcaaagcatttccacgcccgaactcaacatcgccctgcccgaaggcagcaacggccatcaggttatcgacgaactcgccgccaaagccgaatttgaaggcgcaaccgaaatcatcaccatcgacggtctgcgcgttgaatttcccgacggcttcggtctgatgcgtgcttccaataccacgccgattctggtgttgcgttttgaggcggatacgcaagaagccatcgagcggattcaaaaccaattcaaagccgtcatcgaaagcaatccgaatctaatctggcctctgtaaacacaggaaaaatgcttaatcaaatcttggtagattggatttggcttaaaaatctccgcgtccgttcgtgtttggggtggtcgaacaaatcttgcgggctgccttgttcgacaataacgccgccgtccatcacgacgacggtggttgccacttctaaggcgaacttgatttcatgcgtaacgacaaccatggtccagccttcttgcgccaattccttcatggtatccaaaacatcttgcaccaattcaggatcgagcgcggaagtcggttcgtcaaacagcatcagttcaggctgaatcgccaatgcgcgggcaatgccgacgcgctgctgctgaccgccggaaagctggtagggatacaaatccactttgtcgcccaagccgactttttccagcagtttcagagcctcttcgcgcgcttgggcggcaggcttgccctgtacggcaaccggtccttccattacgttttccaaggcggttttgtgcggaaagaggttgtattgttgaaacaccatgcctgatttgcggcgcagtgccaaaatatcgtgtttgcttggttttttagaaaaatcgattttcagcggtcgctcgttgtcgaactcgatttgtccgtcttcgggcatttccaacgcgtttaggcatcgcagaaacgtcgttttgcctgagccggaaggcccgaggatgacgaccacctgccctttgcacacatccaaatcgatgccgcgcaaaatagtgttttcgccaaaggtcttatggatattgcggattttaatcatgacaactccttatttggcgacgtagcggtcgaaacgtttttccaaacgcgcctgaatcaggaacagcactttacaaaaacaccagtaaaccaaagcggcttcgatatagacgggcaaaaagtcataagtgcggtttgccgtttcctgcgcgacgcggaataattccgttaccgtcacgactgccgcgagcgaggtgtttttaaacaaaccgataaactcgttgctcaaaggcggcacggcaacgcggaatgcctgcggcgcgacaatgcggcggaacgtctgcatataggtcatgccgatggagaaacctgcttcccattggcctttaggtacggacaaaattgccgcgcgtatggtttcggaagcgtatgcgccgacattgagcgaaaagccgatgatggcggcaggaatcgggtcgatatagatgccgacggaaggcagcccgtaaaacacaatcacaagctgaaccaacagcggcgtaccgcgaatgacggaaatataaaattccaccaatttcagcaggattttccgcacgatgccgccggcgggcataatccgcaccaaagccacggctaccgcaatcatcataccgataacgaaagaagctgccgccaaaggcagagagaccgcgaagccggctttgaccataggcaaaaacgcgctgacaatcatatcggcgcgtgtttccgtcataaacggcagcgaagcaaggaaattattgaacactgatgtcttttccgaagaattgttcgcccagttttttcagcgtaccgtcggctttcagctcgttgattgccgtactgaatttcgccacggcttcgtcattgcccttgttgacaatcaggccggaaccgactttttcatcggcaggtgcggaccaaacgattttcacgcccgcattcgggtttttcttcagatagtccaaaaccgccaattcgtcgttcagggttgcatcggcacgtttttgttcaatcagggtcagcgattgcgccaaaccgtcaacagccaccaaatctgcgcctgcagctttggctttttcgccgtagttgctggtcagggattgtgcggttttcacgcctttgatgtcggctatagatttgatgttgctgtcgttacggacaaccaatacggcaccgctccagctgtaaggatcggatttgtcgaatgtcgcttggcgttcggggctggtcagaccgacttggtttgccaccacgtcgaaacgccccgccttcaaacccgccatcatcgaatcccattgcgtttctttaaactcgactttcacgcccagtttttccgccacggcgcgggttacttccacatcgtaaccggtcagtttgccgtccttgtcgtggtaggtaaacggtgcgtaagtgccttccgtgccgacggtaaccgtgcctttattgttgatgcgctcgattaaagaaccggaaactgccgattgtgcaggcgcggaagatg

SEQ ID NO: 12 - DNA, 102634 bp, Neisseria meningitidis
  misc_feature (15452)..(15452): N is any nucleotide
  misc_feature (62685)..(62685): N is any nucleotide
ccggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaagagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgcttggtttgcacttccgacagcgggcggttgcggcaggctttgctcataatgccgtccaacaactgatgttcttccagatgttgccggttttccgcactgtcatagcctttatcggcatagacggtcgtaccttcgggtaacccttccaacaacggcgacaggtgtttgcactcatgggcattggcgggggtgatgtgcagtttctcgatatagccttccgcatcggtacgggtatgttgtttgtaaccgagtttgtagaggccgtttttcttgatccaacgggcatcgctgtccttactcggtgtggtttggccgctgatttgtccttcttcatcgacttctatggcctgacgctgttcgctgccggcggtctgaataatggtggcgtcaatgacggcggcggatgctttctctacttttaagcctttttcggtcagttggcagttaatcagttccaacagttcggacagggtgtcgtcttgcgccagccagttgcggtagcggcataaggtgctgtaatcggggatgctcagttcgtcaaaacggcaaaacaggttgaaatcgatgcgggtgatgaggctgtgttcgagttcgggatcggagaggctgtgccattgtccgagcaggacggctttgaacatggatagcaggggataggcgggacggccgcggtggtctcggaggtaacgggttttttgacggttcaggtactgctcgatcggctgccaatcaatcacttggtccaacttcaatagcgggaaacggttgatgtgtttggcaatcatggcttgcgcggtttgccggaagaaggtgctcatgagaaatcccctaaatgtcttggtgggaatttaggggattttggggggattttgcaaaggtctcaggcggcaaatcgccacccttcccttcaaaccttccgcctgtcccaacagcagacaggcgaaaaagcccttaccactgataaccgacagatgcggaagcaccgaaatggccgcgcgaattgccggaagccgtgcctttgataatccaatttccgccgtcggaaatactggagtagccgatggcgtaaccggcttcgccgcgataagtgccgccgccgatcgccatcatactcttgccgggcaaatacgcctgaaccagacctgcggttgcaatcgcttgggcgatgcccgcacgcgcgttgccgtccacattgtcgatgcggttgttcaagttttgcgccacgcctttaagttgtgcgacgtttgtaacatccccctctttaacgcccggggcgacattggtaatgcggacgggtttgttgtccttcttgctgccgacattcaatgcgtccccatccacgctcaaagtgggcgcatccgcccccgcgccgagcgaaacgctggaaaactgcggggtcatcgaagtggcgatgtcgatatttttaccgttgcgggtaatctcgatgttgttgccggcattaatgttgacggtttcatccatctttcccttgctcggcgaaacattgccgctgatgactttgcccgaagaacctgcaaccgctttggaatccaaattccaaccgctgttttgcagctgattgacgtttagggcatcgccgacatttacatcatacataacagtgatgttgccttgatcatctttacttacagtcgcagttgtacctttaccactagcaaaggttacatttgtgcctgatgtaacggtttcaaacttgtcagcttgacctgtttgaccattagcggttgttgttttcattctccaaccagccttgtttactgcatcaatcacttcttttgcagtcactaagccttcgccttcgtctgtagaagaaccattctcgcctttgtctttaccagtaaccaacttaccgtctttttctttaataacagaagtcttcgcaccgattttaacttcggttttcttgccgttgtctttgctttccacattaacagtcgttgttttcgtatctgcgctcaagaactcgactgtgtcgtaagtgcggacgaaatcaacgttatcggaagctgttgtaccgggtttaacgcctttaatgttccagccagcgtttaatacgtctttaacgcttgccgcacgttttttctcgtcatcggtaacgttgtcgttggttacgtttgtggtcgctccggtattcagcagcgtatcggtcaaagtcgaaccaataccgttcagatgaaccgtggtgtcgccgttcgtcccagccgtttctttcgcaaaattcaagcctttggtgtcgcttgtgatgttgactttattgccgtttgcgctaaacgataatttttcagttccaacactggtcagatctgtgaggtcttttttcagcgagtaggtgaagtttgtgccgttttgtttgattttcaggttgtcgccggctttgagggtgatttctctggctgttagtactcctttctcgttgaaatatactgcccaatctgaattttcttctactttttctttttctcccgtgccttctttatcggaattgactatcaacacggcaacagtgcgttgtacggggtctaaatataaatcttcttcttgctcttcattgttagcacttgcctgaaccgttgcaaacaacagtgtcgccaatacggcggtcttcacggttgcggaggcgcgtttggtgtggttgcgtgtgagctcggatacgacgacccaggcattgagggcactattccaaatgatgcggtatattttgttcattttgttttttcttttggtttgtttgaatggttaaatcggggtttgggggcggatggtgcggcatccgcccggtttttgggggttgggggttttctgataaattcccccaacttaaaatctcgtcattcccgcgaaggcgggaatctgggacgtggaatctaaggaaactgttttattcggtaagtttccgtgccgacgggtctggattcccgcttttgcgggaatgacggcggtggggtttctgttttttctgatagattcctgtggtttttctatggattcaatcattcctgataaattcccataatctaaaatctcgtcattcccgcgaaagcgggaatctaggacgtggaatctaaggaaactgttttatccggtaagtttccgtgccgacgggtctggattcccgcttttgcgggaatgacggtcggtggggtttctgttttttccgataaagtcctgccgcgttgtgttgctggattcccgcctgcgcgggaatgacggcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgacggcggtggggtttctgttttttccgatagattcctgttgcgttgcgtttttggattcccgcttttgcgggaatgacgcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgatggcggtgggggtttctgttttttccgataaagtcctgccgcgttgtgtttctggattcccgcttttgcgggaatgacgcggtgggggtttctgtttttgctgatagattcctgtggtttttctatggattgaatcattcctgataaattcccataatctaaaatctcgtcattcccgcgaaggcgggaatctaggacgtggaatctaaggaaactgttttatccggtaagtttccgtgccgacgggtctggattcccgctttcgcgggaatgacggcggtggggtttctgtttttgctgatagattcctgtggtttttcggttgctggattcccgcttttgcgggaatgacggcggtggggtttcggttttttccgataaattcctgttgcgttgcgtttttggattcccgcttttgcgggaatgacggtcggtggggtttcggttttttccgataaagtcctgctgcgttgtgttgctggattcccgcctgcgcgggaatgacggccgccggacggcaaacgaccatacacaattattgacaaccccatttattgcgaaagtcagcctaggagaatcgatctaattgtcaacattcccttatgatcaaagggattacactttattttacgcaaatgcgggggggggggtgatttttgacgttttttgccgaaaatttacattcggacgacgaaaaggaaaaagccgtgtcgcatctgtgcaacacggcttggcgggcgcaaacggatatagtggattaacaaaaaccagtacggcgttgcctcgccttagctcaaagagaacgattctttaacaagtgaattggttccgtactatttgtactgtctgcggcttcgtcgccttgtcatgatttttgttaatccactataaaacggtgttccctgccgccgcaggcggaacgccggatgacggggttttccctaagggtgcggctgccgctatatcacgaaatccaacaggtagaaatcttctttgcccacgccgcattcggggcatttccagtcgtcggggatgtcttcaaacttggttccgggggcgatgccgtgttcggggtcgccgtgttcttcatcgtaaatccagccgcaggggccgcacatatattgcgccatttgtgtttccttgttttttgtatagtgggttaacaaaaaccggtacggcgttgcctcgccttagctcgaagagaacgattctctaaagtactgaagcacccgtactatttgtactgtctgcggcttcgccgccttgccctgatttttgttcatccgctataaatcagggtttgggagaatggtgcggtatccgcccggtttttttggggttggtttttttcgatagattcctgtggtttttcgattactggattcccacttccgtgggaatgacggtttggaggtttcggttttttcgatgaattcctgttgcgttagggggggggctggattcccgcttttgcgggaatgacggtttgagggtttctgttttttccgatggattcctgttacgttgggggctggattcccgcttttgcgggaatgacggtttgagggtttctgttttttccgatggattcctgttacgttgggggctggattcccgcttttgcgggaatgacggtttgagggtttctgttttttccgatggattcctgttgcgttgggggctggattcccgcttttgcgggaatgacggtttgagggtttctgttttttccgatggattcctgttgcgttgggggctggattcccgctttcgcgggaatgacgcggtgggggtttcggtttttccgcctgtttattttgcggcttcgattgccgctatttctttgcgtaggtgtttgatagcgggggttacgatggcaacaaacattgcttcgcggacgcgcctttgggcgggactgcgcatcaggtagccttttgcgccggaatgcagggcggcggattgggcggcggcaagtgccagtacggcggcggcttcgcgcagcttgagggtagcaaggttgtcgggcgtgccgctccaagccaagccggcgagccgttcggtttctgcccacgcgccgtccagccttgttttgaggctgtcgtagccgtcgttgaggtagttgttgacttcggcgttgacgacgttggcgaggcggatgatgccgaggctgccgtcgattacgcccgcgccgatgccgatttgcaggaggataaagcctgctttgatgctttggatgtagtcggcaaactgttcgggcgcggcgatgatgtcttcgtcggggataaatacgtctttgaaattcaggctgaaggtgcgcgtaccttcgagggcgcaaaattcggggcagttttgcaggcttacgccttcccattgtccgcctgtgatgaacataacgtagccgtcgccgatttgggcggtattcgcccagatgtggtcttcaccgatgttggacacccacggcagcgcgccgttgactgtgtagccgccttccacgcgttcggcttggaggttgtgtttttcgatgtcggcaaggtgtttgacggtattggacatgcccgtacccgccaatactttgccttgcaggatgtcggcaaggtatttgtctttgacggcccggttgggcgtttggtgcagataccacgcgcaagccgcctgacaccacgcactgaaagaggttgcgccgcattctttgccgatttcgcgcaatacggcgatttgcgttgccaaacccaagccgttgccgccttcggcttctgtaccgactgcgccgaatccaccgattgcgccgagttcgcgcataaatgcttcggggtagtatcctttgcggtcgatgtcgtccactatgggtttgagcttggttttgacgaattcggcaacgttggcaatcagggtttgggcgttcatctttgttccttaaggtttgcggggaaatcgggggcgcgcctgatgcgcggctgcttccctgccgcttaggcggcttgtttttgtttgagggggtgtttttgaaaaaccgcccgatattcgggcggtttgccgtatcaggcgtaagcctgcaattcggggttgatttcggtttgtccgaggttgttgacgtagttgcacagggttgccaaggctacgcccatcacgacttcgactgcctgctgctggttgtagcccgcatcgaaaaatgctttgagttcctcgtcggataccgcgccttttttcgccattacggcttgggtgaaggcggcgagcgcgccgagtttggcatcgtcaaattcgcctgctgccaaagcgcgcgcggctttgacggattgttcggacaggagttttttcagggttgcgagtttggtgtgccctgccacgcaaaaaccgcattggttggtacgggcggcgatgatctggatgacttcgacttcgccggcggtcaggctgttggcggcgttgagcttgccgacttcttggtaaaacgccaaggcttcgggggcgtttgataatacgccgataaggttggggataaagccgttgttttgaagtaccgcctcgacgcgcgctttggcggcttcgggggcggtttcgagggtgtgtacggttaaacgtgccattttctttccttgttcgcaaatattgggtacgggcgcatggtatgcatttcggaacggaataggaaagactgattggttatgtgctgcaaacaaaaggttataagaaatgccgtctgaacatttttcagacggcatgatggaaaagaaaacgcgcttatcggcccccgcgcccgaaatattgcgccaatgcggcttggggattggctgcctcaaccgtttcgggcaattcggtatagccgcgcgataaaaggtggcgtgcataaaggctgttgccctttgcgccgaaccagacggaaaccgccaagcccaatacgttaaacgccgagtctgtggcgggcgtgtcgccgtaaaccagttgggcaaacacagccagcacgaatatcgcgcccgtcagccccagccccaaaccccacattcttttgaaacacgcccacagcgtgccgaacaagagccccggccatgaccagccttgtttgacggcttggggcggcagggcgggatgggtgtagattttgtatggtttcatcgtgtttccttttcggttgaaaccctgccctttgggaaggtaggatcagactttatagtggattaaatttaaaccagtacggcgttacctcgccttgccgtactatctgtactgtctgcggcttcgttgccttgtcctgatttaaatttaatccactatatttgggaggcgcgcgcgcctgtgccggcatacggcttgaaagcgattacccgatggggaacttcaaacccgacaatgccgtctgaacggtgtcttgccttcagacggcattgcctgccttcaaagcggacgcgcttattccgcccagtttttctttttgctggttttgcctacgcccgggttgaagctgttggtcgggtcaagtttgcggtaaaactgtttgagcgcgggcttggcttcgtacaaatggccgacgttgtgttcggctggatattgcgcgccgcgttgatccaagagatgcagcatttcgtgttccaatgccatgcagtcgttgccttttttgatgatgtaatcctgatggaaaacgtggcacatgaaatgtccgtagtagagcttgtggatgattttattgtcgatttccggcggcagtttttcaaaccagtcgcggtcgtcgcggcgcagggcgatgtcaagcgcgaccaagtcctccacttcgtcgtcgtgtacggcacggtagcggatggcggctgaggcgacggcgaaacggtgcagcatcgcggcttgggtttcttcggcgttgcactcgaaaaacgcgccgccgtgatgtgcaaaatactctttcaggaacgcgcgcgcctcatccacgccttttccgcccattttcagaatcaggtggtgttcgtatttgtcgcggtaatcgcgcatggatttgggcagatggtcaggcaggaatttgctgacgaactgcattgccttgtcggaaaaatgtttgggcaggaagctgacttttttgccgaacctgtccacgcgtgccttcaaatcaaataatttcggcagttggtgcgtaccgaattttttgatgacgtaaaacgtatctttgccgtacacgtcggcaatgtcgaaagcgtggcggtggatgtattcgccggaaacgggcaggctttcaaattcgcccaaggcggcgcggcggatgtcggtcagctcgttgatgtcgttcgtgccgatgtagaacacggccgtttgtttttcttgcggaaaggtatccaagcggacggcgaataccatcagcttgcccgcgcagcccgaggcttcgtaatggcgcgctgggtcggcattgaaacgcgcggcggtcggttcgtccacttggcggacatgttcgcaataggcgtggtcgtgtcctttgcccgcgtcttgcgtgatgtctttgttttgataatgatgaccttgaagattggtcaggatttcttcgggcgtgttgcccaagtctatgcccaagtggttgaccagttccaacctgccttcttcgttgatttgggcgaacaacgccatttcggtgtaggccgggccgcgctgtaccaacgcgccgccagagttgttgcacacgccgcccaagacggacgcgccgatacaggatgagccgataaccgaatgcggttcgcgccccaaaggtttcagcagcaattcgagctggttcagggtcgagccgggcaggcagacgacttgttcgttgttgttgatggtttggatgatgttcatccgcatggtgttcacaatcacgatgtcgcggtcgtaatcgttgccgtcgggggtcgagccgcccgtcaaaccggtattcgccgcctgcgtaatcacaatcacgtctgcttcgacgcacgcctgcagaattttccacatttccagaatgcttccggggcgaaccaccgccaacgccttaccctcgccgaagcggtaaccttggcggtattgttcggttttcgcggggtcggtgatgatgtatttttcgcctacggtttgggtcagtcttgacagtaattgtgatgcgctcatggcagtttccttaaaattgtcggcaggtgcattgcacattggaattgttttcacattgtagttatacgttatggcaaagtaaagaaaatgccgtctgaacggctttcagacggcatcggtgcgatacgggaacgccggaacatcgaagctccggcgtttcaaatagggcggcgggccaaacccccggcactggcgcattggagtgggctgctggcttccgcccctgacccggtgttccgatttgccatgcggggagacccgcctcagagaaacggcattataacgggttttctgaaaaactcaaccgttttgatacggtcatacgccggaaacaccacctaaaatttatatttgataatattgtcaacaatttctcaaagcgttattttgtttctataagggtatttcctgtttcggcattgaaaagtatcaaaaattgaactacattatcgccttttcaaactcgcctgaaaccgacttttcagacggcattcaaataaaaactgccaaacacggacacaccatgaccacgactaccgcccctcagcgtattcgggaaatcccctacaactatacttcctacaccgaccgcgaaatcgtcatccgattattgggcgacgaagcgtggcaaatcctgcaagacctgcgcggtcaacgcaaaaccgggcgttcggcgcggatgctgtttgaagtgttgggtgatatttgggtggtcgtgcgcaatccgtatctggtcgatgacttgctggagcacccaaaacgccgcgccgcgctggtacgtgaaatgcgccaccgcttaaatgaaatccgcaaacgccgcgacgataatcggcaagtggatgtgttggttgccgcagcagaaaaagcagtcgagcgttttgatagcagttttgatgaaaccagccaaaaacggcggcagattttggagcgtttgagcaaaatcaccaagccgcacaatattatgttcgacgggctggcgcgggtaacgcacgttaccgatgcaaccgactggcgcgtggagtatccgtttgtcgtcgtcaatcccgacacggaggctgaaatcgcgcctttggtgcgcgccttaatcgagctggatttggtcattattccgcgcggcggcggcacgggttataccggcggcgcgattcctttggacgcaaacagcgcagtcatcaataccgaaaaactcgacaagcatcgtggtgttgaatacgttgagctggcaggcttggacggcaagcatccgattatccggtgcggcgcgggcgtggttacgcggcgggtggaagaaaccgcgcatcaggcaggtttggtgttcgccgtcgatccgacttctgccgacgcgtcatgcgtgggcggtaatgtggcgatgaacgcgggcggcaaaaaagccgtgctgtgggggacggcgttggacaacctcgcctactggaacatggttaaccctcaaggcgaatggctgcgtatcgagcgcgtgcgccacaatttcggcaaaatccacgacgaagaaaccgccgtgttcgacgttcacacgctggattcagacggcatcaatatcgttaaaaccgaacgcttggaaatccccggccacaaattccgcaaagtcggtttgggcaaagacgttaccgacaaattcttgagcggcctgcccggcgtgcaaaaagaaggtacagacggcatcatcaccagcgttgccttcgtgttgcataaaatgccgaaatacacgcgcaccgtgtgtatggagtttttcggtacggtcgccaccgccacgccatctattgtcgaaatccgcgactttttgcttgcccatgaaagcgtgcggctggcgggtttggaacatttggactggcgttatgtccgcgccgtcggctacgccaccaaagcggcgggcaagggacgaccgaaaatggttttgctggcagacgtggtttcagacgacgaagccgccgtagaggcagccgccgaacacatctgtgaactcgcacgcgcccgcgacggcgaaggctttatcgccgtatcgcccgaagcccgcaaaaccttctggctcgaccgcagccgcaccgccgccatcgccaaacataccaacgcctttaaaatcaacgaagacgtggtcatcccgctcgaaaggctcggcgagtattcggacggcatcgaacgcatcaacattgagctttccatccaaaacaagctcaaactctgtgccgccttggagcaatatctttcgggcaaactccccatcgacaaaatgggcactgacctgccgaccgccgaactgttgggcgaacgcggcaaacacgccctggcccacgtttccgccgtcaaaacgcgttgggaatggctgctcgccaatcttgacacgccgcttgccgactacaaagcccgctacggcgcagccgtccacgccgcacccgaagccaaaaacaatgaaagctgctttattgccttccgcgatttccgcctgcgcgtgtctgtcaaagcggacgtaatgaaaccgctttctgaaatcttcagcggcaaaaccgacaccaaaattatccaaggcttgggaaaaatccacgcaaaaaccgtacgcagccgcgtctttgtcgccctgcatatgcacgccggcgacggtaacgttcacaccaatattccggttaactcagacgatgccgaaatgcttcagacggcataccgctcagtcgaacgcattatgaaaatcgcccgttcgcttaacggcgtgatttccggcgaacacggcatcggcattaccaagctcgaatttttaagcgacgaagaaatgcagccgttttgggactacaaaaaccaagtcgatccgaaacacaccttcaaccgtcacaaactgatgaaaggctcggacttacgcaacgcctacacgccgtccttcgagctgttgggcgcggaatcgctgattatggaaaaatcaaacctcggcacgattgccgattccgtcaaagactgcctgcgctgcggcaaatgcaaacccgtctgctctactcacgttccgcgtgccaacctgctgtacagcccccgcaacaaaatcctcggcgtgggcttattgatcgaagccttcttatacgaagaacaaacccgccgcggcgtttccatcaaacactttgaagaactcatggacatcggcgaccactgcaccgtgtgccaccgctgcgtcaaaccctgccccgtcaacatcgacttcggcgacgttaccgtagccgtccgcaactatcttgccgattccggccacaaacgatttgcgcctgccgcagctatgggtatggcgtttttgaacgccaccggcccgaaaaccatcaaagcccttcgcgccgccatgatacagatcggcttcccagcgcagaatttcgcctacaaaatcggcaaacttcttccaatcggcacgaaaaagcaaaaagccgaacccaaggcaaccgtcggcaaagccccgattaaagaacaggttatccatttcatcaaccgcccactgcccaaaaacgtacccgccaaaacaccgcgctccttattgggcatcgaagacggcaaaagcatccccatcatccgcaaccccgccgcgcccgaagatgccgaagccgtgttctacttcccgggttgcggctctgagcgtctgttcagccaaatcggacttgccgttcaagccatgctctggcacgtcggcgtacaaaccgtcctgccgcccggctatatgtgttgcggctatccgcaagacgcaggcggcaataaggcaaaagccgaagaaatgagcaccaacaaccgcgtggctttccaccgtatggcgaacaccctcaactacctcgacatcaaaaccgtcgtcgtcagttgcggcacttgttacgaccagctcgaaaaataccgctttgaagaaatcttccccggctgccgaatcatcgacatccacgaatacctgctcgaaaaaggcgtgaaactcgacggcgtaaaaggtcagcaatacctctaccacgacccctgccatacccccatcaaaaccatgaacgccacccaaatggccagcagcctgatggggcagaaagtcgttttaagcgaccgctgctgcggcgaatccggtatgtttgccgtcaaacggccagacatcgccactcaggtcaagttccgcaaacaagaggaaatcgagaaaaacctcaaagagctgccgcagggcgaacccgtcaaaatgctgacctcctgccccgcctgcctgcaaggcttgagccgctacgccgacgacaacaatatgcctgccgactacatcgtcatcgaaatggcgaaatacatcctcggcgaaaactggctggatgagtttgtaaaaaaagccaacaacggcggtgtagagaaagtgttgctgtaacaacggacacggaaatgccgtctgaacgccgaaagccttcagacggcattgtttgaaccaaatatagtggattaacaaaaatcagaacaaggcgacgaagccgcagacagtacaaatagtacggcaaggcgaggcaacgctgtactggtttaaatttaatccactatacctacccaaatcatgattgacagacaaacaaacgaacccaaacaaaaaacccgaatcatccttgcccctatgcagggtctggtcgatgacgtgatgcgcgacctgctgacgcgtattggcggctacgacgaatgcgtcagcgaatttgtacgcattacccataccgtgcattcccgatccatatggttaaaatatgtccccgaaatcgccaacggaaacaaaacgttttccggcacgccntgcaccgtccaacttttgggcagcgatgcggacaatatggcggcgaatgcgctggaagccgtccgcttcggtgcgaacaaaatcgatttgaacttcggctgccccgcgcccaccgtcaacaaacacaaaggcggcgcaatccttttaaaagagccggaactgatattccacatcgtcaaaacgctgcgcggacgtttgcccgcacatattccgctcaccgcaaaaatgcggctcggttacgaagacaaaagccgggctttggaatgcgcctgtgcgattgccgaagggggcgcatgcggactgaccgtacacgcgcgtaccaaagccgagggttacgaaccgccggcgcattgggaatggataaggaaaatccgagacagcgtcaatattcccgttaccgccaacggcgacgttttcagcctgcaagactatatcggcatcaaaacaatcagcggctgcaacagcgtgatgctcggtcgcggcgcggtcatccgccccgatttggcgcggcaaatcaagcaatacgagaacggcgggccggtcaaagacacggattttgccgaagtttccaaatggatacggcagtttttcgagctgtgcctgacaaaagaggcaaacaacaaatatccgctggcgcggctgaaacagtggctgggtatgatgaagaaagaatttgcagcagcacaaaatctgttcgaccgcgtccgaacggttaaggatgcggacgaagttcggaacatcttggctgaatttgagcgagaaatgaatacttgaatatgtatagtggattaacaaaaaccggtacggcgttgcctcgccttagctcaaagagaacgattctctaaggtgctgaagcaccaagtgaatcggttccgtactatttgtactgtctgcggcttcgtcgccgtgtcctgatttttgttaatccactatatccgctccaaagcaaatgccgtctgaaaacctttcagacggcatttgttgtctttattgccgtttttcgtccgtatccggatttttgtttttcagcttcgcacccaagcccaaacgcctttcataatccgattgcggagtatcgtcttcctgcataccgaacgcgccggcattgacccacagcgacagcagcgcgacgacaaaggcgcaaaagccaatcacataccaaaacattgcccctcccgatttgttaaaatcatatcaaatacagtgccgaatttatcacaaacgcacgggcaaatatagtgaattaaatttaaatcaggacaaggcggcgagccgaagacagtacaaatagagacctttgcaaaattccccaaaatcccctaaattcccaccaagacatttaggagcaccttcttccagcaaaccgcccaagccatgattgccaaacacatcgaccgtttcccactattgaagttggaccaggtgattgattggcagccgatcgagcagtacctgaaccgtcaaaaaacccgttacctccgagaccaccgcggtcgtcccgcctgtcccctgttgtccatgttcaaagccgtcctgctcggacaatggcacagcctctccgatcccgaactcgaacacagcctcatcacccgcatcgatttcaacctgttttgccgtttcgacgaactgagcagtatagtggattaacaaaaaccagtacggcgttgcctcgccttgccgtactatttgtactgtctgcggcttcgtcgctttgtcctgatttttgttaatccactatactttatgccgctaccgcaactggctggcgcaagacgacaccctgtccgaattgctcaaactgattaactgccaactgaccgaaaaaggtttaaaaatagagaaagcatccgccgccgtcgttgacgccaccattattcagaccgccggcagcaaacagcgccaggccatagaagttgacgaagaaggacaaatcagcagccaaaccacaccgagtaaggacagcgatgcccgttggatcaagaaaaacggcctctacaaactcggttacaaacaacatacccgtaccgatgcggaaggctatatcgagaaactgcacatcacccccgccaatgcccatgagtgcaaacacctgtcgccgttgttggaaggtctgcccaaaggtacgaccgtctatgccgacaaaggctatgacagtkcggaaaaccggcaacatctgaaagaacatcggctgctggacggcattatgcgcaaagcctgccgcaaccgtccgctgacggaaacgcaaaccaaacgcaaccggtatttgtcgaagacccgttatgtggttgaacaaagcttcggtacgctgcaccgtaaattccgctacgctcgggcagcctatttcggactgatttgcgcccgctgccgcctaaaaggcagcccggatgcctgattatcgggtatccggggaggattaagggggtatttgggtaaaattaggaggtatttggggagaaaacagctgaaaacctgtgtttgggtttcggctgtcgggagggaaaggaattttgcaaaggtctcagagtgagtttattttggggcggcggcaggtcgggggcaagcggcgtggggcttggttgtggtttttaggtttttgggggtaaaaaatgccgtctgaacttttcagacggcgtttgttttttctatccaatcgaggaactgccgccatttttccagcggcatatcggcccgacgggtttcggtatcgggttcggcttcccagcggcctacctgtatgtagtgcttcaccccgacgatttgcgccaactcggcctgtgtcagtttgcagcggttgcgaagggtgcggaggttgtaaggcgtgtagccgagttccatgtcgttgcggtttattttgtttcgcatatttttttgactgcccggcggcaggtttcggtaaggatggcggcaaatcgggcttcgtctgccggtttgccgtcgaaaaaaataaaatcgtaaagggtgatgccgttttcggaatggcggtaatgcctgcccgggcattcgccgtctgtctgcctgtggattttggcaatcaggcggggatagcggcaatgggtaatgaaacggcttgcgccgtcttgcccgataatccattcggggtagcggttgaatagtgcggctctgttcattttgttcgtgggataaagcccctcgcggggcttgtggtcaggcaaatttgaatatcagtgccaacacggcggcgatggcggtaaccagcccggtggccgctatcatgggataccagcgggactcttgggctatttttacggattcggcgttgattttgtgcgcgtcggcaatgattttggcgatttcggcatctatttttctcagactggagtgtttcatttcttgttcgattatgttcatcgtacttcctttcgtttttggcggttgccgccgcttgtcggatggtaggatgtctgccatgtgtatatattgataccttttaggttttattgcaagtgttttgggcggcggcttcgtatgcttggcggtggcggcggctgtaccattcggcgagttcgcgccgctcttggaggcggtagctgtcggcggtcaggtagtggtgcaggcttgagaagccggcgcgttggagggcggcgcggctgatgtggccgagggcgaggtctgttgtgagggtgtcttttccggcggtcaggctgatgttggtgaagaggtggcggaatccgtgcattgtgtgtttggatttgccgggggtgctgccgtcatagcccagtcgtcggatggcgttgtgggcgaatttgatgctgatgtggtcgggatggggggcgggtttgcgccgtgggcggatgccggggaaaaggtggatgttgtcgccggtctgtgtgtgcagctctcggagtatttctaccgcccagtccgacagtaggacggtaaaggggtgtttggtcttcatgtcggcggcggggatgtgccataaccgggcggtgaggtcgatgtcttgccagcgggcggaaagcagtgcggacggacgggatgacttccccggtttccccatcaatccgcgccgcctcgatttttccgttggcgcgcagcatttccaccgcctgccgcaccgacatcaaccgcttgccgttgcgcctcatcgcctccaccaaaaccgccgaaatcaatttggcttcttccggtttaagctccgtcttgcccgcatcgctgcgccgtttgcgcgtcggcttgacgctgaccgcctccagcttgcggtatagcgtggcaaggctgatgcccaattcctgcgcctgctgcttaagatatgcagagcgtgcgccgcgttccattgcttccgcctgattctcgactgccttaagacgctcaatcattgccggattcatcgccttctcccgtttcaccgcccaaccattccggcacattgtctgtcggtgcttcagtcggcagggcatagctttcgcgcagttgctcgcagtccaaaataatttgattgagcgtgccgaccatctttgcctgatggctgatcccgtgtgcctcactgtgcgcattaagttggtcgaacaaatctttcagacggctcacttgactgcggataccgacctcaaggcttgttaactgcatcgccaactcgctgcctacgtcttccgccttcggctctctgacaacggtttgcttcttagccagcttctcggccagctcatcaattttggctgttttggttttcatcacttcgtctttggcggcgaggttttcgcggctttcgcgcagggcgacgcgcagctcgcgcaccgtcattcggtccacatcgtcaaaggtcatgccgttgacttcttccccttcggccaaacccaccagcgtaacgtcttcttcgaccagcagctcaagcagcttcgacttgcccaaatccatcagcttcggcgcggctttctgcatttgcggggtcgcaaagcggcgagtggctgacatcagacgtgatgtttctgcgatacccagcccaaattggcttttcacaatttccataaaccgtccgtgttccgtatgctcttttaaaataatcagcgcacgtcccagttcgaacatgccttccatcgtctgccgtactgcttgacgaccgcgttcaacccaacgctcttcgctataagtctcgccgttaccccactgctccatcaccagcacactgcgcatcgctgcctgattgcttactttgtcggttgcgataatttcaatttctgtattcattttttatctccaaagtttccgacgtcggaaactttcaaaatccgttaatccacatcgacccgcttgccgatttcggcaatcttgctttgcagccgttcatgctgctgcctgaaccgctctgcgatttgcagggttttgatgccgtaggcgtagttgccgttttcaagtttgatgaccaatcccgaggcaaccaaatcatcaatatccctgctgacttgcgatggcgtcagccccagtccgaccgataaatccttattgctcagaccgataatcggatgctcgtcaagcgcgataaagaccctcaatagccgttgtacccttttactttctgccatccgcatcctccttatttcagtcccagcttcttggcaatttcgtgccccttgccgtaattgcctttgcgctgtccgccgatcaccagatacacatcgcgcggcttaaagccgttctctcttgcccactgcgccagcgtctggccgtttttggcaaaattttctttcaattcgtctgccgtaagcatttctttggcctgtacgcgggaaaatttcagtatccgtccgtacggttggttaatacactcatgattaatcatcgcttttctccttcatccccagcaaaaccgccgcttcgtggcttttgccaaaattgcctttcagcttgccgcgcaagaggtgctccaccgtggtgcgctccagattgaaatatttcgcccaatgcgccttgcacaccccgttgcgcttaaaccacccggccgcgctctcgcgcgtttgcggataggaaataggcttgaaattcaaaggtttttccatattatttatgcctttcgtgtgatataatgtgtttgtttttaggtctctttgcacgataaacatccggtctgttgtgcagcagcagggtcttggcttgttttaaagtaaacaagctttttctcgtagctgggtgtatgtgatccatcatgagctgtcgcgcatgagccttcaaagtgttcattttttcgtcctttctcgtgatgatttagggtgtttgtgtttcgatgtggaaattataggaagaattcttcctattttgcaaggaatatttatgaataactcttccttttttggcaaccgattgaaagaagaaagaaaaaaattaaaaatgactcaagctgaaatcgctgaaaaatgtggggtttcaggaagaatgtggggggattatgaacgtggcatcagccagccaaaagcggaacttttcttccaatttgaaaaggtgggtatagacgttcaatacgtcatgcacggcagacgcggcgaaacagcggtcatgccgtctgaaaccctgaacgccgaagaacaagaactgctggtcttgttccgcgaggcggcagctgccgaccgtgaaatgattctgatggttgcgcgcagggcagagaaaaaagcccaaactgcgcttggtaaagtgagtaatggataaaatggatcaattcgaattgtgccaaaaagaacatgtcaatccatttgccttgtcaaagcaatatctattggttgtaacattcgtcaaatccagcagtaaaaattttcaggcagcattactttgggcaagaagtgccaaattatttgagaatcttgagattggaaaagaaaccatctattgctgcgctttcgataaaacagcagaacaggctgggatggccggggtatttttgaattatattgaaaattggaatggcaaacagatttacatcaatggccgaatccatagtggcagtatttatgatttgttaggggttttagactgctatcaaaaatcacagtcctgtcccaaccctaaaagccactgttgctttgtttcagacgacatttttctatggcatggatcaagaccaacgtttgaaatcagtcttgatctaactggaaagaaaaaagaaacatcctctgcaaagaaatttgtgatgccttgtattaatttccgtcaccataggattgaaaaagaaacctacttaggaaattggaatgaacaaattgccgcattggcagtaaaacaaaatatagattggtgtccaagttttgatattgagaattttagacagtatgaataattactatctatataggaattgcagcagcgatgtgttatgggtcaaacgtatccaacgccaaatcgacggcagcctactcttgatttctgacaattcaacctatccacccatgcccttggcactggcggaacaccccgatattcaaatcatcgggcaggtagtgcaggtatcaaaagacttgaactagacacaatcaaaaagggaaatagaatgaaaatactcgctttattaattgccgctacctgtgctttatctgcgtgtggcagccaatctgaagaacaaccggcatctgcacaaccccaagagcaggcacaatccgaattaaaaaccatgccggtaagctataccgactatcaatcagcagccaataaagggctgaatgaccaaaaaaccggtctgacccttcctgaacatgttgtccctatcgacaatgcggaaggaaagaatctgctgcatgacttttcagacggcctcacaatcttaaccgttgataccgataaagccgacaaaattactgctgtccgagtagtctggaatacagatgcaatgcctcaaaaagcggaaaaactgtccaaagctgccgcagccttgattgcggcaaccgctccggaagaccgcacaatgctgcgtgataccggcgaccaaatcgaaatggcgattgacagccataatgcgcaaaaagagccaacccgagaatgggcgcgtggtgggattgcttataaagtcactgttaccaatttaccgagcgtggttttgacggcaaaagctgagtaaatctattaagtagaaaaaatagaaagggaaatgatgattgagaaaagtatttctattgtagatggaaaggaatactccgtttttgctgtatcacacgagtttcgttatacctttgatgagcctattttagtcgctgacttgattagttctctaaaagcttatgaaacactgacaagtagttatcttccagcaattttgaatcagctgtttgatgtcaaaatccaaaaaatcaaagtagctgtatctgaaattgaaagaggatctttccttgaaaaactgattttcaatttattcttcaaagatgaagatgcttataatgaattttgtcttaaaatacgaaaatttctaggaacagaaaatcaggacggaagtattaatatgtccaaaatcattatgtttgcaatgactacacttttaggggtaggtgctggttatctcttgtttaaaaacccgccacaagagaagcaggcaataaccaacaacatcgttaccgtcattaatgctgatagttctgtcgcactggatggtgaacatttggtttcagtggtaaaagaagtaacaggaagcagcaagcaaaaaactgcagaaaatgtggcaaaagtatatgctccagcaagtaaaaataatggcagtattacccttgggacagatgatgttcggattgaacctgttgcacaacaaactgtagcaactttgcctaaagatgtggacttacgtgatacgccattgactgaagattacaccgatattgatgtgcaaattcgtgctactgaccgtgataaaaattcagggtggtatgcagtcatagaccaaattgttccatcacgtgttcgattagaactgcctgaagatattgatttgaataggctggctaacaatgctactatccgtgcaaatgtaacagttgagtttgacttaaagcaaaatggctctcgtaagcctaaaaaaatcatcctcacatctctctctactgattaagttttaacccgtattaaaggcttagtcagacggcctttcctacaatccctgtattgatttttaattcaatacagggatttttccatgtcagacaagttcaaccaattcatcaaccgcgtcctctctcacgagggtggttacgccaaccatcccaaagaccccggcggcgaaaccaattggggcatcactaagcgcaccgcacaggcaaacggctacaacggctccatgcgtgccatgacgcgtgaacaggcaatcagcatttaccgtaaagcgttttgggagcgttaccgcgccgaccaaatgccggaagcggtcgcgttccaattttttgatgcctgcgtcaaccacggttacggcaatgccgcccgtatgctgcaacgcgccgcaggcgtaccggacgacggcgttatcggagcagtcagcctcaaagccatcaattcccttcccgaaaacgaccttttattgcggttcaacgccgagcgtctggtcttttataccaagctcggtacgttcacctctttcggcaagggctgggtacgccgtgtggcgcaaaacctgattcacgcgtctgcagataacactgattaaagggagataaaccatgtcaaaaaagtcactcatcgccctaatgaccgcagccatgcagcccgatttcagccacagcgacctaggcattcgctacgccatgccgactcagggatgttggacgcaagcccaccgcaagagcggggtagccgccgcgaaacgcgcagccaaaaaaaagcgtcacaaataaccgcctttttccgatggctgggcggcttggtctctaatccggccacaggaaaaatcagccataccaaactatgggcaaacgtcgccgcagccgccatgacttggaagttcgtgcaggcggcggacgcgcccgaatggctctagtgggcttatggcgcattggtcggcgggtatgcattaatcaaacgcggcatcgcggcgattccgcagttggcagaaatcaaaaaatccgcaaatcaggaaggggggcggcaatgattgaatttgtccgagccaaaaaacggctgctttgggcatttgtgcttttgcttgtgtggacgtgcggttaccgatacgccgccgacaaggccgaagcgaaacaaaccgccctgattgccacctatcggcattcttctatggttgcggcggaacaatatgccttgcagcttaaaaaagcgcaggacgaaaggcagcggtggtacgacttttcccaaaaacaaggaagaaagcccgtgaaaaaacagtatccgccgcaaacgaaaaaagccggctatctgaaaaccaaggaagaactgcttgcggaattggcttgccttaaagcggaaatggttgccctaaaaaagcccgatgccttaatccatgggaaagaagtgcggcagaaagaacgcaactcgtcgcagggttaaggcaatgccatccgttgaactgctgttggagattgtccttctattaccaattggccgtccaatcggcagaagacaaatatgccgatttgaaacggcatatccatgatatttatcgacgacataagggaagatacggctaccggaggattgcggcagccatccgtcacgcaggaacaccggtcaatcacaagaaagtcagccgtctgatggcgaagacggggctgaaggcagtgatacggcggcgcaaataccgctcgttcaaaggagaagtcggcaaaattgcgccgaatatcctgcgacgctgtttccatgcagaaaagccgaatgagaaatgggtaacggacgttaccgagttcaatgtaggcggagaaaagatatacctttctccgattatggatttgtttaacggggaaatcgtcagttaccgtattcaaatccgcccgactttcgatttggccggcgagatactgaaaggtgcgccggagaaaccgggatcgtctgaaaagccgatactgcattcggatcaaggttggcaatatcagatgttttttatcaaaagcagttgaaaggcaacggtctggttcagagtatgtcccgcaagggaaactgcttggacaatgcggcaatggaaagtttcttcggaacgttgaaatcggaatgtttccatacgtgcaaatatgattccgttaccgaatcgtaagcggcactgcacgaatatatccgttactacaacaacgatagaatcaagttgaaattaaaaggactgagccctgttcagtacagaactcagtccctgaaagccgcttgattaaactgtccgactttttggggtcagttcggcttcggcatttttttatccgttttgggggtaacttgtttggaaagctgcaagcttataaataaaggattacatttaagttttgggtaacctttttaaaaaaatgcgtgatgacttttgcatttttaaggcgttttttggggtaattcgtgaaaagttaccccaaaagttaccccataaatggcgaaaactcaagcatacgccagcatcctgcaacacaaaaaagccttgaaactgttgaagttcaaggcttttttgtgttgcaggatgctgctgaaaatagggtatggtggaggcggggggaatcgaacccccgtccgaaagtcctctacaaagcgttctacatacttagttgtgtctatttgaaaatcttatttccatcatgccgaccaacaggccttttggaaaccagttaccttaagtcttatttcctgccaagtaacccggtaggaaaccagtcaatgtaagatgacgttgcggtggctttcgccacacagcccattgaccgactgctgcaacggctagccttaagcggctaaagcgtaagtttcgtcgtttgcgactatttgaattcagtgttttacgggaatctgagaccccggtatgcccgcatctgcttcgcaaccctcgtcgaaaccaaggtcgcccccagaaatggtttgcaaattatacggatattgtgcggtgctgccaagtctgtcggagaaatttgtcagtcttgctgccttaatttgcgtttgagcaggatgcggacgcagccgtcgttgccttcccggggttcggcgtaggcgagtacgtcggggtgttgcatcagccagtttcgggtcatatttttcagaacgggtttgtagcctttggaacctaatccgctgccgtggatgatttcgccgcatacgccgcgtttttgggtgaatgcgatgaattcgttgaggactttttgggcttcttcctgtgtgtagccgtgcaggtcgacatcggtaacgacgggatagtatccgtttttcaggcgttggatgtcgttttttccctgtccgtttttgctgaagctggcgggcgggtcgttgtatgtgctgccgatgtagaagtagttttcttcgtcggcgcggttgtctttgggacggactttgatgggggttttgtcgggcggcgcataatattgctgccggttttttaatggggagagttgtccgactgcttgtgaaaaatcgaaatcctgttcttgtttttgcttgtttttttcggctgcctgtttttctgccgcttctttttgggcttgtttgcccagttgtttgaggatgttttggaagtcggtattcatattttttcctgttatttgtccgatggctgtttcgggcggggttttaatttgccggaatgtttgccaatcgggggaggatgattttgttgcctgcgtatgttttttgaaagtgtgattgtatatcaaaaagaaatgcggcaaccgtcggcagtgttgattgccggaaatgcggaccggtcgaaccgatatgcccgaacgcctgataaagttttaaaaacctgccttgcgaagcaggctgacgtgttttgccaatcttgaattgccggaaacgcgaaacacggaaatctgatgttttatagtggattaacaaaaatcaggacaaggcgacgaagccgcagacagtacagatagtacggaaccgattcacttggtgcttcagcaccttagagaatcgttctctttgagctaaggcgagaacgctgtactggtttttgttaatccactataaatgttccgatacgaactgcaaaatattggttttgtttctgacaggcaaaagcactgtttatttggctgtcaaaaggatggttaaggaaagttatgcgcccctgaagcgggccccagataaggatggttgcgccgacggcttcagacggcattttggcggcggtgttgggttttgtatccggtttgccgttgtgttttgtgatgatgattttgggcgcggtttttctgttttgatgtgtgaaatgccgtctgaaaggcggttcagacggcatagcggtcatttttgtgcggtcaggcggtcgaatatgccgccgtcggcgaagtaggttttcatgatgttgtcccatccgccgaattttttttcgggagagaaggtgtctaagtctgggaagtcggctttgtgtcttgccaatacttcggggttgcgggggcgcaggtagagtgaggcggcgagttcttgcgccggttcgctccaaaggtattcgagataggcgcgggcggttttttgcgtgccttttttcgcgacgacgctgttgacgacggcgacggggctttcggcggaaatggtgtagctcggatagacgatttcaaactgtccttgggtcagttttttgctgacgtagttggcttcgttttcaaaagtgatgagtacgtcgccgatgttgcgttgtgtgaaggtggtggtggcggcgcgtccgccgttttcaaaaacgggggtgtttttgaggatggatgcgacgagtttttgggcttcctgttcgttgccgttggtggttttcagaccgtaaccgtatgcgccgaggaaggcgtagcgtccgttgcccgaggttttgggattggcgatgacgatgttaacgccgtctttggcaaggtcgttccaatcgcggatctgtttggggttgttttttcggacaaggaaaaccatagtgctggtgtagggcgcggcgtggtcggggagggcttgttgccagcctttttctaccagtccttttttttcgagcaggtcgatgtcggaggattggttcatggttacgacatcggcttgaaggccgttggctacggataatgcctgtttgctggagccgccgtgggactgttggatgctgacggatgtgccggggtgttcggattggtatgttttgataaataaggggttgtattctttgtaaaaatcccgtgccacatcgtatgaggcgttgagcagggtaatgttttttccgtcggattcggtattggccggggcattttgtccggacggatggtttgaatcggctgcggggctgcaggcggtgagcagggctgcggtatagagtgccggtgcgtaggttttcatatgcttgtcctgtcggttggtagatggggcaactttatacggctgtctgcgcttgtggaaataatgtttgatttgaagattatcagttttggttataaggacggatcagaggtgtttccgcatcagttcgcatttgattttgatgctggggtcaagctgcaatactgccgaaccgagcgattcgtagcggttgagaaggtaaaacgggacggagttgagcgatgcgtagagtttcagaaagctcaaaccggatttgtgggcgatggtttccgcctgatgaagtagggcagtgcccagtccgaggttgtggaacagggggtggacgtaaagtgcatcgagttgtgcttcttggcagtcgatttggaaaaatccctgtatgttgcctttgtattcggcaacccaaagtgctttgtcgggatcggaaatggtcggcaggtagctttctgtgtttagcaagccttcccatacttttagggcgtgttcgttgtagctgaggatgcaggtgtattggacggagtgcaggtggactttgaagatgtctttgcagtcttgcacggtggcggggcgtaacagtgtcagcaggctcatggcggtatgtcggcggcttcagacggcatctgtgccgttggtcggattatagggactgatgcagtttttttgcttcttgaaatgcggtgtccgaatcggtggttaaaacggtaaagtgtcccattttccgccctttgtgcgcggtttttttgccgtaaaggtgcaggtgtgcattcggatggctttgcaagggcagccaatccggttcgccgccgtcttcctgccaaacgtcgcccaaaatatttgccatacagcaagaactcagtaatttggtatcggcaggcggcaggttgcacataatgcgtacctgctgctggaactggtctgctgcgcaggcatctatcgtatggtgtccggaattgtgcgggcgcggggcgatttcgttgacgaccaattcatgcgtgtcaccgacaacaaacatttctaccgccaatacgccgacataatccaattcgtccgccaagcgttgcgccatctgccgcgcctgttgctgcacgtcggcactcagtcgcgcggggacgatggaataagccaagatgccgttttcgtggatgttttcggcagggtcgaaagtttgcacgttgtcattgttcaaacggcatacgattacggaaatttcactgcgcaaatccaccattttttccaaaacgcaatccacgccgccgtgttcggcaaacgcggctttgagttcatccaatgtttttacgcggatttgacctttgccgtcgtagcccaacgtagccgttttcaggatgccgggcaaaaattgcgcgcttgcttcagtgatgtcttcagccttacaaaccacttgatacggcgcggtttgcaatcccgctttgcgtatccatgccttttcctgaatgcggttttgtgcaatcgccacacaatcgccgctaggggaaacattggtatgttttgccaaaaagcgcatcgcatcggcattgacgttttcaaattcagtggtcaccgccgcgcattttgccaattcgtccaaagcagcttggtcgttaaacggcgcgcacaaatggcggtcggcaaattctgctgccggcgcgtccggatcggggtcgagaacggttactttgtagcccatggttttggcggcaacggtaaacattctgcctaattgtccgccgccgaggatgccaagcatggcgggcggagaaagagatatgtttttcatgctgactcttcaaattgtacaagttgatagctataactaattcttgacggatgtcttgtatcgctggaattaccagtttcagaaatacagaatactttttccataaatttttctgcttttagaaattccagtattctgtttttttcatccttataagcaccgcggtctgtaccccatgcaagaataatcatatcagcatcttccaaacatcctttaaatttggaaaaatcggtttgggtgtttgccctaattcctgtttgctgtgtagagtaactggaaaaaatatttaacattttgaagttggtaaaaccgtacatatccaagaaacgtgcaagttgggtaagggttttgtcgcttctttcatcatttgctttacttggattaattcctatagcgacagctgagaaatttttaggattttctgtgttgccgctccatctaaccgttaggatttctcgatttttttcattatctgtatagagaccgtctttggtagtcggtctgagtgtttggcgaagctcataaagtttttcataagtcatttatccaacccttcctgtaccatttgcgcggcgtgtatgacggctcgggctttgttttgtgtttcctgccattcggaggccggatcggagtcggcaaccacgcccgcgccgctttggacgtatagcgtgttgttttttactacggcggtgcggatggcgattgccaaatccatgtcgttgttgaaaccccatacgccgacggcaccgccgtagatgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgataacgtcgttgcgttcgcgtcggacgaggatttcgggcgaggagccgacgatgtggaaatcgccgaaatcgtagtaaaagagataaggcgaagggttgagcgtacgcagggcgcggtagagggcgagcgggctgtcggtgaattccatgctcatgcgctggctggggacaacctgcatgcagtcgcctgcgaagatgtagtctttgattttgttaacgcaggctttgaacggctcttcgccgaattcgctgacggcttcggtgtgtttgctgccgagcgagagcgggatggcgcagctttggcgcaactgggtgcggatgtcttcgaggcgttcgcgggcgcgttcgtagccgtcgggctgcgacggatcggcgtaaacgacgagatggattttgccgctcaaattgtcgatcaccgccaattcttgcgacagcatcagcaagatgtcgggcgtgccgagcgggtcggctttggtggtgtttttcaggcggtgggcgaagtgttcaaaattgtagatggtttcgtaaccgaagtagccgaccagtccgccggtaaagcgcggcaggcttgggatttcgggtgttttgaagcggttgtggaaggcttcgataaagggcagggggttgccgtcgtgttgctcgacaatttcgccgttttgataaacatcgacgtgtttgccgctggctttgagatagtggctgcaaggcaggccgataaaagaatagcggccgaaacgttcgccaccgacaacggattcgagcaggtaggtataggggcggttggcgagtttgagatagagggaaagcggcgtatccaaatcggcaaggagttcttgcacgagcgggatgcggttgtagccttgggcggcttgggcttggtattcttgtttgctgatcatttctgctttcccaaagggcggtttcggacggcgcggcaacgggcgcgagtatagcattttatcggaattgttgacagtctgaccggagatgcccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacgccaaacgggcttcagacggcatttttgacggcggaggtctatgagccgcaggttttcggcttgttcgccagaatattgatgactttgcgttcggctttttgcggctcgattttgatttcgctctcgtcttcttcgctgccgtctgaaaaacgttcgggcattttttcgctgtcaaacgccaaatcgccgccgtgtttcaggctttgaccgcgttccaatccgacaaagtcgaagagttcggtatcggcaaggtgggaagggacgacgttttgcagggcggagaacatcgattcgatgcggccggggaagcgtttgtcccaatcgcgcagcatatcgccgatgacttggcgttgcaggttgggttgcgagccgcagaggttgcacgggatgatggggaattgttttaattcggcgtatttgattaagtctttttctttcacatacgccagcgggcggatgacgatgtgttcgccgttgtcgctcaccagcttgggcggcatggctttgagtttgccgccgtaaaacatatttaaaaacaaggtggcgaggatgtcgtcgcggtggtgtcccaaggcgattttggtgcagcccaattcttttgcagtgcggtagaggatgccgcggcgcaggcggctgcacagcgaacaagtcgttttgccttcgtctaatacgcgtttgacggtggagtaggtgtcttcttcaacgattttgtagggaacgccgatgctttcgagataggtcggcaatacttcttcggggaagcccggctgcttttggtcgagattgacggcaaccagttggaaatcaatcggcgcgctggcttggagctggcgcaggatgtctaacagggcatagctgtctttgccgccggagaggcagaccatgattttgtcgtccggctcgatcatattgaaatcgttaatcgcgtcgccgacggcgtggcgcaggcgtttgctgagtttgttgttttcgagttcttgtttggtttttttggacatggcggtttgggtttgaaaattagaaaggcggcattgtaaccgattggcggggcggcaatgccgtctgaagggcttcagacggcatcggcggcttattctgcattttcggttttaaagaagagatgaaccgctttgaagataccgccgtttgggacggtcagtgttttttgtgcggcggagaatttaatcacggtaagggcggtaaagttttccgaatcttgaacgctgtcgagtacgatgccggcctcttcgccgtccgccgtcagcagggttcctgcttcgacggccgaatttcccgacaataccgccaagccgcgtttgacctgcccccgatactgggcacgggcaatgatttcctgtcccggatagcagccttttttgaagtgtacgccgccgatgatgtgctggttgagcatttgggcgacggcggtttctttggtagccgcgcatatccacggataaccgctacggatttcgtgcagccgccacgcgttttcggcggcggcatcataaggcggcaaggcgtttttgggggcgatgtgcaaaatgccccgatgtggcaggacgacggaacagatgccgtctgaaccgcattcggcggtaaaggcgaggctgggttcttgcgcggcaagcggttcggcggatgcttctaattccgcgccgacggcgtaatcttcaaggatttcaaaaacggctttggcgcgtaacacaaacatccgcaaacgtttgaccgttgcttcaagcaggtcttgcgccataatcagcagcaaatcgccgcctcggttgacgacaatcatattggcgatgacgcggcctttgggcgtgttgtaagtcgcataacacgcctgcccggtctgaaggtggttgatgtcgttggaaagctgtccgtgcaggaaggtttggcggtcttcgccgctgacgcgcaccacgccgaaaaagggcagtaaggttttcatcatttgcgtactctgaaatataaaggaaatctgtttatgcagttgccgcgtctctcttcacggcggttattttgatttcgacgcgccactccggacgggcgagccgtgcttccacgcaggcgcgggcgggcgttctgccggcggcaacccaagcgtcccacacgccgttcatttccgcatagtcgcccatatcgcgcagatagatgaccgcatccaaaacgtgcgctttgtccgagccgcattccgccagccagcggtcgatttgggcaagcacgtcggcagtctgttcggcagccgtttcaccgttttcgggaaccatgccggagaggaaaatcaagccgtttgcgccgacggcttcggaatagcggggcgttgtgccgaaatatcggatatccatatcggtttccttcgataaaggggatatatggtaacattgcgcttgaccgatttccatgttttgcatgacgaaaaatgagtaaacacacttatccgataacacctgccgtgcgcgttttgcgtgaaaacggcatcgaatttgaaccttttacctatgcctatgaggaacacggcggcacggcgcagtttgcccgactattcggcaaagacgaacacttggtcattaaaaccattgttttgcaagatgaaaacggtaaggggctgattgtcttgatgcacggcgacaagcagatttcaacccgcaatctggcgcggcatttgggtgcgaaacacatcgaacccgccacgcccgtacaggcaaacaagtggacgggctatctggtcggcggcacaacgccgttcggcatccggacaaagttggatatttacgtcgaacagtcggtgatggatttggaaaccatctatatcaacggcggaaaacgcgggttcattatcggcatccgtcccggagatttaaatattttgaacccgaaaacaatacaggcggcggtttgacgggaaagtataaaggaacaatatggacaaagatttgtatgccgtattgggcgtgtcgccgcaggcgggagcggacgaaatcaaacgcgcctaccgcaagctggcgatgaaatatcatcccgaccgcaatccgggcaatccgaaggcggaagaaaagttcaaagaaatccaacgggcttacgatacgctttccgacctgtcgaaacggatgcaatacgacgcgtccttcagacggcatgaggaacgcgggcggcaggaagaggcattccgccgcgaacaggcgcgcagggagcagttttaccgcgaacagatgcgccgcgaacaggcgttcagacaggcgtttgaacggcaggcatcacgttcgtgccatacttacgaaccgtccggcggcggaagcgggcgcaactatgtcctcgccgcctacatcctgttcggtttgggtgcaatcatgctgttcatgcccatagtcggcgtgattttcgcctatatgcccatagtcggcgtgattctcgcctatatgaaacggaacagtttggacagcattgtctatgccgcacataccgaatacctgattaaaaccttttggcgcacattttggctttatattttgggtgcgctgactgcccttttgggtatcggcgtgctgattattattgcaacgaacgtctggtatttctaccgcatcatcgccggctttatccgcttcaacggcggcagggcggttgcacccgagaaatggatatagtatggcttacctgttaatcagcatcgtgttcagcgtgtcggtttccattttgctgaaaatggcaaggaagaaaaaaatcgacatcgcgcaggcggtcgccgtcaattatgtggtcgcggtcatactgaccctgctggtattgaagccggatatcggcaatatcggcgcatttttgccgacgtggccgctgtttgccgctttgggcgtgctgctgccgtccgtattcgtgataatgggcaaatctgtggaagccgccggtatcgtcaaatccgacgcggcgcagcgtttgtcgctgtttttgccgattgttgccgccttgacgctgtttggcgaaaaactcagcgaaggcaaactaatcgggctgtgcctcgcatttgccgcactgttctgcctgctttggaaacacagcggtggcaaaaaatcaggaagcgcgtggcggcaggcggcattgctgctgggcgtgtgggcaggttacggcattatcgatatcctgttcaaacagcttgccaaaagcggaacggcatttgcgggcaacctgctggttgcatttgtgctggcgggtgtgctgatgtttgcctgcctgtttgccaaatcggtcagatggcgtgttgagagtgtggtcggcggcatattcttgggcggtttgaattttatgaatatcgtaacctacatcaccgcgcaccaaatgatgaaggataatccgaccttggtttttgccggtatgaatatcggcgtgattgttttgggtacgctttcgggcgcattgttctttaaggaaaaaatcaacacaatcaatacggcgggaatcgtgttggcactgtgttctatcgcctgcctgttttattggggggaagtcaaggtactgttcggcatataatccggctgattgatataacaaaatgccgtctgaagcagcatccctgcttcagacggcatttgtctgcaacgttacagatgggggttcatcaggttctcgggagagaggatgcggttgagttcttcttcgctcaacagcccgcgttccaagacaacctcgcgcacgcctttgccggtttgggcgcagattttgccgaccaaatcgccgttgtggtgtccgatatacggattcagataagtcaccaaaccgatggagttgaaaacgtaacgttcgcagatttcgcggttgaccgtaatgcctttgacgcatttgtcggacaggttgactgcggcattgcccaagagggaaatggtttcaaacatacattgggcgatgaccggctccatcacgtttaattgcagttgcccggcttcggcggcgaaggtaatcgtcgtgtcgttgccgatgactttgaagcagacttggttgaccacttcgggaatcacgggattgactttggcgggcattatggaagaaccggcctgcaattcgggcaggttgatttctttcaagccggcacgcgggccggaagagagcaggcgcaagtcgttgcagattttggagagtttgaccgccgtgcgcttcaatgcgccgtgtaccatcacatatgcgccgcagtcggaggtcgcctcaatcaggttttcggtcagtttgcaaggcaagccgctgacttcggagagttttttgaccaccagttcggcgtagcctttgggcgtgttcacgcccgtgccgattgccgttgcgcccaaattgacttccaacagcagttggcgggtgcggtcgaggttgaggatttcttcttccaacaacacttggaaagattggaattcttggccggcagtcatcggcacggcatcttgaagctgggtgcggcccattttcaaaacgtctttaaattcttcggctttggcggcaaaggcgtttttcaggacagtcagtttgtcgagcaattcgccgatgctgtaatacacggcaaggcggaagcccgtgggataggcatcgttggtcgattggctggcattgacgtgatccatcggattgacgatgtcgtagcggcctttttcgtatcccaagacttccaatgcgaggttggcgatgacttcgttggtgttcatattgaccgaagtacccgcaccgccctgatacacgtcggacgggaattggtcgaggcagcggttgttcagcagaacttcgtcgcaggctttttcaatggcggcggcgatttcgggcttgaccgcgcccaactcaccgtttgcctgtgccgtcgcctttttcaccatcaccatactgcggacaaactgcggcacgtcagaaattttttgtgtggagattttaaagttttcaatggcgcgcagggtgtggatgccccaatacacttcggcgggaatctcgcggtcgcccaataaatcgtgttcgatacggacagtcatgtttttacctttgtaagtcggataattaatattgaaaaaatgcgccatcggaaagatgccgccgcaggatgaacactataccggccggatgaaattgtccatatcgtatgccgtctgaaaacgggaaacgttgttttcgggtgttatagtggattaacaaaaatcaggacaaggcgacgaagccgcagacagtacaaatagtacggaaccgattcacttggtgcttcagcaccttagagaatcgttctctttgagctaaggcgagccaacgccgtactggtttttgttaatccactatactttccggactttccggcaagccctgcctgccgctgaaatatctttcggcggattgtgctccgccatatcggcttaccgttggcggggcggtttgatgaagacggcacaaatgccgtttgaaggacgttcagacggcatttgtgctgattcgcatcaagatttattgtttggctgcctcgatttggatgtcgatgcggacgcttttggtcataccaacgttaacgaggtagtccatgccccatttggtgcggtcgatggtggtgctgaagtcgccgccacaaacttcggttttctccatcgggctttggtagcagttgaatttttcggctttgagtttgacgggggcggttttgccgtgcatggtcaggttgccgtcaacggaaaccagttttttgccgttgaagttgaatttggtggaaacaaagcggatgtccggatattgggcggcatcgaagatgtcggctgatttcaggtggtcggtaaagtgttgcgaaccgctttgcaggttggcaatggggatggtgatgtcgattttaccgtcgcgttttgcttggtcgaactcgacggaaccggtcagaccgtaaaaaccgccgacgttggtgctggtgttgaaatggtcgatggcgaaacgggcgttggcgtgatattcgtccactttgtaggtggcggcggaggcagtactgatggcggcggctgcgagtgcggcgaagatgatttttttcatgatgataatcctttgtgtgggccggtaaaggcgtttatcctaacataggcagggatttatggcatttcctgccggtaaacggtgggtttgcaggcggttgacgaacggggcgggcggaaaagggcggatgaaaaagcgcggtgtgatccgcgctttgtttttttacaaggcggcgagtaccgcatcgcccatttcggagcaggaaacgagttttgtgccttcttcgtaaatgtcgctggtacgcaagccttgttgcagcactttttggacggcgttttcaacttgttgcgcgcgcgcttcgtcgttcaggctgtaacgcagcaacattgcgagcgagaggatggtggccagcgggttggctttgttttgtccggcgatgtcgggggcggagccgtgagacggttcgtacaggcctttgccgttttcgtccagcgaggcggaaggcagcataccgatggagccggtcagcatggaggcttcgtcggagagaatgtcgccgaagatgttgccggtggcaatgacgtcgaattgtttgggcgcacgcacgagctgcatggcggcgttgtcgacgtacatatgggaaagctcgacatcagggtactctttgccgatttcttcaaagatttcgcgccacaattcggtggtttccaaaacgttggctttgcctacggaacagacttttttgctgcgtttttgggcggattggaaggcaacatgggcaatacggcggatttcgctttcgctgtatttcatggtgttgtagccttcgcgttcgccgttttccagaacgcggatgccgcgcggttcgccgaaatagatgtcgccggtgagttcgcgcacaatcaaaatatccaaaccggcaacgatttcaggcttcagcgtggaggcgttggctaattcgggatataaaacagcaggacgcaaattggcaaacaggttcaaatccttacggattgccaacaggccgcgctcagggcgcaacggacggtcgaggttgtcgtattgaggagaaccgactgcaccaagcaggacggcatcggctttgcggcagaggttttgcgtaaattcgggataaggatgaccgtattcgtcataggcttcgccgcccaatggggcgtattcgtagccggcatccaaaccttgggcgatgagtttgtcgagtacgcggacggtttcggcgacgatttcgggaccgatgccgtcacctcggaggatggcgatatgtttggtcatttcaagtttccttatgggttgatggttgaagggttatttctttttgtatttgtgtgcaatttcgtgccaacgaggtatggaaatcgatcggttgtagtgttttttataggcttcctcaaatttctttttccataaggatgcgttatgccgtgttgccgggttttgataaacggtttcttcaattgcggaaacaaaatcttccaagcattcaaacataggcatattctttttatttatgctgtaccaaacacccgggcggattttatgcaccacgccttttttgacttgaagattaattgcccacccatccatgcttctcgtaatttgccatacttttttaagccataaatccttgatggttacattgccgttgtcgtccatatcgtaaccgaatattaaatagtctacatccagcatatagggtttatgaatgatttcatcagaatacattttaaaatctgcaatatcaaaacccggactggcatttcggttgaacgcctttacttccaacaattctctactgcggtcttttttatttaaaaagaaatcggggggcatttgggtattggttgaaacatcaaattcaatttccctttttctcaaccatccgccgagccattcctgaatgatgttgccgacgacatctttttgtttgacgataatatccacatcgcccaagaaaaatctaatttgaccattgaccgataagattttttcctcattcagcaacttatcaaatatttgttgtgcagtaagttttaccattttatccctatcggtttataaagtatgcagaagcctttcagataccgccttaatcacaggaacggcaacggtattgcccaataaatcgtatttgtcttttttaggaatatcaaacgaataatcgtccggatagccgaataagcgtaaaccttcttttccggtaagtgtgcgcaaaccgccgttgtcaacgacgaaaaggtgctccatatccattgcaactaaggttggcgcaacatcatttgggtctaatattttattgatttcaaatgatttttttcctgaaacaatattgtagcctttgggcagggattcatctttgattcttcgcccgccaattttttgtttcggatgctccaaaaccaaatagcctttatctgtcaggctgtccaaaatattttgaagattggggtgtttatagaaagttgaaatttgcgcttttgtcaaaggcatcccatccatccaatcgatgccgatttctgaagcccattttttcttcctccgttcttttagaagcatatttaataattgcttctcttcttcggttactgtgccttttaattcaatatcccaactgtggatattgtttttccctccccgtttgtcctttactgattttccgtacagttcggacgggggaaatttctttagcaattttttgatgaaaggactgctttcggtaggcagtcccgattccaaaatattttttaatttcggacttagggttgtttcaaaagataagtcgggtttggatttcaaactgcctgtcagataaatacgcttcctgttttggggaatgccgaaatcttttgcatttaaaactttccaagaaacatagtagcccaatgtttccaaggtttccaaaataacggtcagggtgcgtcctattttttgtgtcggatcttttctatcgtgcgtcaccaatccttccacattttccaaaataaaaccttttggtttttttgcctttaaaatccttgccacatcaaagaaaagcgttccccgcgtatcttcaaagcccaatctttttccggcgaaagaaaaagcctggcaagggaagcctgccaacaagatgtcaaaatcgggaatatctcccgtttcaattttcgttatatctccatacggcacttcatcagggtagttttgcttcaatacttccaaagctgccggtttgatttctgaggtaaaaacacattcgcaagcaaccgactgtttccgacaggcttgttcaaatcctttcctgataccgctcatcccggaaaataagtcaataaatttaatttgttgcatattaaaaatctaaaaatttatttgaaatggagagttgcattattgcattaatttagagtgtcgctaagcccgcttaaaagatgaaagcaatttatcgcccctctgtttacattagccgcaacaattatatgttatcaggaatgccgtctgaacggccttcagacggtataggttttaaccgttaaacagccaaggctggctttggcggcgtttttcttcaaaggcgtgaatttcgtcggcgtgttgcagggtcagaccgatttcgtccaagccgtttaagaggcagtgtttgcggtgttcggtaatgtcaaatgtgaacgtttcgccgcttggtgtggtcagggtttgttcggcaaggtcgatggagagctgatagccttcgttggcttcaacttctttgaaaagtcggtcaacccgttcttcggtcaacacgataggtaaaaggccgtttttgtagcagttgttaaagaagatgtcggcgaagctgggggcgatgacggcgcggaagccgtagtcgtccaatgcccaaggggcgtgttcgcgtgaagagccgcaaccgaagtttttacgcgtcaacaggatttgcgcgccttggtaacgcggctggttcagcgagaaatcagggttcaacgggcgtttgctgttgtccatgcctggttcgccgtggtcgaggtaacgccattcgtcaaaggcattggggccgaagccgctgcgtttgatggattttaaaaattgtttggggatgatggcgtcggtatcgacgttgctgcggtcgagcggggcgacgatggcggtaattttggtaaaggctttcatgggtttgcgtcttgtgctgacgatgccgtctgaagcggtttcagacggcatcgcgaatcggttattcggtggcgttttcgatttttccgccgagatgggaaatgccgcgtccgacggcattgccgccttttttgacggcttctttggttttgtcccagcctttttcgacggcgttgcctgtttgttcggcggcgcgttcggcggcggcctgtgttttgtcaaggttgcgggcggtgtcttgtttcgcgccctcccaagtgccggcgcaggcggacaaggcgagggcggacagggcggtaatgaaaagtttgttcatggttaaactccttggtttgaatattaaaggtgtttctgccttacgggacatatttcagacggccgcgtcaaattcttaaagaccgcctgaaaatacttacgccatcatgcggatgtcggtaaagcggccggtaacggcggcggctgctgccatagcggggctgacgaggtgggtacgtccgccgttgccttgacggccttcaaagttacggttggaggtggaggcgcagcgttgccccggggtcaggcggtcggcgttcatggcgagacacatcgaacagcccggttcgcgccattcaaaaccggcttcgatgaaaattttgtccaagccttctttttcggcttgttctttaaccaaaccggagccggggacgattaacacgcgctgtacgttggcggcttttttgcggtctttggcgatggcggcggcttcgcgcaagtcttcgatgcggctgttggtgcaagagccgatgaatacgatgtcgacggggatttcgtttaatggcgtaccggcttccaagcccatgtattcaagggcgcgttccataccgctgcgtttgaccggatcggtttcttcggcaggattcggcactttgctgctgatgtctaaaaccatttcaggcgaggtaccccaagtgacttgcggttcgatgtcttcggcgttgaaacggtattctttgtcgaataccgcaccttcgtcagacaccagcgtacgccagtactcgacggctttgtcccacgcttcgccttcgggtgcgaagggtttatcttttacgtagtcgatggtggtttggtcgacggcaaccatgcctgagcgcgcgcctgcctcaatcgccatattgcataaagtcatgcggctttccatagaaaggctgcggatggcttcgccgccaaactcgatggcgtagcctgtaccgcctgccgtgccgatttgcccgatgatgtagagcgccacgtctttggcggtaacgcccgcttttaatttgccgtcaacggaaatcagcatggatttggattttttcgcggtaatacattgggtcgccatggtgtgctcgacttcggaagtgccgatgccgtgcgccagtgcgccgaatgcgccgtgggtggaagtgtgcgagtcgccgcagacgacggtcataccgggcagggtcgcgccttgttcggggcccataacgtgtacgatgccctgacctttgtccataaacggaaaataggcgagtgcgccaaactctttaatgtttttgtccaaagtatcgacttgcagcttggaaatcgggtcttggatgcctttgtcccaatcgccggtcggggtgttgtggtcggcggtggagacgacgctgtcgatgcgccacagcttgcgccccgccattttcaagccttcaaatgcctgagggctggtaacttcgtgcaccaaatggcggtcgatgtagagcaggacggtgccgtcttcttcttcgcggacgacgtggctgttccaaagtttgtcgtasagggtttgtgctgtcatgatgttgttcttttggataaatggtaatgcggattgggcggattttagacgtattctttataccgcgcaacagattttgtctaatttttgagtcggtgttattttgtaaacaattttaacaaaaaaattagacatattgtccatttcagtaagcagttatatctaaagcatgattcgatacgaaagaatacttgtcgtcattctttcaaaggcattatcatctgcatcttgtcaaaaaacacacagaggtagacgaaagatgaaattaccggtgatgtcgcccgaacattcggcgcaacttcaggcgtttgaggcaaaaatcctgtccaatcacgccaaaatcgaggcgtggttccgcacgcagtggagcgtacaccgcccgccgttttacggttcggtcgatatacgcaatgccggttacaaaatttcgtctatcgatatgaatttgttccccggcggcttcaataatctgaatcccaactttatcccgctggcggcggttgccgcgcaagatgcggtgcaacgcgcctgcgaaacggcgaaatccgtattgattattcctgaaaaccacacgcgcaatacgttttacctgcaaaacgtttacgccctcggcgagattttgcgttcggcagggtatgaagtgcgcttgggcagcctgaatccggaagtaaccgaaccgaccgaatttgaaaccgcattgggcgacaaaatcctgttggaacctttattgcgtacccgcgatcgcgtccatcttgcagacggcttttcgccttgcgtggttttgttgaacaacgatttgtccgccggcattcccgacatcctcaaaggcatcagccaaaccgttttgccgccgttgcacggcggttggacgacgcgccgcaaaacaaatcatttcggcgcgtacaaccaagttaccgccgaatttgccaagttaatcggcatcgacgaatggcaaattaacccttattttgaaaaaatcggcggtttggacttccaagggcgtgaaggcgaagacgcgttggcggaagcggtagaacgtgtgctggcgaaaattcaagccaaatacgacgaatcgggcattaccgacaaacctttcgtcatcgtcaaagccgatgccggcacttacggcatgggcgtgatgagcgtcaaatccgccgacgaagtgcgcggattgaaccgtaaaaaccgcaataaaatggcgaaagtcaaagaaggcttggaagtcagcgaagtgattgtccaagaagggatttatacttatgaaaccttaaacggcgcggtgtgcgaacccgtcgtgtatatgatggaccgcttcgtcatcggcggctttttccgcgtacacgaagggcgcggtgcggacgaaaacctaaacgccggcggtatggtgtttgttccgctgtctaacagcattcctaccggtaacggcgataattcccaagaagcgcccgaagcctgcaagcgcgtattcgaacaatgggactcgctgggtatgccgcgctctgaaaaagactgcgacgtggacaacgaacacaaccgcctctacgtttacggcgtaatggcacgcctgtcgcttctggcggcttcaatcgagttggaagaaacggcgtaagactgttttgaaatacagatgccgtctgaagcggaaatccggttcagacggcatttcggatatttggcgtgtgggaacatctgtttcagacggcatctcagactatttaaaaaagggaaaacatgagcatcaagcaatggccggaaggcgaaagacccagggaaaagctgttggaacgcggggcggcggcgttgagtgatgccgaacttttggcaatcctgctgcgcgtcggcacgcgcggaatgagtgcggtcgatttggcgcgttatttgctgcaggagttcggcagtttggggaggctgatgagcgcggaggtcggcaaactgtcggcatacaaagggatggggacggcaagtttcacacagtttgccgtggtcagggaaatcgggcggcggatattggcggaagaattgcaggagagcatcgtcctgtccgatccggatacggtggccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattattgcgcacaaccatccgggcggctcgcccgaaccttcgcaggaagacatcatgttcacaaggcggctggcacaggcaatgtcgctggtcgatgtgtcgctgctcgaccattttatcgttacctcgcaaagcgtctgttcgttcagacagctcgggttgatgccctgacactctgttttacatgcggcggctctgataaaatagccgcttcaaccgtattcaacagatattgttaagttaatggaaacacaaaacaaacctaccgttaccgacattgaccgccctatactcgtcccgcccggtggacataaaaaagtcttgctgcattcctgctgcgccccgtgcagcggcgaagtgatggaagccatgctggccagcggcatcgactacaccatttatttttacaatcccaatatccatccgcacaaagagtatatgctccgaaaagaggaaaacgtgcgctttgcggaaaagttcggcattcctttcatcgataaagacgacgactacgaaaacgaccgcaaagaatggtttgccaaagccaaaggcatggagtttgagccggaacgcggcatccgctgcaccatgtgtttcgatatgcgttttgaaaaggcggcgcaatacgcgcatgaacacgggttccccgtctttaccagttcgctgggcatttcacgctggaaaaatatggcgcaaatcaacgactgcggacaccgcgccgccgcgccttacgatgatgtggtgtattgggatttcaactggcgcaaaggcggcggcagcgcgcgcatgattgaaatcagcaaacgtgaaaacttctaccagcaggaatattgcggttgtgcctattccctgagggattccaatgcccaccgcaaatcacagggcagaatccccatcaaactcggcgtgctgtattacggcgacgaatcgacacaatacgaacctgcccccatccgggtggacaaataaacacccgatgccgtctgaaggttcagacggcatcgggttcggcatcggcacggggaaaggtttgccggtttrgcaatctgcaatcggaaaccgcattggcaagtttgccgttttgataaaacaccccgttgccgcgtcgggaggacggcattatgaaatccctttttattcggctgctcctgttgggttcggcggcaggcgttttctaccatacccaaaaccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcagcggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgctttttccgctcaagcctttggaatacggcacgctttatacggcggtattcgactatgtccgcaacggacggcgagcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacgaggcgggcggcatcgtcttcagcgttgacggaatggcgggcagccgcatcacgcttgcaccggaaggagaaacggaacgaggcgtaaccctttatttacaggattgaatacatgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactgaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagcctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatgaaaaaaacctgtttccactgcggtctggatgttcccgaacacctccacctgactgtccgttacgaaaacgaagaccgcgaaacctgctgcgccggctgtcaggcggtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaagcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggtggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgaccgaccccttgaaagacagcgcggcggaggcggtgcggcagttggcaggcaaaaacctgaccctgcacatcctcagcggcgaccgcgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatgacggacggcgttgctttagacgtatagttgatgaaaacaaaaataagacgatgaagaattgcaaacttaaagtatgtattgttaccgctcaaacacgttggcgttcaaaatttgagatcgaattgctaggtatttgattttattaaataagagattgtattaatgaggaaaaaaattaaaaagtggatttatgcgataaatggaataatgatgtcaatatggattattttttttccaaataccggttctgtgtatgacggtggcagaacaaccattttcaatgaaaaccatccttttcattttattttctgcataacatttcttattgggacaatttttcttatatatcatgaatataatgataactaatttttaacatccttattgttatatcatgatgaaatgacaataaggatggttttctgctttggctactgcagaacaccgtcgtcagtctcgcgtaggggggaatccatatgcttggtttttcttttattttcaaatgctaattaacggataggtctggattcccgcctgcgcgtgaatgacggaaatgtgcatttctaatttttacccactatatagtgaattaaatttaaaccggtacagtgttggctcgccttgccgtactatttgtactgtctgcggttcgccgccttgtcctgatttaaatttaattcactataaaaaccccgaatcctgattggcaggattcggggtttttgattgctggtgccgttcagacgggattttcaaacagcttattgatctacaaacgcacgctcaatcaggtaatcgccgcgtacgcctgttttcggagagacggtcagtccgaaatcgtccaaaactttgcaggtatctttcagcatcgcggggctgccgcacagcatggcgcggtcgtcttgcgggttgattttgggcaggccgatgtcttcaaacagtttgccgctcaccatcaggtcggttaggcgaccgtggtgttcgaattcttcgcgcgaaacaatcgggtagtaaatcagtttttctttaaccaagtcaccgaggtattcgtgttcgggcaattctttggtaaagcggtcgtagtacgccaaatcttttttgtagcgcacgccgtgtacgaggatgattttttcaaattgctcgtaaatttcggggtctttggtgatgctcaagaaaggagcgatgccggtaccggtgctcaacaagtaaaggtgtttgcccggattcaggtcgccggcaaccagggttccggtcggttttttgctgattaacacgtcgtcgccgactttgaggtgttgcaggcggctggtcagcgggccgtcttggactttaatgctgaaaaattcgaggtgttcttcccagttggcggaggcgacgctgtatgcacgcatcagcggcttgccgtccaccatcaatccgaccataacgaactgtccgttttcaaagcgcaacgattcgtcgcgggtgcaggtaaaggtaaaatatgcgtctgtccagtggtgtacggacaatactttttgggtattgaatgctgccatttgggtttcctgtcagtaaaagaaatggatagtgcttgttcgggaggtgcggcagagtggaaatgtctgcccgattcgggataaagccaaaattctaaacgaaacggatggttgcgacaatgcttgatgcgcgttggttatatgccgtctgaagggcttcagacggcatcgcggggcaggcggcggcttacggcggcatatcggcaagggaaatcagggaaatcgaggctgccagcctgagtgcgtcccgtccccagcgggggtgttccagcctgcgtatcgggaggatcggtttgacggtggcggcaatcagcttttgtatttcggcaggctgatctgacaatacgccgccccatttttccgcagccgcttccagcagtccgccgtttttcaatatcagcgcggtcgaatggatgtagcagagccaatcgcgggcttggcattgcgctatggtcaggacttcggaagggtcgtcttcaaaatccaaaaagctgatgttttttccgtccgacatcatatttcgcgcaaacgcctgactgaggaactgccgttttttatgcacgcgtgcaatggcttccaaaccggcaagccaagcgtccgactttccagcctcggcttcttggcggatttgcgcatcgagcgggatgccttccaaattgccgaacataagggcatttttcctgacggcgagcaattcgggaacggctatccccgccgagcgcaattcgtacaggcgttttgattcggttgcaatggcaggctcgccgccgaggctgggaaccggcttcaacacccccagtttcaaatatcgggcaaccataccgagcagcgcgtaacgccatcgtgcattgtgcctgcctgctttgcgtatccataccttggttccgtcggcaagcaggtggggggcgatggctgcctcctgttttgccgccaattcgtctagcagtatggaaaaacgggtttcctgcataggtaaggtcattttctttcaatcttaagttcggacggaatgcccctgtacggaatatcaggcaagggtttgttcgatgatgccttttaccgcatccgcactgttcggcacggtttgcacgcgctgcggcaggttttccaaaccttccagcgcggcagggcgcggaatggcggcatcgccgacggcttcgcgtatggtcgcatcgaatttcgccgccaacgcggtttccaaacaaaccaccatttcaccttcttcgcgcacttcgcgggcgacttttacgccgtcggcagtgtgcgggtcgatgagttcttggtcttgctcgtaaacctgcttgatggtggcgaggcggtcggcgtgggtggatttgccagaggtaaaaccgtatttgccaccgactttgtccaaggcaaatcgcaggtcaaagcctttgcctgcagccacttccgcccacagcgtattgatttccgcaggatcgcgatccatcaggtcgaacacgaaacgctcgaagttggacgctttggaaatgtccatagacgggctggaggttacataagtatgcgcgctgttgcgcgggcggtatgcaccggttttgaaaaactcgtccaacacatcgttttcattggtcgcgacaatcaggcggcggataggcaggcccatttgtttggcaatgtgtcccgcgcaaacattgccgaagttgccgctcggtacgcagaagctgacggtttcgtcattgcttgaagtggcgttgaaatagcctgcaaagtaataaaccacttgcgcgacgatgcgtccccagttgatcgagttgaccgtaccgatatggtatttttccttgaacgccatcgttctgcaccgccttcacaatatcctgacagtcgtcaaacattcccttcacggcgatattgtggatattctcgtcttgcaggctgtacatttgcgcgcgttggaacgcgctcattttaccgtcgggcgacaacataaatacgttcacgccctttttgccgcgcaaggcatattccgcagccgaacccgtatcgccgctggtcgcgcccaagatattgagttttttgccttctttgtttaaaacatattcaaacgcattgcccaaaaactgcattgccatatctttgaacgccagcgtcgggccgttggacaaggcttggattttgatgccgtctgaaagcgtgcggacgggggtgatttccttagtaccgaacgccgcttccgtgtaagtacggttcagaatgtcgcgcaaatcgtcctccggaatatccgtaacaaacaggcgcataatttcaaacgccaattcgggataagctaaaccgcgccatttgtccaaggtttcgcgcccgatttgcggataatgttccggcagcatcaggccgccgtcgggggcaagccccatcaataaaacttcgctgaacggtttgtgtgcggtttcgccgcgcgtgctgatgtatttcatgatttttctcgtctgtcgaaattgcaggaaaacggcttcagacggcatctgcctcatgccgtctgaagaaggttagcggtacaggtgtttgaagcaggcggaaaccgttttggcggtcagggcggcaagtgcctgattgcgcgtggacggagccagcatctgcatcacatcgttgccggtcatccgttcgggtgcttcttgggcgacgcaagcgcaaatcttgttttcccactccgcctgtttttcggcactcatcgccagcgcggtcaaacgccattcgctgcgtttgtccaattccgcacggcattggctcccaaccgccattttgacgatgctgccgcccatgcctgtgccaccgtctaagctgccgaatgtgttaccgcctccggcggcgcagccgccgagtaagattgccaccggcaaaatagacaaggttttattcatctcaattccttttcggttgaaaccccgccttttatggcgatagaatctgattagccgccccgttcgggataacgcgaagggcggcgttttatgcgccgttccgagtgttggaacaaaccgttttgaatatccggttgaagcccggcaacattatacttcaatcgggaaaataaaaaatcccgccgccgtcattttgcctgtttgcaaaaatgccgtctgaaagcggttcagacggcatttccgatttcagcctagcccaaagatttgaagtgttccaaaaacggcgggataccgggcagcatcccgaccgcacccatcgccacacacaagatcaagaaacctactgcgggtatcaacacgcgtccggcgaaacctaattgcgcactgcgctctttgcagccgattaagcccaaattatccaacagcatcgtcaacgcccagccgaaaaccggattgaccaaggcggaagagaacaccacgatggcggcggattgggtggttttgcctttgcgcgtcatttccatgcccgcttccaaaagcggtaagtatacgcctacgaccaaggctacgctcaataccggctgccaaatcgccaagtccatcggatagccccataacccggcgataatacataaaaccgccgttaaaaccgcaccgcccggaatggggcgtttggcaatcgatgccggtacgatataagttccccaagaagaggtaaaatttgcaccccctaaaatagaacccactgcttgacggacagaacaacttgtcatggtgtcgtctatattcatcaataccttatcggttttttccggatagctgattttttggaacacttgatgtcctaaaaaatcgggcgaccacattgcaacagccaataccgcaaatggaaagacaaccaaaaaactttctgccgtcggcaaccccagatgccagccgctgttttcaccccaccaataagcaggactcattggaggcaggccgggggcggtgtgaaactcaaacggcgcacccaatgcaaatgccaccacaccggcaatcaagcatcccaaaggcacggctaaccagcgttttttccaatgctccaacaaagcgtacatcacaatcgttacaataatgacggtaaaagcgatgtagggcatattaaaaccgcctgcccacgaaaacaatttttttacctgccccgtcgtgccgataaagcccaaatagagtaataatccgccgcatacgccgttgcttgtcagcttcgccataatactgccgccgcgaaataaagccatcagcagacctaaaaccgcaatcgaaatgccgaacgccaaaggatgcccgcctgccgacacaacgatgggaatcatcggaatcagcggcccgtgcgtaccgggcaggttggcgccgggcagaaaaaagcccgataccaataagataaacgcggcggcgattaaaagctcatagcgcacattttccagtacaaagctgtcaggcagccccaaaggtgcggcaaacgccgccgccaccgcccccaccatcaccacttttccaatcgttcccgccatcgcaggaatcaaatcctcccactcgaagcggtaatcgcgaaagggcaggttgggccgccagcgttttggttgcataatctgcaattcatgttccaaatattcgtcccgcgtcgcaaattccgaagctggacggtgcaaatcccgataagtcccattatgtttttccataaccttcctccttatatatcgcgcctcgtaaaaggggcgcatgacttttctttttgatacgggctgcgttcggaagccgtaaccccatttaaagcccaaacaggcaataaaaccaatctttttttttgataaccatcatccggaaaactgatacaatttacaaaccacttgattaaaaagttaattttcagcaacaatccacctaaaagatttcgattgcacaaatatagaaaacatccgcacaaggagggatatatggatgccgtacaattaaaatcatttgtcgccgtcgcgcacgagggcaaccttacccaagccgccaaacgacttttcctttcccagcctgccgtttctgcccaaattaaagcccttgaagaatatgtcggcacgccgctgttcaggcgcacggggaaaggcatggtattgacgcgggcgggcgaaatactgttgcccgaagcggaatccctgctgcaatacanacacaagctggagcattttgccaaaacgctggcaggcgattattcggaagagacagtttgggcattatccaccccatcgattcggcaaaactcgtcgcgctgacggacaatatcggtcaaacagcccccaatacgcgcctgcacatccaatacggaatgagcggcgaaatcctctcgcgcatccaacacaaaaccctgcacggcggctttatactcggcaacgccgcccaacgcggcatccgcagcgtattcctgcaaaacctgacctacgcgctgatttgcccgcaaagccaatatccccatctgacccgctcccttccgcagagcctgcaagaatgcgtatggatagaaatgtcgggcgtgtccggaagtaggaagcacctgcaccagttttggcgcagcaaccggctctcacccaaaaaacagatcttgtgcgactacccccaaaccattatcgatttggttgcaggcggtataggtgtggcaatggtgccgggaaacaaagccgaagcggcggcaaaagaaggcgcgggcgtggctattatcgaatcgtgccgccacagtatgccgctcaatttcatttatgcggaagaatacgaggataatccccacgtctcactcctgctcgagtgcattgaaaaagtatggggagtgcaggcggtgcagccgcccgttgtctcggacaactgaaataaatcctgctttgctgattgttttaaaatagaaatttgaattttatcacgctgaaaacactgaaaacgccatccgcattctctcaaatacggcttaaaatgccctttggaaatgccgttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaactgacgcaaataccgttttgcacaattccaaaagttttcaattccgttaatgcgattttgccgtttggcgaaatgcgtactgttccagtcgtggattgaacccccaccctgtatagttctttcgaagcattggggtattgttttttcaaagcatcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggtgtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgtcgtttgaacatttttttcttcctgtttgatttcagacggcattgccgttccgtttggtttccagcagctcccagcgttccagcttttccaaaagcagcatttcgatttcttcggcgcggttttgcaatgcacctgctttttcgtaatctttgaaaatttcaggataggaaagttgggtattgatttcagcctgctcggcttccaaagcggcgatttcgtcgggcagggcatcgagttcgcgctgctctttgtaggacagtttgaccgtgcggttggctttgggtttttctttggcgggttcggcatcggatgctttgggtgcggatgccgtctgaattttatcttcccgcgattttgcgtcgatatagtcctgatagccgccgatgtattctttcagacggccttgtccttcgaaaacaatgctttgggtaattacgttatcaaggaacatacggtcgtgcgagacaaggaatactgtgccttgataatcgcgcaacaggtcttcgagcagctcttgggtgtcgatgtctaagtcgttggtcggttcgtccaagaccaggatattggcaggacgggtaaagagttttgccagcaaaaggcggttgcgttctccgccggagagcgatgaaacagggctttgcgcacgggctggatggaacaggaaatcttccaaatagctcatgacgtgttttttcttaccgccgacttcaacgtaatcgtttccctgtccgagggtgtaaaacacggtgtcgttttcattcaacgcgctgcggaactggtcgaaataggcgacttcctgcttactgccgatacggattctgccgtaggtcggctgcaattcgcccaaaatcagcttaaggaaggtggttttgccgatgccgttggggccgattaggccgattttgtcgccgcgctgcaagatagcggagaatttgtccataatgactttgccgccataggcaaacgaagcgtgttccaattcggcgatgattttgccacttttctcaccgctatcgagcttgaagttgacttgtccctgtacgttgcggcgttctgcacgctggcggcgcagctcttccaaacggcgcacgcggccttcgttgcgggtacggcgcgcttcgatgcctttgcgtatccatgcttcttcctgtgcgtggaatttgtcaaagaggcggttgtgttccgcttcgactgccaactcttgcgcttttttctcgctgtatttagagaacgagccgggataggaacgcaaaataccgcgatcgagttcgacaatccgcgtggcgatattgtccaaaaaacggcggtcgtgggtaatcacaaccaagctgccttcaaacgctttgagcagattttccagccaaataatcgcgtcgatatccaaatggttggtcggctcgtccagcagcaatacgtcgggcttttgcacccaagcctgagccaaggcgacgcgctttttctgaccgccggaaaggttgccgattttttcattttccggcaaaccgagttcccccaaagtctgcttgactgccgcatccagtttccagccgtccttcgcttcgatttcaagttgcaattcgttgagttctttcaacaaagcctcactcgaaccattttccaactcatggctgacatgatgataacggcgcaataaatcacgaatttcgcccaaaccttcggcaacggtatcaaatacggttgcgtccttatcaaaaaaggattcctgcggtacataaacgattttgaggttgttttgaacaataatctgcccgtcgtcgagcttttgcaaaccggcgaggatttttaaaaacgaagacttgcctgcgccgttgcgtccgattaagccgactttttcgccgctgtcgagttgaaaagaagttttgtcgagcaaggcaacgtggccgatggcaaaagaagcgttttctacagataatatattcatgatacaaattctcaacagttaccgtttggattttaccgcaagtttggcgcgggcaatttcaaccgcacccggcaggacggaaacaataatgatgccgcccatcaccaagcccagattgttttttacgacggggaagttggcaaagaaatagcccgcgtaagaaaacaggataacccacaacaagccaccgatgatgttgtagcggataaatttggcatagtgcattttccccataccggcgacgaagggggcgaaggtgcggacgatgggcataaaacgggcaatgatgatggttttgccgccgtgtttttcgtaaaaacggtgggttttatcgagatattcacgtcggaagattttagaatcggggttggcgaacagcctgccgccgaaatatttgccgacggtaaaattgagcgcgtcgccgagtatggcggcaaggcttaataatgcaaccatcaaatgaatatccataccgcccagcgcggcaatcccgccggcggcaaacagcagcgaatcgccgggcagtaagggcgtaacaatcaggccggtttcgcaaaaaacaatcaaaaacagaatcgcataaatccacacaccgtattgcgccgacagcgcgagcaggtgttggtcgatatggaggatgaagtcgatggcggaggcaagcacggcgcgttcctaaaaaaacaaaccgcgtattttaaccgattggaaaaatgccgtctgaaaagtttcagacggcatcggctattcaaattcatttcacgtaaaaaccgcaaaccaaaatagtttgcggtttggcatttaaagtgacaatgatgatttcaaatcatcagaattttatgccgacgcgcaagccgtattcacgaatactggttttcgggatggtgagcgatacgtcgccactcttggttgttacactaaactcgccggattctttgtaagtgcgttgtttgtagaacggccccgcctcgatgctggcggattcgcccagttttttaccaatatttgcacccaatccaaagccccagccgttggttttttgattgatgtcttttttgagattggtaacgccggtgtttaatttatagcgggaattgaggtcaaatttcacttcagaccaagggttgatataccagccgttacccagttgggaaagcaaatccgcgtgaactttggctaaccacgactgacggctgctgtgaagcgtatgcttggtggttttaatgctgtcttttgaagattcaaaacccaagccggcacccacacggaaatttaaagaatcacttaacgtttgggtgtaggtgtagcctgtgtaaagatcgatacggttttcaggaacgccggtgggcagttttacatttttagtcttacccagcttgttctcatctgtttccaaattaataatattttttttgctgcgcccgaaaccggcttccaagcggatgccttggttggcatcaaaaggaatatcagcacgcacgctgatgtgtttggcagctttgtgtttttctttcaggaaagcacgagttgaagaaatggaagagaggtcggtgtggacggtaaactcattagcggtttgaagctcttgtgcagcggcggcagtaccggtcagggcaatcatggcacatgtaaaaactgtttttttcatagttaaaacctctaaaatttggattgtagtcggatatggtaacataacgtaaataatcgttacgcttacaattatattcttaagctttcggggggggggggattttacatatattaataaaaattaacaaatagttatttgtttacaacgaattgttattctcacttggttttctgttttttatgggaatgacgaaattttagtttgtgtgtatttatcggaaaaacagaaacccgccgccgtcattcccgcgcaggcgggaatctagaacccaacgcgacaaaaatttatccgaagcgacaacaatcttttcatcgtcattcccgcgcaggcgggaatctagaacgtaaaatctaaagaaaccgttttacccgataagtttccgtgccgacaaacctagattcccgcctgcgcgggaatgacgggattttaggtttctgatttcggttttctgttttaagggaatgacgagacttgagatggcggcatttatcgggagcaactgaaaccaccctgccgtcattcccgcgaaagcgggaatctaggttcgtccggtttcggttatttccgatagattcctgccgcgttgggggtctggattcccgcctgcgcgggaatgacgggactttaggtttctgtttttgtttgagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgtttggtttgcgtttccgtcagcggacggttgcggcaggctttgcgcataatgccgtccaacaactgatgttcttccagatgttgccggttttccgcactgtcatagcctttgtcggcatagacggtcgtacctttgggcagtccttccaacaaaggcggcaggtgtttgcactcatgggcattggcgggggtaatgtgcagtttctcgatatagccttccgcatcggtacgggtatgttgtttgtaaccgagtttgtagaggccgtttttcttgatccaacgggcatcgctgtccttactcggtgtggtttggccgttgatttgtccttcttcatcgacttctatgacctgacgctgtgtgctgccggcggtctgaataatggtggcatcaatgacggcggcggatgctttctctacttttaagcctttttcggtcagttggcggttgatcagttccaataattcggacagggtgttgtcttgcgccaaccagttgcggtagcggcataaggtgctgtaatcgggaatgctcagttcgtcaaaacggcaaaacaggttgaagtcgatgcgggtgatgaggctgtgttcgagttcgggatcggagaggctgtgccattgtccgagcaggacggctttgaacatggacaacaggggataggcgggacggccgcggtaatctctgaggtaacgggtttttgacggttcaggtatggttcgatcggctgccaatcaatcacccggtccaacttcaatagcgggaaacggtcgatgtgtttggcaattatggcttgtgcggtttgccggaagaaggtgctcatgagaaatcccctaaatgtcttggtgggaatttaggggattttggggatttttgcaaaggtttccgcctgaaacattatgagatttcaggcggcattggattgcttggcggaatatttttaaaaaggcttacgcgccgtaaacggggtatttattgcacaaagcagttacttgtttgcggactttggcgaggttggcttcgtcttcggggttagacaatacgtcggcaaccaagttcgccaatacgcgcgcgtcggcttcgttaaaaccgcgtgtggtcatggcagcggagccgatgcggatgccggaggtaacgaagggtttttccggatcgttcggaatggcgtttttgttgacggtgatgtgcgctttgcccaaagcggcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcggaccgccttgcaggcttgggaagatggaagagttcaacgctttttcgtgggtattgtcgcggcacaaaattacgccgccgcgaggaccgcgcagggttttgtgggtggtggtggtcacgaagtcgcagaacggcaccgggttgggatattcgccgccggcaaccagaccggcatagtgcgccatatcgacaaagaggtatgcgccgactttatcggcgatttcgcggaattttgcccagtcgatttgtaacgcgtaggcagacgcacccgccacaatcattttgggtttgtgttcgagcgcgaggcgttcgacttcggcataatcgagcacttcgttttcatccaaaccataagtaacggcgttgtagagtttgcctgagatattaacgctcgcgccgtgggtcaggtggccgccgtgcgctagagacatacccaaaatggtgtcgcctggttttaaaacggaagcgtacacggcttggttggcttgcgagccggagtgcggttggacgttggcataggctgcgccaaacagttcttttacgcggtcaatcgccaattgttcgacaatatcgacgtattcgcagccgccgtagtagcgtttgccggggtagccttcggcgtatttgttggtcagctgggaaccttgcgcgtccattacggcgcagctgacgtagttttcggaagcaatcagctcgacgtggtcttgctggcgttggtcttcttgggcaatggctgctgccaaatcggggtcgtattgtgcgagggtaacgctttttgaaaacatgttctcggctcctttgtgtaatcagggtatcatgagtgttttttgtataaaaaaatatttcaaaacctaaggcagatagcccataatgcgtaaattttctttggcattatcaggtaatttatttaacatgctggtttttagcgtctcattacctttatttagtacaagactaatcaaaagcaatacattaaatggtaaattttcggcagtttgtgcaaaatcaatcaaataaccagcaccaaccacatctttatcagccataacccgctgatacaccacttgctaagacaactctcctgccccaccatgtcttaaaatcagatgaatggcttgtaatgctgtgtttggtgtctcacaaattgccaagatctgctcagaagcttgcttgatggcttgtatttttgtttgattactcacaatttccccctattttaataattaacttaaatgcggtcaaattcacaaaatacaagctttacctctaatcacccatcactcgaccttctcggcgtggatcggcaccaccaaccagcctgcttggctcgataataatggcttgaacacctgaatttagctcacgcacatcagtcttatagcccaaatcatttaatgcttgttgccactggacggcggttgtacccgtttctagttcatagctaccaaagcgatttaataaattgggtgcactgatggcattttggatatccatattccagtcactatgtgccacaatcgtcttagcgacatagccaatgatacggctaccacctggggagccgattgccatataaggcttgcctgctttaaatacgatggttggtgccattgaggagcgtggtctcttgccgggctcgacacgattggcgacctgtttgccctgctttattggctcaaaactaaagtctgtcagctcattattcagcaggtagccatttgccatcaaagttgagccaaacgcattttcaatggaagtcgtcattgatagcacattgcccgccttatccacaattgatatatgactggtagaaggtaactcaatcgcttgtgaggacacccactcatgaataaaatcgcctgcagatacgctaggcaatgccttatccgactgctcaagcagctggctgcgatgttttaggtagtctttagaaatcaactggcgaatgggtactggtacaaaatcagggtcgcccaaatatacatcacgatccgcaaacgcaagcctagaagcgtcgcccaagagacgtaaaccttcagcatcataccccacctgattgggtgaaaattcatttaaaatccccaaaatctgacccacagcaatcccacctgagcttggtgcacccataccgcatacttcataaatacgataagtcacacaaacaggcgggcgttccaccacttgataatcagataaatcttgtaaggataattgaccggggttatccttagcattttggacaactgaaacgatattttgggcatatttaccagtatgcagagcttttgcaccttgagctgctaacgcctgaacactgtcagcaaattctaaatttttcagcaagctgcctgcttgtagcggcacaccattcggcaaaaaataagcggctgtttttggatagcgtgccaaatgctgctgattttgctcaaccgagatggcaagccttggcgacacctcaaagccttgttttgccaagcggatcggtgtatcaaataattttccccaaggcaatacaccgtatcgctgatgtattgtctccatcagtttagggatagcaggcgtacccaccgagcgaccaccgaccaccgcttccataaatttcaatggttgaccatctttatccaaaaataattccggcgtcgcacgcatcggtgccgtctcacgcccatcaaatgtggtcaatgttttggcggtattatcccaatacaacacaaatgcaccaccgcccaagcctgacgactgtggctctaccaagcttagtgtcgtctgcaccgccaccatcgcatctgcagcgctaccgccttgctttaagatatcatagccagcttgtgttgctaatggattggctgacgctaccataaaatcacttgcaatcacctgcttttgttcggtcagtcccgttgcatgttcaggcgtgtgagcgtctgcacctgtgatgacagcagaatgagtattaaccttaccttgattggcatggatgacttgacatccagagattgtcatagacattatcaatgcagtcaataaatatgttttagccacaagcactccttcgcctgagtttgattgatgattcatacaaggcatgctgattattgtatttaatatggctaaataattcaatccaaactatcaatcttgaccatcaaaaaaagaccgctaatgtcatcagcagtcttttttgatatttattttaagatattaagtaatcagacctttgggctatgctcttcaatgagtggttttagctcacctgattggtacatttgtaggataatatcactaccaccgattaactcaccattaacccaaagctgtggaaaggttggccgactggcgatgagtggtagagtactgcgaatttctgggttttctaggatattaacaaaagcaaagggtctgccaattgggtcagcacctctactgcacgcgctgaaaatccacattggggaaactggggcgtgcctttcatatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatacagtaggaaaggctgaaaatttatgcgtaaagcgtgatattgtcaacgtttttatcaaccggacggcggtgttaaaagaaaattttgccgtatccgataaaacactggataaaaatattatctttgttataattaatgtaaagattcaatttgactttttaaccgtaaaccaagagaggaaagcgatatgttcccagaataccgtgatttgatttccaaattgaaacaggaaaattcccgcttcgcccgtctgttcgacgaacacaacgagctggacgataaaattaccggtctggtcaacaatccggttaccagcggtgcggaaaccatcgatgagctgaaaaaagccaaattgaaactgaaagacgagttgtacgccatcctgcaaaaagcagcgggaaaataattcgggtttgagtttttgaaatgccgtctgaaatgtgttcagacggcatttttgtcatttgaccggaaggcttgtgctgtttgaaataacggcggcggtatcggattgccgccgccgtgtacttgtgtgaacggctgtctgtctattttgcgtgcaggcggtcgagataggcgacttcttcgctgctgcccatgaagacggcgacgcgttagtgcaggttttcgggctgtatgtcgagcatggcttgatatgcgttgcttgccgatgcgcccgcctgttcgagtatcaggctcatagggttggcttcgtacatcaggcgcagtttgccgggtttagcggggtcgcgtttgtcttgcggatacatgaacacgccgccgcgcatcaggatgcggtggatttcggcaaccatactggctacccagcgcatattgtagtttttgccgcgcgtaccggtttcgcccgccaagagctcgtcgatgtattgttggacggggggcagccagtggcggcggttggacatattgatggcaaattctttggtactttcgggtactttcgggttttctttggtcagcacaaattcgttttcggcattgagcgtgaacatatatacgccatgtccgaatgtgaatacgagctgggtttgaggcccgtaaagaacgtaaccagcggcaagctgctgtctgcccgtttgaaggaatgattcggttgccaatgcgccttcgggtttttcaaggatggagaaaatcgtaccgacggaaatgttgacatcaatattggacgatccgtctaaagggtcgaataggacgagatagcgtccgttttcaccggcatttacgaaagtgtcttcttcctcgctcgccagcccggcaacggcagaattggctttgagtgtgtcaatcatgatgttgttggcgataacatccagttttttttggtcttcgccctgaatattgcccgtgcccgccatacccaatacgccggccagtgcgccgaggcggactttggcgttgatttcggtgcaggcggaaacaacggacagtaaaacgccgccgagtgcttcgggcagctggttttgttgcaggtgttcggggaggaatcgggtcagtgtgtccatagtttgctcgtttcggaaaggtttgtgccgtctgaaaggcggcaggttattgtggcgtattcctttggtgcgttttgcaggatagtctaggggattgtagtgtaaaaaaacggcatggggcaagtcggaacgcggcaggcggatgaggggatatttattcttaaaagtgccgactgccggtatatcgtccggttttgtttatttgacgggagatgttgtctgaagggtttcagacggcatcggggtcagcggattttgctgtccaaaaggtagcgcgagccttcgtcttgcgccagcagccgcgtcagggcggggaggtttgccgccaattgttccgccaacagatagggcggattgatgacgaacattccgctgccgtgcataccgaaaccgtcggctttcggcgcgtggacgtgaagttcggcgtgaaggtagttgtcgggcaggagttttttcaattcttcgggcagcttgcggctttcttcgcggctgaggcagggataccaaatgagataacagccggactcaaaccgttttaaagcggctttcagcgtttccgttacacgccggtagtcctgtttttcctcatagggcgggtcgatgaggacggtggcgcggcgcggcgggggcggcagcagggaaatcagccctttgtaaccgtcttcgcgtaatacttgtccgcgtttgcccaatcctgcttcgcccatattgttttgcagatggacaaagtcggtggggtgcagctcaaacaggcgtaatttgtcgccgacgcgggtcagcgattgcgccagccacggagaaccgcagtaaagtttgggcgagggcaggattttttgtatgtgcgcggcaaagtcagagagttcggcaggcaggttttgcgcctgtcggagcagggcgatgccttgtcggtattcgccgactttctgcgcctcgctgccttcgagattgtacacacccgcgccgccgtgcgtgtcgatgtaccagtagggcttgtctttgcggttgaaatattgcagcactaaaaacaaggtgaaatgtttgagcatatcggcgtggttgccggcgtggaatgcgtgtctgtaactgagcatagtcggtaaaacggcgggatattcggatgccgtctgaagcggggttcagacggcataaacagggatggatgggaaatcagcggctgccgccgattttgctttctctgccttcgagcagcttgacgatattacttttgtggcggaacaacaccagcaaagcaatggcgacggtcgcccaaacccacgagacgtgcggcataaagaaggatgcggcgaccggtgcggcgattgtggcggttaatgcggcaagggaggacaccttgaagccgaatgccataacaagccaaatcaacgcgcagaccaaggcagttgcgggagagagtgccagaagcacgcccaatgccgttgccacgcctttgccgcctttaaatccgaaaaacaccggccacatatgcccgaccagcgcggcgagtgcgacggccgcgattgcgctgtcggataaaccgagcggttcttgaagcacgcgtgcaagcaaaacggcaactaaacctttggcggcatcgcccaagagcgtcagcgcggccgccttttttttgccgctgcgtaaaacattggttgcccccggattgcccgatccgtaggtgcgcgggtcgtccatgccgtaatacttggacacgatgacggcgaaagaaagtgagccgatcagataggaaacagcaacagccggtatgttgaacatttgcggtactttacttagaatggtgcggttattttagcaaaaaacggggcggattatggataaaatctttttgcacggcatgaaggcagatacgcttatcggcgtgtacggctgggaacgcgaacggttgcagaccctgattgtcgatttggacatcggtgttcccgagaaagcgggttcggacgacgatattgccaatacggtgcattatgccgaggtatgcgaaacgctgcgccgacatctgaaagaacaggatttcctgcttttggaagcgttggcggaatatattgccgatttggttttgggatatttcggcgcggtgtgggtgcgcgtgaaaatcgtcaagccgggtattttggaaggcgtgcgcgaggttggcgtggaaatcgagcgcggcaagcgtgaagattgaacggcagaataggaaacggaaaggagatatgaagtggatttgagggaagtaaaattaggcggcgaaaccatttacgagggcggtttcgtcagtatcagcagggataaggtcaggttgcccaacggcaatgaagggcagcgtatcgtcatccgccatccgggtgcggcatgcgtgttggcggttacggacgaagggaaagtggttttggtgcggcagtggcgttatgcggcaaatcaggcgacattggaacttcctgcgggcaagctggatgtggcgggcgaggatatggcagcgtgtgcgctgcgagaattggcggaggaaacaccttataccgccgacagcgtacgcctgctttacagtttttatacggcggtcggtttttgcaacgaaaaaatgtatctgttcgaagcggaaggcgtgcgtttgggcagtacgcttgccaatgacgaagacgagattacggaaaccgtattgatgtcgaaagaagaagtccgtcaggcattggcaaacgatgaaattaaagacggcaagacattaatcggtttgcaatactggttgatgaaggattgacaggatgttggacttgcccgccggattggatcggcgggcggtttgtttggcggatgggatatgccttttcggcttgtatctgggcgcgtcctttaaagtcattcgtgctttagtaataagagagaaaaggggatgataattacctaaaagaacgtgataatttttaaaatggttaataatgaatatctttgttactaatttttgttattggtttattagtttattggctatttcttatataccatctattaatgcatggcatgatgaattaatagatgatattaattttggcaaaagggttatgatggttactttttttgcatttttaggcacggtaatagagcgtttttttaagaaaaagccttggtggttttatcctgccaaggctttttctttgttacagacctaaaagctcaatttgaatttgagaacggtaattggcacagccagtatttaaacaagcgaagctaatttatagattatgtcaaaacaaagggaggcaatttgttgcggttatttgactgccgcccctatcttcagcccgagccaggtcagcagcagcgaacctgccgtgtgcaggaaaatattggcaagtgctgaagcgggacggttcaattggagcagggttacggtttccagcgaaaatccggaaagcgtggtcaggctgccgagaaaaccggtaatcagcagcagcttccattgcgggtggttgacggtttcggcaaagattccgataagaaaagcgcctatccagttggcaaacaggttgcctgtggcgggaggtattgatgcgggaacggcgaggttgagcagccaacgcgccgttgcaccgagtgccgcaccgatggaaagggggatgatgttggaaagcatggttttgcctgtctatgccgtctgaaggctaccgccatatgccgcggtcggacttaagatagcggttgtcgtcgaaagtgttaatccaatggggcttcagtgcaacaaatatggcagttgaaatgccgctgaggaaggcttccgcccacgccagcagaataaagacgggcagggcggtcgtccacaatatttcggacggaaaagcgtttgcggcatccaaaataccggtcagcaccagcccggtcagcagaatgccggcggcggaagcgagaaagccgttgacgaaaataaagatgaaaatattgggcggcaggcggttgaccagcatacgcgacaggcggttgacggtcagcgcgggcagtatcagcaccaaagcgttcggcggatatgcgccgacagaaccggcaaacagcaggcagtagggcagcatcagcagcgcggcaagccaaagggcggcggaagtgcccatcatcagtgcaaccaaattgacggcgagcaggtggtagttcatctgggcaagctgtccgccgccggcagaggcgttcagacaccatgctgcggaaaaaattacggtacacaggggaagggcggaacggtagcgggcaagcgagcggaatgccgacggcgcggaagctgccagtatcaggataaggacaatccacgaaaccgacagtaccatatctgaaaaccagactgtttggaaaatcatggcaatgccgcaaagattaagggaagggacggctattatactgtcggcgggggcaaaccgaaagccgaatcggtttcggcagaattgccggccggttgttttttttgggatggaaacacgttaaaataaacccgtttaatcgtttgtcttgcgggaaacggcatatgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaagaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccatatgttcgatgcggacaaagaagcgttttccgagtctgcggattacggatttgagccgtattttgagaagcagcatccgtctgccttttctgcagtcaaagccgaaaatgcacggaatgcgccgttccaccgtcatgcagggcaggggaaagggcaggcggaggcaaaatccccggatgtttcccaagggcagtccgtttcagacggcacggccgtccgcgatgcccgccgccgcgtttccgtcaatttgaaagaaccgaacaaggcaacggtttctgcggaggcgcgaatttctcgcctgattccggaaagtcagacggttgtcgggaaacgggatgtcgaaatgccgtctgaaaccgaaaatgttttcacggaaaccgtttcgtctgtgggatacggcggtccggtttatgatgaaactgccgatatccatattgaagaacctgccgcgcccgatgcttgggtggtcgaaccacccgaagtgccgaaagttcccatgaccgcaatcgatattcagccgccgcctcccgtatcggaaatctacaaccgtacctatgaaccgccgtcaggattcgagcaggtgcaacgcagccgcattgccgagaccgaccatcttgccgatgatgttttgaatggaggttggcaggaggaaaccgccgctattgcggatgacggcagtgaaggtgcggcagagcggtcaagcgggcaatatctgtcggaaaccgaagcgttcgggcatgacagtcaggcggtttgtccgtttgaaaatgtgccgtctgaacgcccgtcctgccgggtatcggatacggaagcggatgaaggggcgttcccatctgaagaaaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtaattacgcgttatgaaatcgaacccgatgtcggcgtgcgcggcaattccgttctgaatctggaaaaagatttggcgcgttcgctcggcgtggcttccatccgcgttgtcgaaaccatccccggcaaaacctgcatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggaaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgtaatcttgcgggcttcaatcaaaaaatcgccgaagccgcagcaaggggagaaaaaatcggcaatccgttcagcctcacgcccgacgatcccgaacctttggaaaaactgccgtttatcgtggtcgtggtcgatgagtttgccgacctgatgatgacggcaggcaagaaaatcgaagaactgattgcccgcctcgcccaaaaagcccgcgcggcaggcatccatttgattcttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgctgccgggtactgcctatccgcagcgcgttcacggcgcgtttgcctcggatgaagaggtgcaccgcgtggtcgaatatttgaaacagtttggcgaaccggactatgttgacgatattttgagcggcggcggcagcgaagagctgcccggcatcgggcgcagcggcgacgacgaaaccgatccgatgtacgacgaggccgtatccgttgtcctgaaaacgcgcaaagccagcatttcgggcgtacagcgcgccttgcgtatcggctacaaccgcgccgcgcgtctgattgaccagatggaggcggaaggcattgtgtccgcaccggaacacaacggcaaccgtacgattctcgtccccttggacaatgcttgattttttgcaaatggaaatgccgtctgaagactgtttcagacggcatttttatagtggattaacaaaaatcaggacaaggcgacgaagccgcagacagtacaaatagtacggaaccgattcacttggtgcctcagcaccttagagaatcgttctctttgagctaaggcgaggcaacgccgtaccggtttaaagttaatccactatatcagacatttgaattcggattattccctgacctgtcccgtgccttgtacgatgtatttgtaactcgtcagctctttcaaacccatcgggccccgggcgtggagtttttgcgtggagatgcccatttcgcaacccaagccgaattcgccgccgtcggtaaagcgcgtggacgcgttgacatacacggcggcagaatcgatatgagtcgtgaaatagtccgcagcgtggcggttttcggtaacgatgccgtctgaatggtgtgtgctgtgggtttcgatgtgccagaccgcctcttcgaccgaagcgacggttttcacagcgaggatgtagtctaaaaactcggtatcgaaatcgtctgcacccgccgcttcgccgccgatatgccgcgccgcctgcggatccaaacggaagcggatgggcggcagtccggcttctatgcggtcgcgaaccaacagccgttcgagcttgggcaggaagtcggcagcaatgtcttcatgtaccagcagcacttccatcgagttgcacacggacggacggctggttttggcgttgtacacgatacggagcgccttgtcccaatccgcgtccttgtcgatataaatgtggacaatgcccgttcccgtttcaatgaccggcacgacggcattttcaaccaccgcccgtatcagccccgccccgccgcgcggaatcagcaggtctagataatctttcgccctcatcatttcgtaactgctttcgcgcccggtgtcttcaatcagttggagcgcgtcggggtcgatgcgggtttgcgccaaccccgttttcagggcggcaacgatggcgcgtgcggattggaatgcatctttgccgctgcggagtacgaccgcgctgccgcttttcagtgccaaagccgccgcatcggaagtaacgttcgggcggctttcgtaaataatgccgataacgcccatcgccacgcgctttttgacgatttccaagccgttgggcaaagtcgaggtttccagtatttcgcccacggggttgggcagcgcggcaaccgccctgatgccgtccgccatcgcgcaaatgcgtttgccgtccaacaaaaggcggtcggtcatgctttcgggaatgttgcctgccgcggcttccaagtcttgacggtttgccgccaaaatatctgccgtcgccgcttccaagctgtccgccatcgcaagcagcgcgcggtttttttcttccgtatccgccgtgttgacggatttttttgccgctttggcaagggcaagctgtttttgtgtgtttgacatgggtttccttttctaaaattcggtcagaagcaggcgtatttcgggcgtgatggaaatccagtcgtcccgatggatgaacacgcctttcgccttacgcgatttgagcaggtcttcggcggcggcagagccgaacaggacgcgccctttgcccaggggctgtttggttgccttgctgtacacggttacggtgtccatacgggaaaaatgcccttcgattccggcaatgcccgacatcagcaggcttttcccctgttcggacaaagcgtgttccgcaccttcgtccacataaacgctgccccggctttcggaatagaacgccagccattgcttctgcgtccgcaaacctttggcacgggggacgaaaaacgagccgtccgcctgatgttcggcagcttcggcaagtgcatcgggtttgagcgaggaacagatatacaccggtacgccggattcggcggcgatggttgccgctttgattttggtcagcataccgcccgtgccgtttgccgaacccgagccgcccgccatttcgatgatttcatggttgatgtgttcgattttgtccagccgtacggcatcgggattgctgttcgggttgcccgtgtaaagaccgtctatgtcggtcagcagcaccaagaggtctgcctgtatcatcgccgccacttgcgcactcaatgtgtcgttgtcgccgattttcaattcctcaaccgaaaccgtatcgttttcattgatgatggggacggcgcggcgttgcagcagcacggaaagtgcgccgccggcattttggtagcggcgtttgtcggcaaagtcggcgcggctgagcaggatttgcgcggacacgatgccgtctgaagacaggtttgccgtatattcttccatcagcagcccctgcccgacggcggcggaagcctgtttgtcggcgattttgaccggacgttttttgaaacccagcgcaccgaaccctgccgcaaccgcgccggaagacaccaagaccagctcgtgtcccgcatgatgcaatgcggcaagctggcaggtgatggtttggattttgccgcgcgagagactgccgtccgaatgggtaatcgaagatgtgccgactttaaatacgattcttttgtatttcattgtttccgtccttgttggtttgtcctgtctcgttgccaccttgtgccgccgaatttgccctgttctgccgcaattgtcaacaatcacgccgcgtctgcaataaaatggacaaaatgtataaaattaataaaatctatggcggcttattgagatttttcaaatttatattgccgttttgtccaaaatgcgtataatcctgtccatatttctgctgtaggctgatttattttagacaaggactaccatgcaattagatatagaccgcttggttgcttatttcggcggcgtgaacgcgcttgccgaagcgttgaaacagcacgatcccgaaaatgccgcgacgaccgccgccatctataaatggcgcacgcgcggctcgctgcctctggcgcaactgcaaaagctgaccgcgttggcggaagcgcaaggcaggccgctggatttgaatgcttttttacaaaaaaacgaatctctggagagaacagaaatgacacagaccaaccgcgttatcattttcgacaccaccctgcgcgacggcgaacaatcgcccggcgccgctatgaccaaagaggaaaaaatccgcgtcgcccgccagctggaaaaattgggtgtggacatcatcgaagcgggttttgccgctgccagcccgggcgatttcgaggcggtcaatgcgattgcgaaaaccattaccaaatcaacggtctgttcattgtcccgcgccatcgagcgggacatccgtcaggcgggtgaggccgttgcgcccgcgccgaaaaaacgcatccacaccttcatcgccaccagccccatccatatggagtacaaattgaagatgaagccgaagcaggtgattgaggcggcggtcaaagcggtgaaaatcgctcgtgaatacaccgacgatgtggaattttcctgcgaagacgcgttgcgttcggaaatcgatttccttgccgaaatctgcggcgcggtgattgaagcgggcgcgaccaccatcaatattcccgataccgtcggctattccatcccgtataaaaccgaagaatttttccgcgaactgattgccaaaacgcccaacggcggcaaagtcgtttggtcggcacactgccacaacgatttgggcttggcggttgccaattcgcttgccgcattaaaaggcggcgcgcgtcaggtggaatgtactgtcaacggcttgggcgaacgtgcaggcaatgcttcggttgaagaaatcgtgatggcgttgaaagtgcgccacgacttgttcggcttggaaaccggcatcgataccacgcaaatcgtgccttcgtccaaactggtgtccaccattacgggctatcccgtgcagcccaacaaagccattgtcggtgccaatgccttttcgcatgaatcgggcatccatcaggacggggtgctgaaacaccgcgaaacttacgagattatgtccgccgaatcggtcggctgggcaacaaaccgtttgagcttgggcaaattgtccggccgcaacgccttcaaaaccaagctggcggatttgggcatcgagttggaaagcgaagaggcactgaacgcggcatttgcacgcttcaaagaactcgccgacaaaaaacgcgaaatcttcgatgaagacctgcacgcactggtatccgacgaaatgggcagcatgaatgccgagagctacaaattcatctcccaaaaaatcagcaccgaaaccggagaagaaccgcgcgccgacatcgtgttcagcatcaaaggtgaagaaaaacgcgcttccgcaaccggttccggccccgtggatgcgattttcaaagcgattgaaagcgtggcgcaaagcggcgcggctttgcagatttattccgtcaacgccgtcacgcaaggtacggaaagccagggcgaaaccagcgtccgtctggcgcgcggcaaccgcgtcgtcaacggtcagggcgcggataccgacgttttggtcgccaccgccaaagcctacctttccgctttgagcaagctggaatttagtgccgccaaaccgaaagcgcagggcagcggtacgatttgagcgtgaaaacagacgatgccgtctgaagcataaaaaggcttcagacggcattgcggcgataatagggcgcaaaacccatttgaaaaggaaaatgatggattcccgaaaatttaccgaagcatccaaacggcggttgagcgaattgttggatgccaaaagcgaacaaggcaacacgatgcgttgcgacgaggttcaaggttttatgacggcgctgttgagcgggccggacaaattgacaccgctcgactggctgcccgaagtgttgggcgacgaatcgcaatttaccgccgccgaacgttccgaaatcgaacggctggttttggcaatggcgatggaaacaaccgccgcgatgtcggataaaaaactgcccgatttgtggctgtatgaaaacgaagacggcggcagcgatttttacacatggtgcaatgcttatctttacggtttggatattgtgccgaccgattggtttgaagccgtcgatgatgaagcgtttgaagagttgttttatcccatcatggcattgggcggtatttacgacgaagaggaaaacggcgctatccgtctgcaattcacagaaggcgagctggcggaactggaatccgagttgccttatgcattggcggatatctaccgctactggcaggcagtcatcaacaaaccgcaaaccgtccgcagggaaggcgaaaaaacaggcaggaacgatccctgtccgtgcggcagcggcagaaaatacaaggcgtgttgcggtaagaattgaagcgtttgtttccatgaaccaaacgtaaaaataccgtctgaaaccggatttccatgtttcagacggtatttttcacaggcggtcagtgctgttttttcatgccgaaccggacaaagccgacgatacccaaaacaatcatcgggacgctcaaccattgccccatcgacagccccaaggtcagcagcccgagatagtcgtcgggttggcgtgcgaattcggcaatgaagcggaatatgccgtagccgccgaggaagagcgaggcgacttgtccggtcgaccgctgttttttagagaacagccaaatgacggtgaacaggcagatgccttcaagtgcaaactgataaagctgcgagggatgacgcggcagcataccgtattgttgcagccattctgcccaaagcggattgtgcgcggcggcttcggcatcttcgtaacgcgcctgcgggaagcccattgcccaaaatgcgttgatgtcggtaacgcgtccccaaagttcgccgttgatgaagttgccgatacgtcccgaagcgagacccagcggaacgagcggtgcgaccgtatccatcagtttgaggaagccgatgccgtgtttgcggccgaacaaccgtatggcaataactacacccaaaaagccgccgtggaacgacattccgccttcccataccttgaaaatatcaagcggatgggcgaggtagtcggaaaacttgtaaaacaggacgtaacccaaacgcccgcccaaaattacgcccaaaatgccccatgtcaggaagtcgtcgagcgattctttggtaaaaacggacaagccttgcgcgatgcgccttctgccgagaaaggtaaaaagaataaatccgaggatgtagcttagggcataccagcggacggcaagcgggccgatactgataaggacgggatcgaattggggatgggtaatcataacgggctttcgttttcaaatgccgtctgaaaggcatgatgcttcagacggcatttctgcaataagggtttcagcgcaaatcgccgatgacgttgaggatagcggacaacgcggcttcgcccagccgtaaagaacgctgaccgttccagccgaagtcgtcgtcgggcagattggcattgtctttgaacggcatttccagcgtataggcaaggcagttgaaacggttgccgacccagttggtcgccaaggtcatattcgcttcgcccggcgcatctttttcgtaaccgtattcgtcttggaaatcggggctggcgtttaaaagggcatttttaaactgcgcttccaacgcggcgatgcgcggattgtagttcggcacgccttccgtacctgcgacaaagacaaagggcagcccttcgtcgccgtggatgtccaaaaacaaatccactccggtttccagcattttttcgcgcacgaagaacacttccgggcttttttctaccgtcgggttttcccactcgcggttgaggttcgcgccggcggcgttggtacgaaggttgcccagtgccgaaccgtcggggttcatattggggacgatatagaacgtggcgcggtcgagcaaggcgcgggcggtagggtcttgcgggtcgagtaatctgccgagcagcccctcgataaaccattccgccatggtttctcccggatgctggcgggcggtaatccagattttcaaatcgctttcgacctgattgcctatggtcagcagattgatgtcgcgcccttgcacggtgctgcccaagtcgtcgatgcggcacaggccgctgccttgcgcgtcgccgaggaggtttaaatgctgttcttcggagtaaggttcgaaataggcgtaatacacgctgttggacagcggagtatgattgacggtcagtacgccgttttcgtaggaagtcggtacgcggaaccagttgcggcggtcgtatgaggcacacgcctgatagccttcccagcctttcgggtaggcggcttctgccgcgttttcaaaatgcatgatgcagttttgatatgccgcgccttgcagccggaagtagaaccattgtgcaaaatcggaggcgttgtcgggacgcagggcgaggcggatgttggaaggatcggtcaggtctttgacgacgaccgagccggcatcgaagcgggtgctgattttaatcatgggaaagtccttgctgtcgccggtttctcgaaccggataaaccgcgattttaccgcccgtatcgcaaggcttcaacctgcccgaaagtctgccggatgccgtctgaagattgtttcagacggcgtttggcgttaacataagccgaaattgtcaacaatagggagccgttatggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctgaagcaaagtcggaaaatgccggctttggcggaaaacctgtttgtctggtttctgtttttggggtttcgggcaatttccaaaccgtcattcctgaaaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatagaaacaaaaacagaagcctaagatccgtcattcccgccgggcatctggttttttgaaatccggttgtttgggataaattctccggctttgattttttgtttttccgataacgccataactttgaaatttcgtcattcccgcgcaggcgggaatctagacctgtcggcacggaaacttatcgggaaaaaaggtttctttagattttatagtggattaacaaaaaccagtacggcgttgcctcgccttagctcaaagagaacgattctctaaggtgctgaagcaccaagtgaatcggttccgtactatttgtactgtctgcggcttggtcgccttgtcctgatttttgttaatccactatacgtcctagattcccactttcgtgggaatgacgggatgtgggtttttgtgcggatttgaaccggtaagggtggtgtgggattggtggtttgcttaggatcttttggattgtattttgtatatacatttacttgttgataaaagataaaataaaattagaaactaaaagtgagaaaaaattaataataatagggatgtataaatgtaaaggctccgtttcatagctaaggttatctgaatatatggaaaaaaagtaaaagtccataaaactaaaatatatagataatgctaatgataatagaattatcactttcctagagtaaggataatatttttttatcgtaaaaaaatataaaataggataaataattgccatatagatagattttgtaacaaaattaaaaataaataataaaaataatgtaataaagtatattttttggctatgaaataaaattgtacataattgaacgagcagatcaaaaaatgaactacatataacaataaataataacgtatttaccatactaaatttaataggtctcattatcatatttaataaccacttcatagtatagtggattaaatttaaaccagtacagcgttgcctcgccttgccgtactatctgtactgtctgcggctttgtcgccttgtcctgatttaaatttaatccactataaatgcagagtgggtggaaacactcactttatggtttgctacgctctgctcaattagcaacccgataacccaatatggataatagggtaattaatccaatctaatttgtcagcatccgttaatttattgcaaaataaagtattgaattatgtcgggtgcaaatgacgaaatataagtttccgtgcggacggatcaagattcccactttcgtgggaatgacggtggaaagattgttgtttttcccgatgaattcctgtgttttttgtttttccggataaattcctgtggctttgagttttttggatttcagcctcaatgccgtctgaacgccgaatcgggcttcagacggcattgcgtcatttgaaattcaaaaccggccagcctttttctttggcttctttttccagctcggcatcggggttgacggcgacgggttcgctgacaaggcgcagcagcggcaggtcgtttttggagtcgctgtaaaaataggttttgccgtagctttggagcgtttcgccgcgttcggcaagccattggttcaggcgggtgattttgccttctttgaggctgggcgtgccgatgtaattgccggtgtagcggccgtcagaaccggtttcgagttgtgtgccgatgatgttggtgatgccgaaaaggtggcagacgggggtgatgatgaactcgttggttgaggaaatcacaagggtttcgtcgcctgccatttggtggctctgcaccagcatacgctgcataggcgagatgtgggggatgatgtattccgccataaattcgcggtgaaactctgccagctcttctttgctgtaacgagcgagcggggcaaggtggaatttgaggaatgcgtcgatgtcgaggcagccgttttggtagtcgcggtagaatttttcgttttgcgcttcggtttcggcagcgtcaaccaagccttttttgatgaggtattgcggccaggcgtggtcggaatcggtgttgatgagggtgttgtcgaggtcgaagatggcgaggtttttcattgggtttcctgttgtttcaaaagctggcgcaaaagcggcagggtgatgcgtttgcccatcgtgacggcgtagttgtccagcgtgtcgagcatcatcatcaggctgtccatatcgcgccgccagtgtttgagcaggtattcgaaaatttcggaatcgacggttacttggcgtgccgccgccatactggcgagcgcgtcgattttttcttggtcggttaagggtttgacttcgtaaacgaggcagtacgccatacgcgtccgcaaatcttcgcggatgacaagctgctggggcgtgtattccgaaccgagcagcaaaaagcctttgccgctgttgcggaagcggttgaagatggaaaaaagcagggcttgttcttcgttgcccagtttttcgacttgatcgacggcgaggtattccgcctcgaacgcggcatcggtcagcggcatggaggcggcatcgatataggcggcgtttttgccggcttcgagcgcctgtgcgacccacgcctgcaaaagatggcttttgcccgcgccttcttcaccccagacatagataaactgtccgtgtttgtgtcggaggacatagaccagttccgcgttttccgtgccgaggaatttgtcgaaactcggatagtcgtgtgcggcaaagtcgaaaataagctggttcacggttcggcattccgaggggtggtaaacgggtttattgtacgttgttttcgcgcgcctttccaatttgaacgatgccgtctgaaaacggcttcagacggcatcgttcaaccgcaggcaacgttgccgacatcgaggcgcatattgtggaacgcgttgagcgtgctgcggtggccgatgctgatgatgatgctgtcgggcagtttttgtttcagtgcgcggtagagcagggcctcggtcggttcgtccaaagcggcggtggcttcgtcgagcaggacgattttgggcttggaaagcagggcgcggacgaaggcgacgcgttgcagttcgcccggggagagtttgtgttgccagtcgtcggttttatctaatttatcaaccagataacccaagcggcaggtgttcatggcttcggctaactcgggatgctgcttgtcaatgtcggggtaacaaaccgcgtcgcgcaggctgccctgtgccgtgtacgggcgttgcggcaggaagaggatgtcttgatgcggcggacggctgactttgccgctgctgccgaacggccaaagccccgccagcgcgcgcaacagcgaggttttgccgcaaccgctcgggccgcgtatcagcagggaatcgccgtttttgaggtttatgttgatgccgctcaacaggatttcgccgttgtggcggaacagagcgacgttttcctgtgggggactgttagtttttgcacaaggaacaaatagagtaaaaaaacgctgaaatcttcggaagacgtggatttcggcgtttttttgtatccggaaaagttacgccagctttttcacaaaaccgcgccggaatgcgcggttttctgtttaaagctgacgagattagggaatttttaaaactgttttaagaggtttttaaaatggatttaatcaatactccggccataccattcaacacggcctatgatggcgatgtcgtcttgggcattgctcaaatctatttcaaacggtgcgtaacgtggattttcagacgttacaagcagtttgcccggtatacgttgcacacgtttgacaaagaggtcattgcctatacgcaagacatataggccgtcacgcgggtcagtttcggcgtggttgatgagaatggaatcctcatgattgagcacgccctccattgaatcgcctttaacggtaattacagacagtttttccggctgtttggtcacatagttgtcaatccaatatttccggaaagccaagcagaataaaggttcttcgccgaagactggtgcgccataccctgctgctgcggctacgttgtagcgcggcacgaatacaaactcggacaggtcgacaggattgcccatagtgtcggtgattccatcagaatttctacttacagagaatgctccggcgttttccggcctggctttatcgagatacggcaagccttttccggtcagcagccagtttaaatcacaactgaatttttactaggtaatcggctgttgggatagctccctctttccaaactctattaaatccagaagccgacatttctattttgttatagatgtcagatggcttagccccatgaggccaaagaaatttgagcctatctaaaaaagtatccatagtaatcctaatttaactcatttaagcaaaacattaagcaaaaaaagaaactcttttgcttaaataagattactcaaataatcaatattttgtaaaaataattacgtttttgagaaaatattttagcaaaagagtttcatgaagctgttttgctaaatgtaattcactcatttgctaaatgacggcggttaataaacctacttaattaaggaattgcgagaatgaaaaaaagcaagaaagcatgactgattggcatcgtgctgacattgtggctcgtcttaaaaaggcaggctggtctgtgagagcgttatctatcgaggctaatttagcaccaaatacattagggaaagctttagatgctccttatctgaaaggcgaaagaatcattgcagcagcgattggagtacccgcagaagaaatctggccatctcgttttgagaaacgaaaccataagccaaccttcccaagatctataaatagataactgttttgctaaatagttccaaaagagtaccgcatttaagcaaaaatagaaagcggaaaaaatgaaaatatctgcatctgatattgcgaaattaggaattccgagcctaccaactgatagacaagggattgaataccatgccaagaaaaataattggcaacactgttttgagcaaaaaggaagaggccgtcctaaaaaactgtatgaaatcgcttccctccctgccgaaatccgagcagccatcatgaaacggcagtcggacgagctggcggagaagatgccgaaaatgctgcccaaagtcagaccggggacggcgatgtcggctcaagcactggctgaagcggccaagctgttgaacgagaaacaacggtcggtggcggatgcgcgatgtgcggtggtagcggcggtattggggattaaatacgaatacgattgctctgccaaggctgcggtggctcagtttttgggcttgctggcagaaggtaaattggacgcggtcacgcttgggaacttggaaaaggccaatgaccgcagccggacggcgaaggtcggcgaacgtactttagacggctggatttctgcttatttgaaagcggaaaacgcgacggagcggttggttgctttggctccgaagacgacgaaggcggtcaagccgattgaaagttacggatggttgccgatgtttatgcagtttcacaatattccgtccgcgccaaagctggcgcacagctaccgctggtttgtgcagtgggcggaagcggaaaatatgccggtcaatgatgtgcctaacttgagtatggtgcggcgcgtttgggaaaagctcccgttgattatgcaggagcgcggcaggaaaacgggggcggcttataaatcgctgctgccttatgtgaaacgtgattggggggctttgaagccgaacgatgtttggatcggcgacggccatagctttaaggcaaaggtggcgcatccggtacatggcagaccatttaagccggaagtgacggtgattattgatggttgtacgcggtttgtggtcgggttttcggtctctcttgctgaaagttgtgtggcggtatcggacgctatgcgtatcggggtcaagcattttggtttgccgattatctattactcggataacggcggcggccaaaccggcaagacgatagaccatgaaatcacgggtattacgtcccgaccgggtatccgccatgaaacgggtatcgcgggcaacccgcaagggcgcggcatcattgagcgatggtggaaagacaatctgattgagatggcgcgccagtatgagacgtttgcgggtgcagggatggacagcagcacgaagaacctgatgtaccgcaagatggaaagtgcgtttaacgctttggaaaaaggcaaggatttgacggaggaacaacagaaatatttgaaaaaactgccgagctggtcgcgttttatagcggatgtggtcaagtgtatcgacgaatacaacaaccgcccgcacggcgagctgccccgacatcctgacggcgggcattatacgcctaaggcttatcgggaaatgaggctggaacaggacggtatcgcgccggatatgttgtcggcgcaagagctggcgacgatgtttatgccgcaagaggtgcgaaaggtacagcgcggttggctggatttgtttaacaactcttatttctcaaccgagctggcggagtatcacaaagacgaggtacgggtcagctacgatttgagcgatgcgtcggcggtcaatgtgtttgatatggacggcaagtttattactaaggcgcaggccaacggcaatacccgcgaggctttcccgacggctcgtatcgaccaactggcggaaaaacgtcgaaaaggcaaaataaagcgggcggaaaatgcaatcaagctcgcaaacgcggaagtcaatcctgctctggaacaggctgcggtttgggacgagctgggacatttgggcggaaacgacatcgaggcggagtatgcggtattgccgaaaacgggcacagacgattttgtgttgtttgaggcggatagataaaggaaaacatgatggacaaacagcaaaatgcagcgttttcggccgagcttgttgaaaaattgaaactcaagcgagctcttgggcggattcaacgagctcaagcaaagattcaaggtgttcccgctgaacggaatcaggctcaaacgtttttgcctgcgcttgaaggaaactgcgaacctgctcaatcgaagtcggctcttgacgggtaatccgctggagcagccaggaaagtacgaaagaatcggcaagtgacctgtcttccaagtcttgaacggcgacttccagcatgatcaggcgtttttctaaatcgggaaactctttcatttcagacggcctttaaaggttgtttaaaactcaaggatattaaaaatgaaacaaattaatcaagcattgcaacaaaaactggttgaatttaaagaaaaatcaggcatgaaccaaacccaactggcacgcggtatcggtacttcgccggcatccatcagtatgtatctgaacggcacttatgcggaaaaaggcggcaattatgaaaccatcgagccgaaaatcgaggcgtttttggagatgcaggacagtaaagcgcaacgcgaagagctggtgttgggttttgtatcgactaagacgacccgccgtattgcagaagtgatgcgcgatgcgcacgaaggcggcgaaacagtggtgatctacggtcaggcgggattgggcaagactcaggcggtcaaaaactactgcgagaaaaaccctgcggccatcttgattgaggctaatccgagctttacggctttggtcttgatgcgcaagttggcgactgcggcgaaggtatcggcgatgggcagcctgaatgatttgtttgagtctgtatctgaccgcctgcgcgattcgggccgtctgattgtggtcgatgaagcggaaaacctgcctttacgcgcccttgaaattgtacgccgtctgcacgacgagactggctgcggcttggtgttgagcggtatgccccgactggtggccaacctgcgcggtaagcatggcgaactggtacagctttacagccgcgtgtctgttgcgctgaatttgggcgaatctttgccggatgacgaactctttgagattgcgaaagcggctttgcctgatgcggtcaagcatctgctccctgatagtgtacaagcgttgattacggtcatcgggtttaatgaaacgctggagctggtgcgcctgatgggcggtacgacttatcctttgcggcagggttatacgaaaaacagtcaatcccgtgttgcatacttggaagagattatcggcagtgaggcggccggtcggctggtggaggcaatggctccgtgcaatctgtttataccccgttgcgagacggccttgtatgagttgcgaaaccgtaaaatccgcagtcagtttgaccggcagacggcaggcggtacccctgcttatgaggccgttaacgatttggccttggcacaccgcctaagcgaccgccatgtgtggcgaattttaaagcaggcggataaggaagcggagcaggagaatttgttttagaatggaatgccatgcagatgtatggcattttattttggagaaaaatatgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataaaataaacgattctaaggccgtctgaacaacaggcggcttttttgttgcctactgacactgtttcgcccgctgcaaaagccatgccgtttgaaaatgtaagcctctgaaagtgcattttaatctgattttgagggaggctttaatgagcaaaattatttgtctgactgccggacacagtaacaccgacccgggcgcagtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaatcatgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatagcaatgcgtattttggatatttttaaaaacccggcgacaggcaatgtgtcgcactcgaaactgtgggcaaacgttgcctgcgcggctgggacgtttaagtttgtgatgttgccctat

SEQ ID NO: 13 - DNA, 47475 bp, Neisseria meningitidis
gaacgctcgaccaacggattaaaagtccgctgctctacccccgggagctaacgacccgataagccgtgcattatacagcaccatcctacctcgtcaagcaaattttacaggcttaattgcagaccactgtttgcacgggatattttgacaacggattttcacaatccgccgcataccgtgtaaaagttcgcacaaggaaaagcaaaccgcccgaaatcaatgtacactttccgcccgtttcccttcccaacctgcacacagaaacacacattatgaacatacaaaacatccgcaccctcctcgacaccgtcgccgttccgaatacggcacgcacgctcggcggcgaaaaggccgtccgttcggtcgaacagcgttcagacggcatccatatcgccctgcatttcggcttccccgtcgcgcacattgcctcagaaacagccgaccgcatacaggaaatcctgatgcccgaaacaggcgacacacacatccatctgtccatggacactgaaatcggcacacacaaagtccagcccggcgttaccaccatcaaaggcgtgaaaaacatcatcgccgtcgcatcgggaaaaggcggcgtgggcaaatcgacaaccaccgccaaccttgccgccgcaatggcgcgcatgggcgcgcgcgtcggcgtgctcgatgccgacctttacggcccgagccaaccgaccatgttgggtgtggacgaccgcaaacccgatcagaaaaaccaaaaactcattcccgtcgaatcttcagacggcatacaggtcatgtctatcggctttctcgtcgataccgaccaagccgtcgtctggcgcgggccgatggtcagccaagccttgcagcagctgatgttccaaagcgagtgggacgaagtggactacctgtttatcgacctgccccccggcacgggcgacatccagctcacgctgtcccagcgcatccccgtaaccggttccgtcatcgtaaccacgccgcaggacatcgccctgatagacgcgcgcaaagccgtggatatgttccgcaaagtcaacattcccattttgggcgtattggaaaatatgtccgtccacatctgcaccaactgcggacacagcgaagcactgttcggcacggacggcggcaaagatttcgccgcacgcctcaacgtccccctgctcggacagcttcccctaagcctgcccgtgcgcgaagccatggacggcggcacaccggcgcaactgttcgacgaacaccccgccatcgcccgaatctacaccgatgccgcattccaaatcgccctgagcattgccgacaaaggcaaagacttcagcagccgcttccccaaaatcgtcgtcgaataaagccgcgtccgaaaccgcaacagcaatgccgtcccaagccccgcgcctgccggcgggcaaacttgccggataaaacggtttttttgagattttacgttccggattcccgcctgcgcgggaatgacgaattttaggtttctgattttggttttctgttttgtaggaatgatgaaattttgagttttaggaatttattggaaaaaacagaaaccgctccgccgtcattcccgcgcaggcgggaatctagaccttagaacaacagcaatattcaaaggttagctgaagctttagagattctagattcccactttcgtgggaatgacgggatgtaggttcgtgggaatgacgcggtgcaggtttccgtgcggatggattcgtcattcccgcgtaggcgggaatctagaccattggacagcggcaatattcaaagattatctgaaagtccgagattctagattcccactttcgtgggaatgacgggatgtaggttcgtgggaatgacgcggtgcaggtttccgtgcggatggattcgtcattcccgcgcaggcgggaatctagaccttagaacaacagcaatattcaaaggttagctgaagctttagagattctggattcccactttcgtgggaatgacgggatttgagattgcggcatttatcggaaaaaacagcaaccgctccgccgtcattcccgcgcaggcgggaatccagaccttgggataacagtaatattcaaagattataaaagacccgtcattcccgcgcaggcgggaatccagaccttagaacaacagtaatattcaaagattataaaagactcgtcattcccgcgcaggcgggaatccagactgtcgggcatctgcagcggtttgctaaaaaacgctttaccgtgatcagtgtgcaaagttaaaatggggaggtaagcttttcaatcagcaatccggcgggcgcgggatcgggcggtttaccgaaccccggtgttcgcggcgcgcctgccgccgacggtatcccgcgaagcaagatttaagggataaaatatgttccaacacgcagggcggcacataaggcgccgccctgattcggaagggcttgcacccctcccggacaaagcctgatcctgccgccccgaaggacggatgcccgaagggcggggggtttgaccgaaaaggaaatacgatgaataaaactttaaaaaggcgggttttccgccataccgcgctttatgccgccatcttgatgttttcccataccggcggggggggggggggcgatggcgcaaacccataaatacgctattatcatgaacgagcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatcaaaccatcgtctctacgacagaaggctcccctatttcccttggcgaccagcagcgcgaacataccgccgtggtctattatctgaacgccaaactgcacctgctggacaaaaaagggattaaagatatcaccggcaaaacagtgcggttgggtgtcttgaagccgagcatcgatgtgaagacacaaaatacggggcttggcggcattctagcttattgggctaggtgggacattaaagataccgggcagattccagtcaagctcggcctgcagcaagtcaaagcaggccgctgcatcaataaaccgaaccccaatcccaacaaaaaagacctttcgccggccctgactgcccccgcgctgtggttcggacctgtgaaagatggtaaggcggagatgtattccgcttcggtttctacctaccccgacagttcgagcagccaaattttcctgcaaaacctttcccgcaaggatgacacaagcaaaccgggccgctattccctcaaacccttgagtacgtcggagattaaaagtaaagagccgagtttcacggggcggcaaaccgtcatccgattggatggcggcgtacggcatatccaactggatagaaacaatgaggccaccggtttaaatggaaatgacggcaaaaacgacactttcggcattattagagaagggagcttcatgcctgatgccagcgagtggaaaaaagtattgctgccttggacggttcggggttttgctgatgacagtaaatttaaagcattcaacaaagaagaaaacaacgacaacaagccaaaatacagccaaagataccgcatccgcgaaaacggcaagcgcgatttgggcgacatcgtcaacagcccgattgtcgcggtcggcgagtatttggctacttccgccaacgacgggatggtgcatatcttcaaaaaaggcaacggggacgcgcgcgactatagtctgaagctcagttatatcccgggcacgatgccgcgcaaggatattcaaaacaccgaatccacccttgccaaagagctgcgcacctttgccgaaaaaggctatgtgggcgaccgctatggcgtggacggcggctttgtcttgcgccgcattacagatgaccaagacaagcaaaaacacttctttatgttcggcgcaatgggctttggcggcagaggcgcatacgccttggatttaagcaaaatcgacaacagcaacccggccggcgtttccatgtttgatgtcaaaaacgacaatggcgtgaaattaggctacaccgtcggtacgccgcaaatcggcaaaacccacaacggcaaatacgccgccttcctcgcctccggttatgcgactaaagacattaacaacggcgagaataaaaccgcgctgtatgtgtatgatttggaaaacaacaacggtacgccgattgcaacaatcaacgtacccgacggcaagggcgggctttcgtcccccacgttggtggataaagatttggacggcacggtcgatatcgcctatgccggcgaccgcggcgggaatatgtaccgctttgatttgagcaacaacgatccgaccaaatggtctgtacgtactatttttaaaggcacgctggataagccgattacctccgcgcccgccgtttccaaactgaaagacaaacgcgtggttatcttcggtacgggcagtgatttgagtgaggatgatgttgataaaaaggatatacaatctatttacggtatttttgacaatgacacaggcacggatgtggcagaagaaggacagggcaaagggttgctcgagcaacaccttactcaggaagataaaaccttattcctgaccgattacaagcgatccgacggctcgggcgacaagggctgggtagtgaaattggaagccggacagcgcgttaccgtcaaaccgaccgtggtattgcgtaccgcctttgtaaccatccgcaaatataacgacggcggctgcggcgcggaaaccgccattttgggcatcaatactgccgacggcggcaagctgaccaagaaaagcgcgcgcccgattgtgccggaagccaatacggctgtcgcgcaatattccggtcataagcaaaccgccaaaggcaaatccatccctataggttgtatgtggaaaaacaatgaaaccgtctgcccgaacggatatgtttacgacaaaccggttaatgtgcgttatctggatgaaaagaaaacagacggattttcaacaacggcagacggcgatgcgggcggcagcggaacattcaaagagggtaaaaaacccgcccgcaataaccggtgcttctccggaaaaggtgtgcgcaccctgctgatgaacgatttggacagcttggatattaccggcccgatgtgcggtatgaaacgaatcagctggcgtgaagtcttcttctgatttgcacgcgaaaatgccgtccgaaaggttttcggacggcattttttgcgtttttcgggaggggcgggttcgtaaaaggcgggctatagggtaggcttcatctcgccaatctcactgaatccatcaatttccacaattcaattaaataccgtcaaaccgatgccgtcattcccgcgcaggcgggaatctagacattcaatgctaaggcaatttatcgggaatgactgaaactcaagaaactggattcccactttcgtgggaatgacgggatgcaggttcgtgggaatgacgtggtgcaggttcgtaggaatgacgtggtgcaggtttccgtgcggatggattcgtcattcccgcgcaggcgggaatccagacattcaatgctaaggcaatttatcgggaatgactgaaactcaaaaaactggattcccactttcgtgggaatgacgggattagagtttcaaaatttattctaaatagctgaaactcaacgcactggattcccgcctgcgcgggaatgacgaagtggaagttacccgaaacttaaaacaagtgaaaccgaacgaaccggattcccactttcgtgggaatgatgggattagagtttcaaaatttattctaaatagctgaaacccaacgcactggattcccgcctgcgcgggaatgacgaattttaggtttctgattttggttttctgtttttgtaggaatgatgaaattttgagttttaggaatttatcggaaaaaacagaaaccgctccgccgtcattcccgcgcaggcgggaatctaggacgtaaaatctcaagaaaccgttgtacccgataagtttctgcgccgacaaacctagattcccgcctgcgcgggaatgacggttcagttgcgtaggactggattgtgaaaaggggcggattcggtgaaaacggcggaaatgtgggattgatggaatcggtgggctgaagccctccctacagagctttcagacggtattgtttgcgttttcgggatgggggcaaatgaaacaccgacaaaccgataccgtcattcccgcgcaggcgggaatctagacattcaatgctaaggcaatttatcggaaatgactgaaactcaaaaaactggattcccactttcgtgggaatgacgattcggacattccttaaactacccgtgtatcgctgtaaatcttagagatggaggaataaagaccgttgggcatctgcagccgtcattcccgcgcaggcgggaatctaggatgcggaatctcaagaaaccgttatacccgataagtttctgcaccgacaggtctggattcccgcctgcgcgggaatgacgattcgggtatttctgacggttcgggcattcccgacaaggtggattttcaaggtgttgtatagggtgtaggaggattcgtaaaaggtgagttatagggtgggcttcagcccaccgattccaacgattccaccaatcctacaccgttcccatagactcaaatcaacacagaaacttatgcgccgtcattcccgcgcaggcgggaatctaggatgcggaatctcaagaaaccgttatacccgataagtttctgcaccgacaggtctggattcccgcctgcgcgggaatgacgattcgggtatttctgacggttcgggcattcccgacaaggtggattttcaaggtgttgtatagggtgtaggaggattcgtaaaaggtgagttatagggtgggcttcagcccaccgattccaacgattccaccaatcctacaccgttcccatagactcaaatcaacacagaaacttatgcgccgtcattcccgcgcaggcgggaatctaggatgcggaatctcaagaaaccgttatacccgataagtttctgcaccgacaggtctggattcccgcctgcgcgggaatgatggttcgggtattcctgacgattcgggtattcctgacgattcgggtattcctgacgattcgggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcgggtattcccatagtttcgccgggcggacgtggggaaatgcgtaacgggcatagtgggcgcggagcgggcggttttatgccccggatttccgttttcgcgcgaacatatcagcccgcctgccgcgtttgcgcttgaaatcgggtatgtttcgtcttaaaatatgctgctttcagggtataggcacttgcccgaaaagcacgttacgcgtctatcttgcgcggcgtgtttttttttgaccggatttttccgaccggatgccccctgccgaagtcccttcagacggcattgtcaagaattttattaaaaacaggattcccatcatgagcacccccgccctcctcgtcctcgctgacggcagcgtatttcacggcacatcaatcggttacgaaggttcgacttccggcgaagtcgtgttcaatacttcgatgaccggctatcaggaaatcctgaccgacccgtcctactgcaaacaaatcgttaccctcacctacccacacatcggcaacaccggcaccaacgccgaagatgaagaaagccgcagcgtttatgccgccggcctgattatccgcgacctgccgctcttgcacagcaacttccgcgcctccgaaagcctgcacgactatctggtacgcaacaaaaccgtcgccatcgccgacatcgacacccgccgcctgaccacgctgttgcgcgaaaaaggcgcgcaaggcggtgcgattctgaccggtgcggatgccacaatcgaaaaagcgcaagaactcatcgccgcgttcggcagcatggtcggaaaagatttggcaaaagaagtttcctgcacggaaacttacgaatggacggaaggcgaatgggcattgggcaagggtttcgttacccctgacgaacagccttaccacgtcgtcgcctacgatttcggcgtgaaaaccaacatcctgcgtatgctcgcctcgcgcggctgccgcctgaccgtcgtccccgcccaaacgagcgcggaagacgtgttggcactcaaccctgacggcgtattcctatccaacggccccggcgaccccgagccttgcacctacgccatcaaagccgtacaaaaactgatagaaagcggcaaaccgatttttggcatttgcttgggacaccagctcatcagcctcgccatcggcgcgaaaaccctgaaaatgcgcttcagccaccacggtgcgaaccaccctgtgcaagatttggacagcggcaaagtcgtcatcaccagccaaaaccacggttttgccgttgatgccgacaccctgcccgctaacgcacgcattacccacaaatccttgtttgacaacactttgcaaggcatcgagctgaccgacaaacctgtgttctgcttccaaggccaccccgaagccagccccggtccgcaagatgtcggctatttgtttgacaaattcattggcaatatgaaagcggcaaaacgggcataatggttttcagacggcaacagtatgctgctgccgtctgaaaaacaaagctggaaatgaagattagcgcactcgaccatctagtactaactgttgccgacattgaccgaaccatcgcgttttatagtgaattaaatttaaaccggtacagcgttggctcgccttgccgtactatttgtactgtctgcggctcgccgccttgtcctgatttttgttaattcactatacacacaagttttgggcatggaagaagtttcatttggcagcgaccgtaaagctttgttgtttggcagtcagaaaatcaacctacacgggcgcggtgcggaaattcagcctaacgcgcaacacgccgcctgcggcacagcggatttatgcctgctgaccgatacgccactggaaacggttttacaggaattatccgcacacggcatcaaacctttaagcggcatcgtagcgcgcacaggcgcaatgggcaaaatccaatcggtttacctgcgcgatcccgatggcaacctgctggaaatcagcagttattgattttcagacggcttatgcaaaataaaaaacagcctgcacaagctgttttccttgcagcctctttaaccccaacagccgccccgtcctctctccctgtgggaaagcgttagagagagggcaacaagccgcaaggcttgtgtttgggcggttagggtgttggggaaggttgccgaaattcggggaatgccctctccccggccctcccccacgggggagggagaaggttgcagcagattttgcggttgcaggcggtttgaaaggcaacttagatttgcagctgttgtttcaggtcatctgaaaaataaaaagcagcctgcacaacctgttttccttgcaaaacccttaatcccaaccgccaccacgtcctctctcccatgggagagagtcagagagagggcaacaaactgtaaggcttacacaaacagtaacccgacaacagaatgagcacgcacgagaaacttttaaccgccgacaaccccgtcctgcatcaacgcgccaaagccatgcgccaagaaatgagcgaggcggaagcaaaattgtggcagcacctgcgggcaggccgtctgaacggctataaattccgccgccagcagccgatggggaattatattgttgattttatgtgcgtaacgcccaagctgattgtcgaagcagacggcgggcagcacgcggaacaagccgtatacgaccacgcgcggacggcatatctcaacagcctgggctttaccgtgctgcgtttttggaatcacgaaattttgcagcagacaaacgatgtactggcggaaatcctgcgcgtattgcaggaattggaaaagcagtatgcgcaataacaaacggttaattttgattagagttttgaaaattataggatacaggtagggtacaggctgcttgaattgagcgtttagaagaccgtctgaaaaacaaaaaacagcccgcacaacctgtttttcctgcagaacccttaattccaacagccgccccgtcctctctccctgtgggaaagcgttagagagagggcaacaagccgcaaggcttgtatttaggcggtgaaggcattggggaaggttgccgaaattcggagaattccatctccccagccctcccccacgggggagggggcaggttgcagcggattttgcggttgcaggcggtttgagaaagaatgcccgaaatatcaacagcgggaatttttcaggcagcctttatcgcaaggcaggtggaacaaacgccgcgaacgttttttcagacgacctttgaactcatcggcagagagtgtgccgcaaggcacgcacgcggtgggttggggttgcagggaaaatggagaacgcgtgcatacgtaccgcacataccctacatacgggctacggcttgctacgatacgggggtttcgatatacaagttaggttttagcaaacccaacattttagacaattaagcggtttgtgttgggttttcaacccaacctacgcttgctacgtttattgcaacatattcgcaggagtttaaatatgtcaatacctattaatttcaataatttaaagtatttgcttaatgatatgagaaacaaaaatagaataattgaagcatttccttttaattataatcaaaggcaatacgccgttattttgactaggtataaacctgatgaacctagaccagatgattatgcacaagcaaaattagagttttttaatttgaatagtgaaaattcaatatttgcgtatgctgatttttatgaagttcattttaaaagtgctactgattttattaatttttttaaaattaatgttcaggctggtgctgcgaaaatcagagaaatttttcagagttttagtaatctttttgcagatttcattccaacacaaactaaaaaagatttagacataatttataaaaagattgtagctactcgtttagaacctaattctcctaacactatttattgctatgatgtccgtagaaatgggaaagataaggctggcaagcctaatcgcaggagcgtggaaaatagtgaaaaagcaaaaattttgcgcccagagctatacgaaaaatttaaagccgatagtaattacagttttttcttttcagataatccaagcgatgaaaaaacagatgcagaaataattagagaagttaccaatcgtcaataatccaaattcttcaaaagaaagacccaccatgcccaaacgtaccgacctaaaatccatccttatcatcggcgccggccctatcgttatcggtcaggcctgcgaatttgactattcgggcgcacaggcctgcaaagccttgcgtgaagaaggctataaagtcattttggtgaattccaaccccgccacgattatgaccgaccccgaaatggcggatgttacctacatcgagccgattatgtggcagacggtggaaaaaattattgccaaagagcgtcctgacgcgattctgcctaccatgggtggtcagactgcgctgaactgtgcgctggatttggcgcgcaacggcgtgctggcgaaatacaatgtcgagctgatcggcgcgaccgaagacgccatcgacaaagcagaagaccgtggccgctttaaggaggcgatggagaaaatcggcctctcctgcccgaaatcttttgtctgccacacgatgaacgaagctttggcggcgcaagaacaggtcggcttccctaccctgattcgtccttctttcaccatgggcggttcgggcggcggcattgcctacaataaagacgagtttttggcgatttgcgaacgcggtttcgatgcgtcgcccacgcacgagctgttgattgagcagtccgttctcggctggaaagagtacgagatggaagtggtgcgcgataagaacgacaactgcatcatcatctgctcgattgaaaacttcgacccgatgggcgtgcatacaggcgactcgattacggttgcgccggcgcaaacgctgacggacaaggaatatcaaattatgcgtaatgcttcgctggcggtattgcgcgaaatcggcgtggacacgggcggctcgaacgtgcagtttgcggtgaaccctgcaaacggcgagatgattgtgattgagatgaacccgcgcgtgagccgttcttccgcgttggcttccaaagcaacgggtttcccgattgcgaaggtggcggcgaagctggcggtcggctttacgctggacgagttgcgcaacgacatcaccggcggcaaaacccccgcgtcgttcgagccttccatcgactatgtggttaccaaaatcccgcgtttcgcgtttgaaaaattccctgccgcagacgaccgcctgaccacgcagatgaaatcggtgggcgaagtgatggcgatgggccgcacgattcaagaaagtttccaaaaagccctgcgcggcttggaaacaggcttgtgcggcttcaatccgcgcagtgaagacaaagcggaaatccgccgcgaactggcgaaccccggccccgaacgtatgctgtttgtggcagacgcgttccgcgcgggcttcacgctggaagaaatccacgaaatctgcgccatcgacccttggttcttggcgcaaatcgaagacttgatgaaggaagaaaaagcggtttcagacggcattttgagtgatttggatttcgccgccctacgtcgtctgaaacgcaaaggcttctccgacaaacgtttggcacaattgttgaacgtaagcgaaaaagaagttcgcgaacaccgctacgcgctgaagctgcatccggtttacaaacgcgtcgatacctgcgccgccgagttcgccaccgaaaccgcctatctttactccacttacgaagaagaatgcgaatctcgtccttccgaccgcaaaaaagtgatgattctcggtggcggcccgaaccgcatcggtcagggcatcgagtttgactactgctgcgttcacgccgcgctcgccctgcgcgaatcgggctttgaaaccatcatggtcaactgcaaccccgaaactgtgtccaccgacttcgacaccagcgaccgcctgtatttcgagccgctgacgctggaagacgtgttggaaatcgtccgcaccgaaaacccgtggggcgtgattgtgcattacggcggccaaaccccgctcaaactcgccaacgcgctggttgaaaacggcgtgaacatcatcggcacgtccgccgacagcatcgacgccgccgaagaccgcgaacgcttccaaaaagtgttgaacgacttaggcctgcgccaaccgcccaaccgcatcgcccacaacgaagaagaagcgctcgtcaaagccgaagaaatcggctatccgctggtcgtgcgcccgtcttacgtcctcggcggccgcgccatgcaggtcgtccattccgccgaagagctgcaaaaatacatgcgcgaagccgtgcaggtttccgaagacagccccgtgttgctcgacttcttcctgaacaacgcgattgaagtggatgtggactgcgtttcagacggcaaagacgtggttatcggcggcatcatgcagcacgtcgaacaggcgggcatccactccggcgactccggctgctcgctgccgccctactccttaagcgaagaaatccaagacgaaatccgccgccaaaccaaagcgatggcgtacgcgctgggcgtggtcggactgatgaacgtgcagtttgccgtacaagacggcgtagtgttcgtattggaagtgaacccgcgcgccagccgcaccgtgcccttcgtctccaaagccaccggcgtgccgctcgccaaagtcggcgcgcgctgcatggcaggcatttccctgaaagaacaaggcgtggaaaaagaagttgtccccgatttctatgccgttaaagaagccgtgttcccattcatcaaattcccgggcgtggatacgattttgggaccggaaatgcgctccaccggcgaagtcatgggcgtgggcgcaagctttggcgaagcctactacaaagcccaactcggcgcgggcgaacgcctcaacccgaccggcaaaatcttcctctccgtgcgcgaagaagacaaagaacgcgtcattaaaaccgctaaaaacttccaagttttaggctacggcatctgcgccacgcgcggcacggcgcaatacctgaccgaacacgggctgattgtgcagaccatcaacaaagtacccgaaggccgcccgcacatcggcgacgcgctgaaaaacggcgaaatcgcactggtcgtgaacaccgtttccagcgatccgcaatccgtgtccgacagccacatcatccgccaaagcgcattgcagcaacgtgtgccgcaatacaccaccaccgccggcggcgaagcgatgagcgaaggcgcgaaaagccgagaccatctgggcgtgtacagcgttcaagaactgcacgggcgtttgaaaaaccgcaactgatgcctgaatcaggttgaaaatgccgtctgaagccgttttgcggtttcagacggcattttgtcatttggaaagccgatgttgccacacacaagccgtacataaggaacagccctatcacgctccccatatagattgccattgccgccgactatacattatcttatttattttttctcaaagttattaagtgagtaaaaacagttttatgacaggtttttatagaattatccacagagattgtttcccagttcctccactaaaaaatccaaaaatacgcgtaagcggagattgacggctttatcgctgtaataaacagcattaaaggggtgtgttttatcggaggtttgttcggcgagcaggggaattaactttccttcagcgatgtcgttgtcaaccaaaaaatctgataagcaaacaataccgcaacctgaaaggcacaacgagcgtaagatttcaccgctgctggcggtaaagtgcggtgaaatcttatagggatttccctgcgcatctaaaaccgcccatgtatttagagaaccgggttcggtgaagcctaaacattggtggccggcaagctcttctgtagattgcggcgtgccgtgttttgccaggtattcaggactggcgattacgcggaagcggctgtcaaacagatggcgtgcacgcagcccggaatcgtccaattctccggcccgtaaggcaatatcgactttgcgttcaatcagattgatatagccttcggaagaaacgagcgaaagtcggatatgcggatagcgttcgttgaattttgctgccagcggcgccagcagatgcagcaccatcggcatcgcggaatccacgctcaacacgccttgcggtatttcgtgcactgccagcatttcggtttccgccgctgccatttcttgcaggattctctgcgcgcggcggaaatattgcgcgccttcttccgtcagactgagttgccgcgtggtgcggttgagcaggttcacacccaacttttcctccagccgtttgacgatgcggcttacggcagaatttgccatcgccaactgctccgccgcacggctgaagctgccgctttccaccacttgaacaaatacggtcagttcttctgaattggttttcatcgtgtttccttttcggttggaaccccgccctttagggcggcaggatcagactttatttgggaggggtgtaaccccttccgaatcaggacggcacacagggcggtgctttatgtgccatcccgtgtgttggaacatctgattatttcatttgacgcaaaagtgttttcttatttttgcacttttaaattataaagtaaaacggcacaatacattcatcaattcacaaacgaggtaacaaatgaatattttattattagacggcggcaaggcgttcggacattctcacggcgggttaaaccgtacgcttcacaaaaaagcgaaagaagttttgaccgcgctcggacacaatgttcaagaaaccgtgattgatgccggctatgatgttgaggcagaaatcgaaaagttcgtttggatggatgctgtgatttggcagatgccgggctggtggatgcacgagccttggacagtgaaaaaatacatagacgaagtattaaccgctggacacggcaaactctaccaaagcgacggcagacacagcgtcaatccgactgagggctacggcacaggcggcttgttgcaaggcaaaaaacatatgatttcactgacttggaatgcgccgattgaagcctttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaaaaatttatcttataaacaaacaaaggcagcctgaaagattgaatggtctgcacccctaaggttggactaaccaaccgactaaggtgcagattattttttgttgctttttcagcttttcgttgggttagatattcttgcccactgttttcaggcagccttgaatacaaaaaaatggcgtatgtaatatgtttatacgaccaaaacggaatgaattttaacgtattgcgcgtcatcaacaatgactgagtttctcgcctctcgcgcctgaatctatagtggattaacaaaaaccagtacagcgttgcctcgccttgccgtactatttgtactgtctgcggcttcgttgccttgtcctgatttaaatttaatccactatatgtcatgcagttcctttcattcaaatcaacaaaagaatgccgtccgaacgtccgttcagacggcacttgtcttcccacaatagacttgaggctgttctaacgtaccaccccttcgttccgccccaaaaccatcgcatcgccgtagctgaagaaacggtattcgcgttcgaccgcatgacgatacgcggcgcggatatgacccatacccgaaaacgcgctgaccaacatcagcagcgtcgatttcggcaaatgaaaattggtaaccagtctgtcgacaacattaaaacggtagcccggcgtgatgaaaatatcggtgtcgccctgccccgctttcagacgacccgtcgcacgcgcggcagattcgagggcgcgcatggaagtcgtgccgaccgcccagactttgttcccccgggcttttgccgcctcaacggcggcggcggtttcagacggcacttcaaaccattcgctgtgcattttgtgctcttcgattttgtccacacgcacgggttggaacgttccggcaccgacgtgcagggttacttctgcggttaccgcgcctttgtctttcagacggtgcaaaagttcttccgtaaaatgcaggcccgccgtcggcgcggcgaccgcgccctgatatttggcataaacggtttgataacggctgtcgtcatccgcatcggcggcgcgttcgatataaggcggcaggggcaggtgtccgttctgttccaaaagttcgtaaacggtctctccgccttcaaaacgcaggcagaacagttcgccctcacgcccgaccgtcacggcgcggatgccgccttcaaacaccagccccataccgggcttgggcgatttggacgaacggatgtgcgccagtgcggtatggttgtccaacacgcgctcaatcagggcttcgatcctgccgccgctgtctttctgcccaaacagccgcgccttcatgactttggtgttgttgaacaccaaaacgtcgcccgcctcgacataatccggcaaatcgccgaacacccggtcttgcagcggcatatcgggcaacgcaaccaaaaggcggctgctgccgcgcacttcgggcggatgctgggcaatcagcttttcgggcagggtaaaatcaaaatctgaaatatccatttttacactctcgttcgggcaagccgccattatacgcactttagccctttttcagacggcatctttgtccgaaaaaccaacagattagaataaacactcttaacctggaacatcttgtgcgcaaaatcaaacttcctgcacatttcccccaaaaaccgccgttttttgatattttactggacatttaccgacaacttcgggaaaataaacacattctcacggtcgttttccaccacaggaaaaccgtatccgaacaccattccgcccggtttgcgccgttgccgcaagccggctgttttctgaaaaaccaacgcaacaacccgccggaacaccggcagcctttaaaggaacagaaatggatttgcgcaaattaaaaaaactgattgatttggttgaagaatcgggtatcgccgaaatcgaagtaaccgaaggcgaggaaaaagtccgcatcacccgaaccatcgccgccgcacccgtttacgccgcgcccgtacctgccgccgcgccggccgtaacgcctgccgccgcacccgttgcggcatccgcgcccgccgccgcacctgccgcccgcgatttgtccgacgcgcaaaaatcgcctatggtcggcacgttctaccgcgcacccggcccgaatgccgcgccttttgtcgaagtcggccaacaagttaaagccggcgacacgctgtgcatcatcgaagcgatgaagctgatgaacgaaatcgaagccgaaaaatccggcacggtcaaagaaattttggtcgaaaacggtacgcccgtcgaattcggcgaaccgctcttcattatcggataatcctgttttcagacggcataaacttccgatgccgtctgaaatgctttcccccttcagcgttcccgcacccttttttacggacgggttgccggaaccgcaggaaaggtcatcatgctgaaaaaagttttaatcgccaaccgaggcgaaatcgcattacgcgtactccgtgcctgccgcgaaatgggcattgccaccgtcgccgtgcattccgaggccgacaaagacagcctgcacgtcaaactcgccgacgaatccgtgtgcatcggccctgccgcttccgcgcaaagctaccttaacgtccccgccattatcgccgccgccgaagtaagctgcgcggacgctgtccatccgggttacggtttccttgccgaaaacgccgatttcgccgaacaggtcgagcagtccggctttacctttatcggcccgaaacccgacaccatccgcctgatgggcgacaaagtctccgccaaacacgcgatgatagcggcaggcgtaccctgcgtccccggttctgacggcgcattgcccgacgacggcgaagaaatcctcaaaatcgccgataaagtcggttatcccgtcattatcaaagcctctggcggcggcggcggccgcggtatgcgcgtggtcgagaaaaaagaagacctcctccaatctgtcgaaatgaccaaagccgaagcaggcgcggcattcggcaacccgatggtttacatggaacgctatttgcaacgtccgcgccacgtcgaaatccaagtgattgccgacgaacacggcaacgccatctaccttgccgagcgcgactgttcgctgcaacgccgccaccaaaaagtcatcgaggaagcaccggctccgttcatcactgaaaaagaacgcgccaaaatcggcaacgcctgtgccgatgcctgcaaacgcatcggctaccggggcgcgggtacgtttgagtttttatacgaagacggcgaatttttctttatcgagatgaacacgcgcgttcaggtcgagcatccggttaccgagctcatcaccggcgtggacatcgtgcaggagcaactccgcatcgccgccggcctgcctttgcaatacaaacaaaaggatattcaagtcgaaggccacgcgtttgagtgccgtatcaacgccgaagacccgtacaacttcattccaagcccgggcctgattgaaagctgccacctgcccggcggcttcggtatccgcgtggacagccacatttaccaaggctaccgcatcccaccgtactacgacagcctgatcggcaaaatctgcgtacacggcaaaacgcgtgaacaggcaatggcgaaaatgcgcgtcgcactcgccgagctggcggtaaccggcatcaaaaccaatacgccgcttcaccgcgacctgttcgccgatgcgggtttccaaaaaggcggcgtcagcatccactatttggaacactggctggaagatcgcaaagccaaacaggacaagtaaaccgccgccgatatgccgtctgaagccgcccgtccgcgttcagacggcatttcccttgccccgcgccgtctgaaaccgatttcgatatagtggattaactttaaaccagtacggcgttgcctcgccttagctcaaagagaaagattctctaaggtgctgaagcaccaagtgaatcggttccgtactatttgtactgtctgcggcttcgtcgccttgtcctgatttaaattcaatccactatatttccaagaaagcccgttatgccctaccaacaaatcaccgtcaacgtcaacgatgccgtcgccgaacgcctcgccgacgcgctgatggaacacggcgcactctccgccgccatcgaagatgcctacgccggcacgcaaaacgaacaggcgattttcggcgaacccggtatgcccgccgaacaaatctggcagcagagcaaagtcatcgccctgttcggcgaacacgacgaagccgccgccatcatccaaaccgccacacaagaatgcgggttaaaagacttggcatacaccggcgaaaccatcgaagaccaagactgggtgcgtctcacgcaatcgcaattcgaccccatccggatttccgaccgcctgtggattaccccctcttggcacgaagtccccgaaggcagtgccgtcaacctccgcctcgaccccggactcgccttcggcaccggcagccacccgaccacgcgcctctgcctcaaatggttggatacgcaactcaaaaacggcgaaagcgtcctcgactacggctgcggttcgggcatcctgaccatcgccgccctcaaactcggtgcaggtttcgccgtcggcgtggatattgacgaacaggccgtccgcgccggcaaggacaacgccgcgcaaaacaacgtcgatgcacaattcttcctgcccgacggtctgcctcaagggcaattcgacgtagttgtcgccaacatcctcgccaaccctttgcgtatgcttggcgaaatgctcgccgcccgcaccaaacagggcggacgcatcgtgttgtccggtttgttggacgaacaggccgaagaactcggcggcatttacagccaatggttcgacctcgacccggcggaaaccgaggaaggatgggcgcgattgagcggcgtaaaacgctgaaacggaaaggaaacaccgtgcaggataaaaacaacctctgctggctcgatatggaaatgacggggctgaatcccgaaaccgaccgcattatcgaagtcgcgatgattattaccgactcggatttgaatgtgttggcgcaatccgaagtttacgccgtccaccaaagcgacgacgtgctgaacaaaatggacgaatggaacaccgccacacacggcaggacggggctgacacagcgcgtacgcgaatcgtcgcataccgaagccgaagtcgaacagaaactgctggactttatgtcggaatgggtacccggacgcgccacgccgatgtgcggcaactccatccaccaagaccggcgttttatggtcaaatatatgccgaaactggaaaactacttccactaccgcaacctcgacgtttccacgctgaaagaactcgccaaacgctggaatccgcccgttgccaaaagcgtcgtcaaacgcggttcgcacaaggcattggacgacattttggagagcatcgaagaaatgcgccactaccgcgaacactttctgatttccgccccgagagccgaagcgcaataagaaacaaacaatgccgtctgaaacgcagtttgcatttcagacggcatttttacagcagattgaaatcaaaaatatacacgcccgtcattcccgcacaggcgggaatccggaaggtcgggcctgccgttattttcaatcattacagaaactgaaaggtctggattcccgcctgcgcgggaatgacgggcgtgtgcattcttatagtggattaacaaaaatcaggacaaggcgacgaagccgcaaacagtacaaatagtacgaaaccgattcacttggtgcttcagcaccttagagaatcgttctctttgagctaaggcgaggcaacgccgtactggtttttgttaatccactatacttcaatctgccaaacagatcgaacagagaaaccctgtccgtcaaaacatcattcagccatcgccttgaacacttcaaccgcaaccgcaaccgtttcgtcaatcagctcgggcgtatgcgcggcggaaacgaaacctgcttcataagcggacgggccgaaggcgacattgcggtcgagcatcccgtggaaaaactgtttgaagccttcaatattggaacgcgccatatcggcatagtttcgcggcgcgtgtgcggcgaaatacagaccgaacataccgcccacgctgtcggcggtgaactcgatgcccgccgcatccgctgccgtccgaaaaccttgaaccaactgttcggtacgcgccgtcaggttttcatagaagccttcgcgctggatgatttccagcgttttcaagcctgcggcgacagcaatcgggttgcccgacaaggtgcctgcctgatacacgccgcccagcggggaaatacattccataatgtctttgcgcccgccaaacgcggcaagcggcataccgccgccgatgactttgcccatcgtggtcaggtcgggcgtgatgccgtgcaaagattgcgcgccgccgagcgcgacgcggaagccggtcatcacttcgtcgtaaatcaacaccgcgccgtatttttcggtcaatccgcgcaaggctttgacaaaggcttcggtcgggcggacgaggttcatattgccgacgaagggttcgacaatcacgcaggcgatttcattgccgctttgagcaaaggcttcttcgagttgggcgatattgttgtactcgagtaccaaagtgtgtttggtaaagtcggcaggcacaccggcggaagacgggttgccaaacgtcagcagaccgctgccggctttcaccagcaggctgtcggaatgcccgtggtagcagccttcaaacttgatgattttgtcacgcccggtaaaaccgcgtgccagacggatggcggtcatggtcgcttcggtaccggagctgacgaggcgcagccgttcgacggacggcatgattttggcgatttcttcggcaatgacgatttcgccttcggtaggcgcgccgaacgacaaaccgcccaatgcggcttcgcatacggtttcgacgacttcggggtgcgcgtgtccgacaatcgcaggtccccacgagccgacgtaatcggtatagcgcgtgccgttttcgtcccaaacatacgcgccttcggcttttttgataaagcgcggtacgccgccgacgctgccgaatgcgcggacgggggaattcacgccgccggggatgatggctttggcgcggtcgaataaaatttcgttacggttcatatatatcctcaaatgccgtctgaacggcaggtttcgggcttggaagcagaaagccccattttatcatttttcaggttgcgacaaggatttgcccgcttctttgcggatcacgccaaccgcatcccggatgacggaacgctcgtctttttccactttatgtgtaaagcggtagtctcggacgactccctccccgtcgtaatccacacaccactcccaatgtcggcgttctgatttcatataaatgaaattggtcggcaaaaaattataaatcggcaggstgacttcatgataggcataacaaccgaaagggttgcgcttcccgaaacgtgcctctacacctccgcccgggtcgttttgcctttaacaaccgtttgtgcgattccctcttccgtctgatatagtggattaacaaaaatcaggacaaggcgacgaagccgcagacagtacagatagtacggcaaggcgaggcaacgctgtactggtttttgttaatccactataacgcaggaactgatgttccctgtcgccgaaattgctggtacacgcacacagcagcaatgccgcccatacagccggtttcatacacatctcccattaaagccaaacattatacagccgtcccgaccgattaaattcatattttaaaacaatatcctgcctccaaaacccacatcgtgctataatccgcaccgattttcagacggcatcgtcgtgccgtctgaaattttttcattccaacaacaatcagccccgcgattacggctgcctgagaaagacacaaaccatgaaaaaagtatttatccgcaccttcggctgccagatgaacgaatacgacagcgacaaaatgctcgccgtcctcgccgaagaacacggcggcatcgaacaggttacccaagccgacgaagccgacatcatcttgttcaacacctgctccgtgcgcgaaaaagcgcaagaaaaagtcttctccgatttggggcgcgtgcgtccgctcaaagaaaaaaaccccggcctcatcatcggcgttgccggctgcgtcgcctcgcaagaaggcgaaaacatcatcaaacgcgcgccttatgtggacgtggttttcggcccgcaaacgctgcaccgcctgccaaaaatgattgtggacaaagaaaccagcgggctgtcgcaagtcgatatttccttccccgaaatcgaaaaattcgaccacctgccgcccgcccgcgtcgaaggcggcgcggcatttgtatcgattatggaaggctgttccaaatactgctccttctgcgtcgtcccctacacgcgcggcgaagaattctcccgcccgctcaacgacgtattgaccgaaatcgccaaccttgcccagcaaggcgtgaaagaaatcaacctcttgggacaaaacgtcaacgcctatcgcggcgaaatggacgacggcgaaatctgcgacttcgccaccctgctgcgcatcgtccacgaaatccccggcatcgaacgtatgcgcttcaccaccagccacccgcgcgagtttaccgactcgattatcgagtgctaccgcgacctgcccaaactggtttcccacctgcacctgccgattcaaagcggttccgaccgcgtattgagcgcaatgaaacgcggctacaccgctttggaatacaaatccatcatccgcaaactgcgcgccatccgtcctgatttgtgcctgagcagcgatttcatcgtcggcttccccggcgagaccgaacgcgagttcgagcaaaccttgaaactggtgaaagacatcgccttcgacttgagcttcgtgtttatttacagtccgcgccccggcacgcctgccgccaacctgccggacgacacgccgcacgaagaaaaagtgcgccgcctcgaagccttgaacgaagtcatcgaagccgaaaccgcgcgcatcaaccaaaccatggtcggcacggtacaacgctgcctggtcgaaggcatctccaaaaaagaccccgaccaactgcaagcccgtaccgccaacaaccgcgtcgtcaacttcaccggcacgcccgacatgattaaccaaatgatcgatttggaaatcaccgaggcctacaccttctccctgcgcggcaaagttgtcgaagcctaaaccctcacgccgaaaaaatgccgtctgaagcgtttcagacggcattttgccttgtatcggcagacgacggcgcggccgggcggcttaatttgccgcatcccgatccgacagccacgcgcgcacacgccgttccaccgcttcggcactcaagcccaaatcgtctaaaagttttttcggatcgccgtgtccggttacggtatcggcaacgcccaaaagcaaaacgggtttgcagatgccgtgtttcgccaatacttccagcaccgcgccgcctgcgccgccctgttcggcgttttcttcaagggtaacgatgcggtcgtggcttcgggcaaggcggacaatcaactcttcgtctatcggtttgacgaagcgcatatcggcgacggtggcgttcagtttttcggcaaccgccaatgcgggggcgaccatactgccgaaggcaatgaatgcggttttctcaccttcgcggcggataatgcccttgccgatttccacggtttccatgccgtctgaaaccggcgcgcccgtacccgtgccgcgcggatagcggacggcggcgggcgcgtctgcctgatagcaggtcgaaagcaacaggcggcattcgttttcatcgctcggcgcggcgacaatcatgttcggcacgcagcgcaaaaagctcaaatcgtacagaccggcatgggtcgggccgtccgcgccgacgatgcccgcgcggtcgacggcaaacaaaacgggtaggttttgcagggcgatgtcgtgcaccagttggtcgtaggcgcgttgtaaaaaggtggaataaatcgccacgacgggcttcatcccttcgcaagccaaaccgccggcaaaggtaacggcgtgctgctcggcgatgccgacatcgaaatagcggtcggggaatcgttgttcaaactcaaccaagccgctgccctcgcgcatggcgggggtaatcgcaaccagtcgggaatctgccgccgcccggtcgcacagccatttgccgaacacttgggtataggtcggtttggcggcgggcttgggttctttttcagacggcatttgcgccgcgctttctttaggcaggttggcgacggcgtggtatttgacggggtcgttttcggcgagtttgtagccgttgccctttttggtgatgacgtgcagcaactgagggcctttgcggctgcgcaagtctttcaatacgtccaccagattttcgacgttgtgtccgtccacggggccggtgtagcggaagccgaagttttcaaacaaagacagcgactgtttggcgtgttcggcttcttcggcaagggttttgattttgtgttcgactttttgggcaaactccatcgcgccgggtattttgtctaataccttgcccgtttgcgctttgacggtactcaacaggccgtgcatatcgcgcacgacgttgctggcaaggtatttcggcagcgcgccgacgttgggggaaatcgacatttcgttgtcgttgaggacgaccagcaaatccacatccatatcgcctgcgcaattcaaggcttcaaacgcctgccccgccgtcatcgcgccgtcgccgatgatggcgacgctgcggcggtcgctgcccaagagtttgtctgccgccgccatgcccaacgccgcgccgatggaggtggaggaatgccccacgccgaacgcgtcgtactcggactcgcaacgtttcggaaaacccgccaaaccgccatattggcgcatggtgtgcatctggtttttcctgcctgtcaggattttgtgcggatagctttggtgtccgacatcccacaccagcttgtcttcgggcgtgtcgtacacatagtgcagggcgatggtcagttcgaccgcgcccaaattgctggcgaaatgcccgccggtctgcccgacagattccagcagaaaggtgcgcaactcgccggcaaggcgcggcagctgttttttgtccagacggcgcaaatcttgcgggctgtcaatcaggtcgagtagggggcttgggttcatggtgtgtcttttttatgtgtcgtccgggtgcaacggtcaattatatatcaagagcgtgcggctgacggctgattttgccgtatgtcattcgtcctgccgcttggcgcgcgggtgggcttcgtcatacaggcgggcgatgtggtcgaaatcgagcttggtataaatctgcgtggtcgaaaggctgctgtgcccgagcagctcctgcaccgccctgatgtcgcgcgaagcctgcaataggtgtccggcgtagctgtggcgcatcatatgcggcgaaacgtgcctgccgtcgccgttttgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccgaccagcggcacctgccgctgcttgcgccctttgccgataacgtgtacccacgcctcgtccaaatagacatcatctgcattcaagccgtgtatctcgctcacgcgcaaaccgctgccgtacatcagttcgaacagggcgtggtcgcgcaccgccagcgggtcgccgccgtccacgggcaaatccagcatccggttcagccattcctgcggcagggctttgggtacgcgctcgggctgcttcggcggtttgatgtcggcggtcgggtcggcgtgcatcaggccgcgctttaccagccaaacgcaatactgccgccaagacgaaagcttgcgagccagcgtccgttcccccaaaccgcggccggacagccggcgtaatgcctgtacgaagtcgccgcgagtgcaatttgaagggtttgcagacggcatttcttccagaagggcaagcagttcctgcaagtcgcgccggtatgcggcaaccgtgtgctccgatttaccctcgcgcacgatattttccaaataagcgtccaagtatgccgcaagtccgtccaaacccattcccacacctaaaataacattagaaacattatcataaatcggaatatccgaatcccgaaacgtcaaaacccgacaaacctgcatactggcatcgttaatataaaatcaatgagctgtttatggttttttgctgtaaaaaacattataatccgccttatttacctattgcccaaggagacacaaatggcactcgtatccatgcgccaactgcttgatcatgctgccgaaaacagctacggcctgccggcgttcaacgtcaacaacctcgaacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagaatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgaagcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacttgcgccttgcttctaccggcgcggtacgccgctaccttgccgaaaatccgtccgactttgacccgcgcaaatacctgagcaaaaccattgaggccatgaagcaaatctgcctcgaccgttatcttgcgtttggctgcgaaggtcaggcaggcaaaatcaaacctgtttcgttggaaaaaatggcaagccgttatgccaagggcgaattgaaccaaatcgtcaaataacaggttgcctgtaaacaaaatgccgtctgaaccgccgttcggacgacatttgatttttgcttctttgacctgcctcattgatgcggtatgcaaaaaaagataccataaccaaaatgtttatatattatctattctgcgtatgactaggagtaaacctgtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataaccattgtgaaaatgccgtccgaacacgataatttaccgttcggacggcattttgtattgcaccgtccgacggcatgcccaaggggggaaatccctattttcaggccaaccgctatataatgccgtctgaaccaacgagagaatgccatgcaagctgattttaaccgtcccgtcctggccgtcgataccggtacttcccgtttgtcgctcgcgctgcgtgccgacggcgaaacccgtctgttccatcaggaagtcggcagccgccagtccgaactgattctgccggaaatccgcaccctattccgcgatgcaggcattaccgccgccgatttgggtgcggtcgtgtacgcacagggtcccggcgcgtttaccggactgcgtatcggcatcggtgtagctcagggtttggcaacgccgtttgatacccccttaatcggcgtaccctcgctcgatgccgccgcctcgctgccgccgccgcaaagctgcatccttgccgctacggacgctcgtatgggcgaagtgttttatgcatggttcgatacgctgaactgccaccgtttgagcgattatcaggtcgggcgggcggcagacatccggctgccggagggatgcgccttttcagacggcataggcagcgcgttcgcgctggaagaagctccgccgttctcaggcagaccggatatgccgactgccgccgactttctcgcattggcagccaagggcggttatcctgccgtccatgccgcacacgccggtttgctctacgtccgcaacaaaatcgccctgactgccaaagaacaggccgaacggagagcgcgcccgtgaacatccgccgtgccgtttgtgccgattgtgaggagctggccgcactcgatgccgtctgcaacccgtccgcatggacgcaacgccaatttgagtccgcactggtttcgccgtccgaacaggttttccttgcggaaaaagacggcgggattgccgcctttatcgtttggcagaacctgcccgacgaatccgaactgcacctgattgccaccgcgcccgaatgccgccgccaaggaattgcgtccgccctgctcgaatattggttcacacatctgcccgaagacacgcaacgcctgctgctcgaagtccgtgcaggcaacaccgccgcacaggcactgtacacggcgcacggcttcagcattacgggcaggcggaaaaactattaccgtacagccgacggtaaaaccgaagatgccgtcttaatggagaaaatatgttaagcgcgcgctacctccacctgcacgaagctttgggtttgggtccgatgtggctgaaacaggccgccgccgtcctgccgcccaaaaacacacccgcaccctcggcacaggcacgtccccaaaccgtccgcgccgccccgatccgcccttcccaaccccataacggtcaggcgcggctcgaaacgatgaaagcgttggaaaccgccgccgtacctacgcgcaaacccgcgcctgaaaccgaaacgcctctgcccggcctttcagacggcatcgcccccgttcccgccgcttcgggcatcaccaagcttgccgtcgtcagcctttgcccaccgatcgaggatgcggtttacgggcaactgttccacggcaaagcaggcatcctgctcgacaacatactcaaagccgtaggactggatgccgcctatgtccacaaaacctgttgggtgaaaaccgccgccgtcggcaacccgatgccgtctgaacaggccgtcgcgaatgcgctgggtcaaatcgcccgcgaactcgacggctgccgcgccccggctgtccttttcctcgggcaggcttttgtccagcctgaacggcaaacgatgattgaaactttgtgcggcagccgtcccttcttcatcatcgaccatcccgcccggcttttacgccaacccgaactcaaagcccgcgcctggcaggtgttgaaacagttgaaacgcgccttgcggcaaggcggcggcagttgaagcgcgccgcacggggcggtagaatcgcaactgcgtcccaatatctgacagaaagcacaaaatgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaaaaacaatacggtctgcccgtcgcccccatcgccagcctgaacgatttgtttattctgttgcaaaacaaccccgaattcggacagttcctcgaacccgtccgagcctaccgtcggcagtacggcgtagaataaaaacaaagcatatgccgtccgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggactgtttaaagccaaagaccatctggcaagcacgaaagaacccatattcaacgatttgcccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctgaccgcaacggaaagccgccgcagaaatgccgtctgaaccccgtttcagacggcatttccccgattatatagtggattaaatttaaatcaggacaaggcgacgaagccgcagacagtacaaatagtacggcaaggcgaggcaacgctgtactggtttaaatttaatccactataaagacctgcccaaccctcaaggaccccgatgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaagggcgggggagcggcactgccgccgcgaatgaaaaaaggtcgtctgaaactgctttttcagacgaccttttttaatggttgtttcaaatcaaaatatctatgccgccggccccatcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataatcgggcggagagttccagcgcggcggcttcgtcggcaagcaggccgaagccgtccgattcgaacgggcgttgcagcagtgggcaggccgccgccgtcagtgccgctgcgttttgcgccagccgttgcagggcgaatcggcctattgtttgcggcgaaaacaggcgttcgtccagcaagccttcgtcgtgccagcggcgcagtttttccagcgaaaaatccaaatgcagcgcgcacatgccgctgttgtcgggcagcagggtttcggatacgtccgccaaatcgccgcgtaccagtcagatttcgccggcagatgggcggtattccctgccgcccatttgtaaccggttctgccccgacaccatgacgaacaaggcgcagttgtggctgaaattgtggatttcggtgggaaacgcgcccgttccgccgccgcgcatccgcgacaaggtgatgcccgaatcgaagcggttgatgcacatttccagatgcaaaccgggctgttttgcctgcgcaatgagcgcgctgtcggaacagccgtccaacgcccagccggatttatcggagcggacataggtttggtactggcggtagatggcggcggtgttcatgattggataggaacgagttgtctaacaaatgaattaaataggaattattaccaataatcaagcgcagggattggttgaaacggaaaaggtcgtctgaaagggtgtttcagacgaccttttccgtatcgggaatttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtagggagtcgtctgaaaacggagcttccgaaggaagcggggggtttctgcgaagctaaagtgcggtttcaacgaattgaaaagcagcctgtatgttgaaaataccgctcaagcaaacctacggtttgccgccctctccctagccctctcccacagggagaggggattgggttgcaggctgcctttaaggtttaggcaaatttttaacttcgttgaagctgcgatttcagaagctccgttttagcttcgcagaaactccgcttccttcgaaagctccgttttcagacgaccttttggagtaccgcaggcacacgcatcgaacggctgaatcaaagattcagaccgatggcagtccgcacccgagtttatgcggcaaacagcgaggctacggcaacccgccccctctccctgtgggagagggttagggagagggcggtaagccgcaggcttacatcaaagccgataacgctttcacaaagcctgtgtgcactgaaaactgaaaggtcgtctgaaaacggagctttcgaaggaagcagagtttctgcgaagctaaaaccgaagctgcaaaaaatcgaaaagcagcctgcacgttgaaaatgccgcccaagcaaacctgcggtttgccgccctctcccacagggagaggggattggggtgcaggctgtctttaaggttcaggcaaatttttaacttcgttgaagctgcgatttcagaagctccgttttagcttcgcagaaactccgcttccttcgaaagctccgttttcagacgaccttttggagtaccgcaggcacacgcatcgaacggctgaatcaaagattcagaccgatggcagtccgcacccgagtttatgcggcaaacagcgaggctacggcaacccgccccctctccctgtgggagagggttagggagagggcggtaagccgcaggcttacatcaaagccgataacgcttccgttacaactccgcccactgaaagcagcctgcaacgaagccaaaacgacaaaccgcatcgtaaaccacccaacccataggagaaccccatgcaaaacgaaaccatcaacctgaaacagcaccttgccgccatcaaagaatactggcagcccgaaatcatcaaccgccacgggttccaattccacttggtcaaacttttgggcgattacggctggcatacgcacggatacagcgacaaagtgctgtttgccgtggagggcgacatggcggtggacttcgccgacggcggcagcatgacgatacgcgagggcgagatggcggtcgtgccgaagtcggtgtcgcaccgcccgcgttcggaaaacggctgctcgttggtgctgattgagttgtccgacccgtccgaggccgtctgaaaacgaagtttccgaaggaagctgagtttctgcgaagctaaaagcagcctgcaccttcaatcaatatgccgaaaatacaaccccaccgcacaccaacacacaaaggaaatcccatgacacgcttcaaatattccctgctgtttgccgccctgttgcccgtgtacgcgcaggccgatgtttctgtttcagacgaccccaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaaggcacgctgcgcggccgcctggtttccaccttcggacgcggcgactcgtggcggcggcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattgatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgattttgggcggacgatacacccgttaccgcaccggcagctacgacagccgcacacaaggcatgacctatgtgtccgccaaccgtttcaccccctacacaggcatcgtgttcgacctgaccggcaacctgtctctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataaggtcgtctgaaaacggagtttctgcgaagctatagtggattaacaaaaaccagtacggtgttgcctcgccttagctcaaagagaacgattctctaaggtgctcaagcaccaagtgaatcggttccgtactatttgtactgtctgcggcttcgtcgccttgtcctgatttttgttaatccactataaaagcagcctgcacattgaaaatgccgcccaagcaaactttcagtttgcccgcctcgtcctagccctctcccacgggagaggggattggggtgcaggctgcctttaaggttcaggcaaattttaacttcgttgataccgcgctttagcttcgcagaagctgcactttcagacgaccttttggaacaccacaggtacacgcatttaaggaatgccgtctgaaatgcctgcctcaataacgcatcatgttgccgtcaatctcggccgcccatgcatcgatgccgccctgaaggttgtacaggttttcaaaacccgcgtccgccaaatacatcgccgtatgcaggctgcggataccgtggtggcaatacaccacaagcggcacatcatccggcagctcgttctgccgcagcggaatcagattcatcgggatatgcagcgcatttggcagcgaacaaaccgccgtttcttcatccgtacgcacgtccaacaaacaaaacatccgcccttcgtccatccacgctttcaattccgcgggcccaagttgcacaatatccatcgcaccccccaaaaaaaaccaagcaaaatgccgtctgaagccccaaacccgctttcagacggcatgacctgtcaacatcttaaaaatcgaaaccgccaaacggatcggcatccttatcatccaaatgcgccaccaaggtatcgaacagcaccttctcttcaaacacatcgcccctgcgcgtaatcaaaagcgcgcgttgaacaggcttgcgacctacgataaccaccatgcgtccgccatctttcaactgttctttcaacacttcaggcacaaggtttaccgcaccgccgacataaaccgcatcaaacggcgcacctgcggaaagttcggtcaacccgttgttttgcacataatcgatattgtccaaacccaagccgtccaacaccgctttggcgcggttttgctgttcgacatcgatgtcgtccgacaccacacgaccagccaattttgccaacagcgcggtcgcatagcccgaacccgtgccgatttccaaaaccgtatcgtttttcgtcagcttcaagccctgcgccagccgcgccacgactttcggctcgagcatcttatgaccgttggcaagcggcagcgccatatccgcatacgccaaaccctgcaagtcctcatcgacaaaaagctcgcgcggaatctccgccaaagcgtccaacacatcaaaatccaatacatcccacggacggatttgctgttcgaccatattgaaccgcgctttttcaaaatccatttagtgctccgtcaaataattgttccaacaatggcaggcattataaaaccacactcccgccgcgccaacttcggcacgcgccgacagcccgttttgtcagtctcaaaccgcctgacgcgaagcctcaaaccgcttctccaaaatcttcgccagttcgcccaaatacaaagcatccgtctcatcaaactgcgccaaatgttcgctgtccgcgtccaacacgccgatacagcggccgtctgaaaacagcggcacgacaatctccgaacgtgacaaagacgaacaggcaatatggtcgggatgcgcgttgacatccttaacaaccaccgtttcacccttcgcccaagcctgaccgcacaccccgcgaccgaacggaatccgcgtacacgccaaaggcccctgaaacggtgccaaaaccaattcgtccgaacgcgtatcgaccaaataaaaacccacccaaaaccaaccgaacgcctccttcaaaaccgccgccgtgttcgccaaattcgccacccaatccgcctcgtcagccaccacagactcaatctgcggcaacacctcccgataaagcgcggccttgtccgaagccgaaaaatgaagcgcgtgcatcacatctcctatagttgcatacatatcaggcggccattataaaacagcctgcccgaaacaacattccaaaccgcccggccggccgcttcaagttgcgaacccgccgcatatccactaaacttcacgttgcaccgcgccacacgcggcagacaaaaaaacacgacacggagcaaaaaagatgtatcgccaaatcggaatgtgggatcaaaaatgggtcatcggcaactggaaaatgaacggccggctccaaaacaacaacgcactgatgcaccgcttccgcatccaccccaccgccgaacgcgtcctcatcggactcgccgccccgaccgtttacctgctgcaactgcacaacgccatgcaaatcgttttaaacaaccgcatcctcacctgcgcccaagacgtgagccgcttccccaataacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccgttattgtgcgtcggcgaaagcctcgaagagcgcgaagccggcaaagaacacgaagtcatcgcccatcagctttccatcctgcaagggctggataccaaaaacatcgccgtcgcctacgaacccgtctgggcgatcggcaccggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacgcgcaactcgtcggcggcgcttcattgtcgtacgactcctttaccgccatcatcagtcccgcacaaaatgcgtagaaaattatggaacccttcaaaaccttaatttggattgttaatttaatttccgctttggccgtcttcgtgttagtattgctccaacacggcaaaggcgcggatgccggcgcgactttcggat

SEQ ID NO: 14 - DNA, 4927 bp, Neisseria meningitidis
  misc_feature (904)..(904): N is any nucleotide
catcgcccgccacggcatgattgacatcgacatcagctgcaaaggcgacctgcacatcgacgaccaccacaccgccgaagacatcggcatcacactcggacaagcaatccggcaggcactcggcgacaaaaaaggcatccgccgttacggacattcctacgtcccgctcgacgaagccctcagccgcgtcgtcatcgacctttccggccgccccggactcgtgtacaacatcgaatttacccgcgcactaatcggacgtttcgatgtcgatttgtttgaagaatttttccacggcatcgtcaaccacagtatgatgaccctgcacatcgacaacctcagcggcaaaaacgcccaccatcaggcggaaaccgtattcaaagccttcgggcgcgccctgcgtatggcagtcgaacacgacccgcgcatggcaggacagaccccctcgaccaaaggcacgctgaccgcataaaaaaccataccgtctgaaacacccgcaggcttttcagacggtatcggaacagataagattacactacactacaaacagaaaaggagtaaacatcatgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcagncggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaakcgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactgattgccttttccaaacacaatgccgtctgaacatatttcagacggcatttttatcaccccacgcttaaaatcagtcccgattatgactatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataatccgcacaaatttagtcaatatcaagaccaattatgaaccaactcgaccaacttggcacccgtatcaacctgatttgcaatgtcttcgacaaatggatcgggcagcaggatctgaattacaacctctttgccgtactttataccctggcaaccgaaggcagccgcacgcaaaagcatatcggcgaaaagtggagcctgcccaaacagaccgtttcaggcgtatgcaaaacccttgccggacaagggttgattgaatggcaggaaggcgaacaggaccggcgcaaacggttgctgtcgttgaccgaaacaggcaaagcctatgccgcacctttaacagaaagcgcgcaggaattcagcgacaaagtatttgccacattcggcgacaagcgcacaactcggctgtttgccgatttggatgcactggctgaagtgatggaaaaaacaatctcggaaaataaaaaataggggggcaaatatgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttgaaaaatgccgtctgaacacgcttcagacggcatttccatccgttcggcaaactacatcacatccgcccgccggttgacaagtttggcaaacaacttttcaacagaagcttccgcctgcaaaccaatgcgctggatcaggctttgcttctcctgatatttcacttcgataacctgtttgttttcaaacgctttcaacaacaaatcatcactggtcgaaatctcgtcaatcaagttcaacgccaacgcctgccgaccgaaccaatgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaaaaagaatgcttcaaacgattgccgctgttttttataattttccgaaaaatccgtcagtacgacactgccgctttccgactgtttcttactctgtacgatagccaacacaatcagcgcaattgcgccgaacacggtaagcagttcgagcaggaaaataccgtaattcagtaaaatttctttccacattgattggatttcctcttgttcaggcatgaacatgtcaatattgtccatcaccgtccgacagataaaaaaataaccgcttggagcggcattgtcattttcagcttggtgcccggagccggaatcgaaccggcacgggatgtttagtcccgacggattttaagtccgttgtgtctacctatttcaccacccgggcatttgtgaaaggtggaggcgggggcgcggattttaaccggcctgtatgaagattgcactcctcatagcataaacactctgccaccccgccatagtacgataatggaggcgagagtcggaatcgaaccggcgtagacggatttgcaatccgctgcataaccactttgctatctcgccctaaaactggcttatctaaaaaacttggagcgggaaacgagtctcgaactcgcgacctcaaccttggcaaggttgcgctctaccaactgagctattcccgcgcgttcaaacatatcggtttttggagcgggaaacgagtctcgaactcgcgacctcaaccttggcaaggttgcgctctaccaactgagctattcccgcgttgatatgtttgaaataaaacttggagcgggaaacgagtctcgaactcgcgacctcaaccttggcaaggttgcgctctaccaactgagctattcccgcaatgattgcggaagaatgaaatttttggagcgggaaacgagtctcgaactcgcgacctcaaccttggcaaggttgcgctctaccaactgagctattcccgcccgatttcattctccgatatcgaagagacacaattatt

SEQ ID NO: 15 - DNA, 25509 bp, Neisseria meningitidis
gttctgcctgtatgattagcgtttatttgatttgctttctcatttggatatgaaattcgtcagcgaccttttgtccgtcatcctgtttttcgccacctataccgttaccaaaaacatgattgccgcaacggcggtcgcattggttgccggtgtggttcaggcggcttttctgtattggaaatataaaaagctggatacgatgcagtgggtcggattggtgctgattgtggtattcggcggcgcaaccattgttttgggcgacagccgcttcattatgtggaagccgagcgttttgttttggctgggcgcgctgttcctgtggggcagccacctcgccggtaaaaacggcttgaaggcgagtatcggcagggagattcagcttccggatgccgtatgggcgaaattgacgtatatgtgggtcggtttcctgatttttatgggtatcgccaactggtttgtgtttacccggttcgagtcgcaatgggtcaactataaaatgttcggctcgactgcactgatgcttgttttctttattattcagggtatttatctgagtacctgtctgaaaaaggaggattgactgtggaatattttatgttgctggcaacagacggggaggatgtgcacgaggcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcgcaggcttgggcggaagacgatccctatgttcatgcaggcgtgtacagcgaagtgctgatcaagccgtttaaagcggtgttcaaataatgccggccgtcgatttgatccgcgaacgcctgcagacgctcgatccgctggtgttggaaatcggcgatgagagccatctgcacaaaggacacgcgggcaataccggcggcggacattatgccgttttggtcgttagcggccgttttgaaggcgtaagccgcctgaaccgccagaaaacggtcaaatcgctgctcaaagatttgttttcaggcggcatgattcacgcgctcggcatccgggcggctacccctgacgagtatttccatacggcggactgaatgaagtctgcccgaacatttcaatttaaaatttaaagagagaagattatgaaagcaaaaatcctgacttccgttgcactgcttgcctgttccggcagcctgtttgcccaaacgctggcaaccgtcaacggtcagaaaatcgacagttccgtcatcgatgcgcaggttgccgcattccgtgcggaaaacagccgtgccgaagacacgccgcaactgcgccaatccctgctggaaaacgaagtggtcaataccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcattgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataattctgaaaacgggatatggcggcaagacgttcagacaggcgttttgccgccgcgcaggacagggaataccatgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgccggctacaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaagacgagctgcacaagttttacgaacagcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgccgcgatgaatcggggcgacgttacccgcgatccggtcaaattgggcgaacgctattatctgttcaaactcagcgaggtcgggaaaaaccccgacgcgcagcctttcgagttggtcagaaaccagttggagcagggtttgagacaggaaaaagcccgcttgaaaatcgatgcccttttggaagaaaacggtgtcaaaccgtaatggcatttccaataccgatgccgtctgaagcctttcagacggcattgcacgttcaggtaaggaggacggcttatgcgtgcggtcatacagaaaacggtaggtgcaaaggtggatgtcgtgtccgaagccggcacggaaacctgtggcaaaatcgacggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcaggtgtcgctctgcaacgatgggccggtaaccatactgctggactctttcatgacgcggatttccccaaaaatgaaggttgttccggattgaaattgaatccgcaatgataaaatatcgacaatgaacgacaatacacacacccttcccccgcgccacctgtccgtcgcccccatgctcgactggacggacaggcactaccgttaccttgcccgccagattacccgaaatacttggctgtacagcgaaatggtcaatgccggtgcgattgtttacggcgacaaagaccgctttttgatgttcaacgaaggcgagcagcccgtcgccctgcaactgggcggcagcgatccgtccgatttggcgaaagccgccaaagccgccgaggcatacggttacaacgaggtcaacctcaactgcggctgccccagtccgcgcgtgcagaaaggctcgttcggcgcgtgtctgatgaacgaagtcgggctggttgccgactgcctcaacgccatgcaggatgcggtcaagattcccgttaccgtcaaacaccgcatcggtgtggacaggcagaccgaataccaaaccgttgccgatttcgtcggcacgctgcgcgacaaaaccgcctgcaaaacctttatcgtccacgcccgcaacgcttggctggacggtctttcccccaaagaaaaccgcgacgttcccccgttgaaatacgattacgtttaccgcctcaagcaggagtttcccgggctggaaatcatcatcaacggcggcatcaccaccaacgaagcaatcgcaggacacctgcaacacgttgacggcgtgatggtcgggcgcgaggcgtaccacaacccgatggtgatgcgcgaatgggacaggctgttttacggcgatacccgcagcccgattgaatacgccgatttggtgcagcgtctctacacatacagccaagcccaaatccaagccggacgcggcacaatcttgcgtcacatcgtccgccacagccttgggctgatgcacggtctgaaaggcgcgcggacttggcggcgtatgctttccgacgcaacgctcttgaaagacaacgacggcagcctgattctcgaagcgtggaaagaggtcgaacgggcaaatatgcgcgaatagggcggggctgtatgtgtgaaatgccgtctgaaggcttcagacggcatttgtgcgtttgtcgggcggtgtttagggggcggtaacggcgtgtttcggcactttgtccatatcccagtgtgccaccgcccagtcgagcagttcggcagggcggtcggtttccggtgcttcgggcagcttgaggtaacggaacacttggcggaggagttgttcgcggcggtttaaatccaatgcgggggcgagcgtctgtttcgaccatttctgcccttgtgcgttggtcagcagcggcaggtgggcatattgcggtgtcggaacgtccaaacactgctgcaaatagatttggcgcggcgtggaaacgagcaggtcttgtccgcggacgatgtgggtaacgccctgttcggcatcgtcggcaacgacggcgagctggtatgcccagtaaccgtctgcacgaagcaggacgaaatcgccgatgtcgcgggcgaggttttgggcgtaaccgccgacgatgccgtctgaaaaaccgataatgcggtcggggacgcggatgcgccacgccggctgtttgccttgcagtgcagggcgttggccggggtggcggcaacgtccgttatagacgaacccgtctgcgccccgccttgccccggcctgccagtctttgcggctgcaatggcagggatagaccagtccggcggttttcaggcggcatagggtttcttcatacagggcgtaacggcggctctgataggcgacttctccgtcccactcgaatccgaatgcctcaagcgtgtgcaggatatggcttgccgcccccggcatttcgcgcggcggatcgaggtcttccatgcggatcagccatttgccgccgtgcgcgcgcgcatcggcataggaagcgacggcggtcagcagcgagccgatgtggagcagcccggtcgggctgggggcaaaacgtcctgtgtacatatctggtacagcccctttatttaagactattaatcaaagccattatctcatctttattcagttccatcccgggctcttcaagcaaggttaaatcatatagggcattatattgctcttcggtagctgaaccatccataagagcaggcgagaaaaaatcaaaggctctatctgcaattctctcattacttgcatttctactaaccagtttcgtcaattctgtatattttgaaaagtttatggaaaaataaaacagcgaaaaagttttggtttcgctgtttttgatttaattagcactgataatcttcaaattcccacgaaaaaaaacgaagtaaataagtcaatgacttttcccaagtttcttttgaacattctttaagaattttctcaatttccgatttaataacagaatgattaaattcattcataatcatcatacccgccccccatttaaccctttgattttggaaacaattatgcaaaatccatttaggagagcatatgcgaacagaaaatatatctgcagcatcactatcatcagttcctatgtctaaatcaattcccacacaaaaattgtctttgatttcgggaacgaaatcttcaaaggcacaatcgtaaagattgatggctttcaattctaggttaatcattttatattcaatagtatggggaggtaccggatccttaaaaatcagatctgaataaatttcattgggtgaaatgatttcgattgcttttgccatgattctatttccttttgtgttagtgggtaatgtcgtgcattaacttcttgcccattaatatttttagggtgaatccttgatatgccgcactgtgtccggtcaaacgggcgatgccgtctgaaagcctttcagacggcatcgggaaaatgcctaagccaaaggcgcgagcagtttttcaaacgcttcttcaaactgtttcaaaccgtcttcctgcaaacgcgttgccaaggtttcgacatcgatgccgagcgcggcggtttcggcgagctgcgcttgtgcttcttctacgccttcggtcagcgtggctttggctgtgccgtggtcgataaaggctttgagcgtggcatcgggaacggtgttgacggtgtgcgcgccgatcaggctgtcaacgtagagcgtgtcgggataggccgggtttttcacgccggtagatgcccataaaagctgcacgcggtttgcgcctttggtttccagcgcggcaaattcggggctgccgaagtattgcgcccagtcttggtaggcggctttggcaagggcgatggcgattttgcctttgaggtggtcgggcagtgttgtgtccagcgcgccgtccacacgggagatgaagaagctggcgacaacttggatatgggcaacgctttgtccggctgctaagcgtttggcgatgccgcgcgcgtaggcggcgtaggctttgagggtttgggcgcgtgagaacagcagggtcaggttcacgctgatgccgtctgaaacgagggtttcgagcgcatcgatgcctgcgtcggtggcaggcactttaatcatcgcgtttttgcacccgatggcggcgtagaggcggcgcgcttcttcaaccgtgccttgcgcgtctttggacaattcgggcgaaacttcgaggctgacgaagccggttttgccgccggtggattcgtgttcggcaaggcaaacgtcgcaggcggcacgcacatcggcaaccgccattgtttcgtagcgttgtttggggctgaggttttgctgcttgagggcggcgatttcatcggcgtaaagcgcgtcgccggcgaaggctttttggaagatggcgggattggaagttacgccgcacacgccctgtttcaacatttgcgccaattcgccgctttgcactagcgagcgggaaaggttgtccagccagatttgttgtcctaatgctttaacgtccgataaaatggtcatctctgattcctttggatggataggcggggtttgagggcttatgctaccccgattcggaaattttgggtagttttattacagcaaaggcggatggcaatggcagaaaacggaaaatatctcgactgggcacgcgaagtgttgcacgccgaagcggaaggcttgcgcgaaattgcagcggaattggacaaaaacttcgtccttgcggcagacgcgttgttgcactgcaagggcagggtcgttatcacgggcatgggcaagtcgggacatatcgggcgcaaaatggcggcaactatggcctcgaccggcacgcctgcgtttttcgtccaccctgcggaagcggcacacggcgatttgggtatgattgtggacaacgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatataaggcgttgcagccgtttcagacggcatttgtggtaagatatgccgtctgaaaacaaggaaatcccatgcaggcaatttctcccgaattacaggcgcgcgccgccaaaatcaaactgttgatcctggatgtggacggcgttttgaccgacgggcgcatctttatccgcgataacggcgaagaaatcaaatcgtttcacacactggacggacacggtctgaaaatgcttcaggcaagcggcgtgcagactgcgattatcacgggccgggacgcgccctccgtcggcatccgcgtcaaacagttgggcataaattactatttcaaaggtatcagcgacaaacgtgccgcctatgaagaattgcgcgcgcaggcgggcgtggaagaagccgagtgcgcctttgtcggcgacgacgtggtcgatttgccggtaatggtgcgctgcggattgccggttgccgtccccggcgcgcattggtttacgcggcaacacgccgcctatatcacggaacacgcgggcggcgcaggcgcggtgcgcgaagtgtgcgacctgattatgcaggcgcaagggactttgggcgcggctttgaacgagtacatcaaatgaaagtaagatggcggtacggaattgcgttcccattgatattggcggttgccttgggcagcctgtcggcatggttgggtcgtatcagcgaagtcgagattgaagaagtcaggctcaatcccgacgaaccgcaatacacaatggacggcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataatcccaaaatgccgtctgaaatataaacccggttcggacggcatatgccgaccgaagatattgaagagatatttatgagtgcaaacgtcagccgccttgttgttcaaaacctgcaaaaaagtttcaaaaaacgccaagtcgttaaaagcttctccctcgaaatcgaaagcggcgaagtcatcggactgctcgggcccaacggtgcgggtaaaaccaccagcttctacatgattgtcggactcatcgccgccgacgcaggcagcgtaaccctagacggacaagaattgcgccacctgcccatacacgaacgcgcccgcctcggtgtcggctacctgccgcaggaagcctcgatattccgcaaaatgaccgtcgaacaaaacatccgcgccatcttggaaatcagaaccaaagataaaaatcaaatcgacagggaaatcgaaaaactgctcgccgacctcaatatcggacacttacgccgcagccccgcgccgtcgctgtccggcggcgaacggcggcgcgtcgaaatcgcccgcgtactcgccatgaaaccgcattttattttgttggacgaaccttttgccggcgtcgatccgattgccgtcatcgacatccagaaaatcatcggtttcctcaaatcgcgcggtatcggcgtactgattaccgaccacaacgtacgcgaaaccctcagcatctgcgatcgggcctacattatttcagacggcacggtgttggcatcgggaaaacctgatgatttggtcggaaacgaacaggttcgttctgtttatctgggtaagaacttcaaatattgaaaatatttttcagacgggcgacctaatatcgtcgggcaggcggcaaaaatacggatttatgttgtttttacataaattaattcaaatttaaaacattgacttaaacctgttttcaaagaatattgcccgatatgcttgcatgtcgtcccgtaatttggtttaatacgcatctcttaacgagacagacaaaggccagatagctcagttggtagagcaacggattgaaaatccgtgtgtcggcggttcgattccgcctctggccaccaaaaaaccgccttgaagcggttattttttttgcctgccgtttttgggaagttgtccgtgtcggacacgttttgtgtctgaccgttatgtagaagggcaaaaatgataatgaccgccccgttgcgttttggagaagagggtaaaggcagaaagcatatgccgtctgaatgatatttcagacggcattttatattgcggcggcactcagtccgtgtcgctttcaggcaactctgccgaacccatgcgtttgagcacgatattggttttgttgcggagccgtttgcttttcggatggtcggcgtagtagagcggggcggggacgcgcgccgtcagttttgccgcctgctgtttggtcagcttggcggcgggtatttgataaaaataccgggacgcggcttccgcgccgaaaacgccgtagtgccattcgattgagtttaaatacagttcaaaaatcctgtctttgtcggtaacggcttccatcatcgcggtaatcgccgcttcttcgcctttgcggatatagctgcggctttcgtttaaaaacaggtttttggcaagctgctggctgatggtcgagccgcccgccttcactttgccgctgttccggttgcgcctgatggcgttttgaatgccgccccaatcgaagccgccgtgcccggcgaaacgggcatcttcggaagcaatcagggcttttttcaggttggtggaaatgcgtttgtagggcatccagcggtaatccagtgcgacatcgcgaccttcctgttcaaactgcttcatccgcatcgacataaaggcagtccgatggggcgcgacggcgcggtaggtaatgatgttgccgtacacataggcattgaaaaagataaagatgccgacgggcagggcaatcagccatttgatgatgcggaacatgtttatagggctttcatgtattcgataacggggcggatatcgggcgtaaatccgcgccagagggcgtaggaagccgccgcttgaccgactagcatacccagtccgtcggcagtttttttcgcacccgattgtcgtgcaaaatctaaaaacggttttgccgcgcagccgtacaccatatcgtaggcaagcgcgcagttttgaaaaatatcgggcggaatatcgggaatctgaccgtttagaccgcccgacgtgccgttgatgatgatatcaaaaccgccgttcacgtccgccatcgggacggcttcaatgccgaaaagctgcgccaattcctcggctttggcgcgggtacggttggcaatgacgatacgggcaggacggtgttctttcaaaacaggaatcacgccgcgcaccgcgccgcctgcgcccaaaagcaaaatggttttgccctcgatggcaatatttttgacctgcgtgatgtcgttggtcaaaccgataccgtcggtgttgtcgccacgcagcttgccgtttttcaacggaatcagcgtattgaccgcacctgccgccaatgcgcgttcggaatgctcgtccgccagatgaaacgcttcctgtttgaacggtacggtaacgtttgccccgcaaccgcctgtttcaaaaaatgtcgaaaccgcctgcgcgaaaccgccgatgtcggcgcaaatgcgttcgtattcaatgtcaacgccttcctgaagggcaaattgttgatgaatttgcggcgatttgctgtgggcgacggggttgccgaaaacggcgtagcgggggagggcggtcatggtcgtgttccaaaagacgggaaggctattttataacggcggcgtacagatggaaacgatgccgtctgaaaccgccttcagacggcatcgtttcctgtatcggtcgggaaaaatccggatgcggtgcgccggcttgtccgcattgttgacaatcttgccgtctgaaactatattttccggcttgaaatttgacgcaaaaccggtttcagacggcatcggcgtggtaaaatcgtgccgactttgcgtcaagccgccgcgttccgcatattttgctatttcccttttccaggagctgaaaaatgtctattaaaaacgccgtaaaattgattgaagaaagcgaagcccgctttgtcgatttgcgctttaccgataccaaaggcaagcagcaccactttaccgtgcctgcgcgcatcgtgttggaagaccccgaagagtggttcgaaaacggtcaggcgtttgacggttcgtctatcggcggctggaaaggcattcaggcttccgatatgcagttgcgccccgatgcgtctacagccttcgtcgatcctttttatgatgatgcgactgttgtgttgacttgcgacgttatcgatcccgccgacggtcagggttacgaccgcgacccgcgctccatcgcccgccgagccgaagcctatttgaaatcttccggcatcggcgagaccgcctatttcggtcccgaacccgagtttttcgtattcgacggcatagaatttgaaaccgatatgcacaaaacccgttacgaaatcacgtccgaaagcggcgcgtgggcaagcggtctgcatatggacggtcaaaacaccggccaccgcccgaccgtcaaaggcggttacgcacctgttgcaccgattgactgcggtcaggatttgcgttcggcgatggtaaacattttggaagaactcggtattgaagtggaagtgcaccacagcgaagtcggcaccggcagccaaatggaaatcggcacgcgctttgctactttggtcaaacgcgccgaccaaacccaagacatgaaatatgtgattcaaaacgttgcccacaacttcggcaaaaccgccactttcatgcccaaacccattatgggcgacaacggcagcggtatgcacgttcaccaatccatttggaaagacggtcaaaacctgttcgcaggcgacggctatgccggcttgagcgacaccgcgctctactacatcggcggcatcatcaaacacgccaaagccttgaacgcgattaccaatccgtccaccaactcctacaaacgcctcgtgccgcactttgaagcgccgaccaaactggcatactccgccaaaaaccgttccgcttccatccgcattccgtccgtgaacagcagcaaggcgcgccgcatcgaagcgcgtttccccgatccgaccgccaacccgtatttggcatttgccgccctgttgatggcgggtttggacggcattcaaaacaaaatccatccgggcgaccctgccgataaaaacctgtacgatctgccgccggaagaagatgcattggtgccgaccgtttgcgcttctttggaagaagcactggccgccctcaaagccgaccacgaattcctcctgcgcggcggcgtgttcagcaaagactggatcgacagctacatcgctttcaaagaagaagacgtacgccgcatccgcatggcgccgcacccgctggaatttgaaatgtattacagcctgtaagcacgtctggttttcagaaaagcaatgccgtctgaacacagtttcagacggcattttgcatttgaacggcaaaccggcggcgcggggcggcatttttcagcaggcgggcgatatttgctacaataggcttttgttttttttgggctgcacgaacgatgactgcatcgaaatcaggttttatcgggcaaatcttttcccgcaatatgcttgtctgtatttttacggggtttacctcggggctgccgctgtactttctgattaacctgattccggcgtggttgcgcagcgagcaggtggatttgaagagcatcgggctgatggcgttaatcggtctgccgtttacttggaaatttttgtggtcgccgctgatggacgcggtcaggctgcccgttttgggacggcggcgcgggtggatgctgctgacgcaggcagggttgctggcggctttggcggtctatgcctttttaaacccccgtaatcatctgccgctgattgccggcttgtcggtgcttgtcgcttttttttccgccagtcaggatattgtattggatgcgttcaggcgcgagattttgtcagacgaagaattgggtttgggcaactcggttcatgtgaacgcctaccggattgccgccctgattcccggttcattgagtttggtgttggcagacaggatgccgtggttagaagtatttgttatcacttcattatttatgctgcccggccttctgatgacgctgtttcttgcgcgcgaacccgtgttgcctcctgccgttcctaaaacgttgaagcagaccgtggtagagccgtttaaagaattttttacgcgcaagggcatcgcttcggcggtgtgcgtgctgctgtttatcttcctttacaaactcggcgacagtatggcaaccgcgttggcaacgccgttttatctggatatgggtttcagcaagaccgacatcggtttgattgcgaaaaatgcaggactgtggccggcagtggcggcaggtatcttgggcggtgtgtggatgctgaaaatcggcgtaaacaaagccttgtggctattcggcgcggtgcaggctgtaaccgttttggggtttgtatggctggcagggttcggacctttcgacacggtcggcacaggcgagaggctgatgctggcggcagttatcggcgcggaagcggtcggcgtggggttggggacggcggcgttcgtatcgtatatggcgcgtgaaaccaatcccgcatttaccgcaacgcagcttgcgctgtttaccagcctgtccgccgtcccgcgcacggtcatcaattcctttgccggttatctgattgaatggctcggttatgtaccgtttttccaactgtgtttcgcactcgccctaccgggtatgctgctgctgctgaaagttgcgccttggaacggggagaaaactcaggatgcaggcagatgaacgcgtcaaactggagcgtttacctgatattgtgtgaaaacagcgcgttctattgcggcatcagcccgaatccgcaacagcggcttgccgcccacacaaccggtaaaggcgcgaaatatacccgcgtattcaaaccggtggcgatgcgtatcgttgcaggcgggatggataaaggaacggcactcaggcaggaaatcgccgtcaaaaaactgaccgccgcacaaaaacggcaattgtgggagcaggcagaaaaaatgccgtctgaaacctgacggttcaggttcggacggcagttggcagcaatcagggaaaagcggggcaggcggtaaggaaaaccgacgtttcaacacacaggacggtacataaagcgtcgccctatgaaagtgaaggcatatatcagtattttttatacgccaacagaaaagaatacgatgaactgtttgttggatttgtattgattaatcagtatattttttatgccggggtatttttccttatcggtatcccttcttttatgaggatgcctgccgctcatataaagaacgggaaaatacgatgggaaaatacggtacagccctcgacatcgcacaatatgtcaacttatagtggattaacaaaaatcaggacaaggcgacgaagccgcagacagtacagatagtacggcaaggcgagacaacgccgtactggtttttgttaatccactatatttgtttgttttatattgtaagtatacgtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgaagatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagcaaaagttagtaaattatttttaactaaagagttagtatctaccatgaatatattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaaaacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatatgaagcttatgaagataaaagacatattcctgaaaatccatattttcatgaattttactatattaaaaaaggagaaaatccggcgattattactcatcggaataatcgaataaaccaaactgaagaagatagttatagcactagcgtaggttcctgtattaacggtttcacggtacggtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggggtggaaaacctatgggatgatacggtcggtaaaaagacccgtttaatgtgtatttccgttttttggattgtggttttcaatttgtagcgaatcggattcggcatatacggcattgcaaaaagcgtttgactctccaatgccgtctgaaaaccggtttcagacggcatttgcgttcagtgagaaaggtcgcgcctgccgcccgaacgtctcgccgcagcctctgcataacggcgcacctctttttccaaattttccaagttcaaaggaaaatcaggcagtctgtctccctgtttctcttcgcggacaatccgcccgccatccaaataccacgtctgttgcgcatgataggtctgcatatccgccgttacgccatccgctttcaatgctaccgtcgaagattgtgcaataaaaagatttccgtttttcaaataatattcgaaactctggcgtttttttccattgtcgaaactccaatagactttttgcggcagaccgtccgcatcatagccgaccacaagactgttcgccttcatccctcggggcatcaattcccgcatattctgataaaacacagaattgcgcgagtccgacgcaattcggttgctctctttgcggaagtcccaaaccttctgctcgtcattcgcgacatcccggtatttcgccaaatatacctgggccatctgataacacccgaggcaatgctcataaacatcttccccgattttcccgcgccccgccgcatcaaataccgaaccgtctggttgccaaacaacccgatattctcctgtcgtttcataattttccccgtgaaccgttccgccgtacacatttacagaaaacggacgatcgttccgatacagatattcggcattaacaaatgcttccggcgagcgttgcgaaagcgaaaccgcaaccaaaccgccctcgccgatatggtaatccagccaaacctctttcccatgttcctgctccgttacgtgaaaccatttcgccttttctttcaaacgactgagccggatagcgagcgcgagataatccttctccgactgcaacggaccgtcatccacagttccggcaagattttcctccgtccttatcgattccttcacgatgacaaccgccctgtcggcatttcggaacaggcgggcaagtttcgccacaaaagcattcggatttttaggtacttcagttgccgtatcgctcaaaaaccaacgcggattaatctcataggcaatacccgttcccagccaaaaggcaaatacaagtgcaaaaaatgacaacagtaccggtttgaattttttaaacatatttatttttcgtttaacagaatatatcgattatatcagacgagctttgattgccgggttttgctattttttgttgtaataatcaaattgcacgttgactatgtctttctcggtaaaaatataacggagcattgttttaagcctttcataacgttcattaattcctacgctatcaggtagccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaacaagtaatatttcttctgaagttttttaactcacacataatacacataataattaatctccaatacgatttaggtttttatcaaatgtaccgtttcttgtttcttttctgtaatgttattcatcgtagtaaggttctgttgaataattgtctttgcccccggcaatgatagtaacaattttcccttttgcttcccaagcttgtactcctatttcatcaaactcatagacatatgtcggataagattcatttgataaataatatttatcaacaccgtatgatttagggtaatggaaaagctgtttaaaatcttcaaaattcagacctattatattaacgcccataaaatatagctcctgataacaaaatatcgaaataattttgtttttttttttgacggaaatgagtaaatttgagtcgggagattcataatattctgttctaaactcatcaggaggttcatacataaaagtttccagtatgtttttgtactgtgttatatccgcaccaaaacggaatattcctacagaagtaaaaggtaaaaattcgggagttttaacgaccgcgtcgaccatgctcttctccttttgtttttcgattggcatttttggcaatatttctgattttttgcttaatctttaagcgttcatttttggacattccgggaataattttatttgttaattcagcaatttttgattccgctgatatttgacttcgaccgccatctccatgtttttcattcttggagcttcctgttcttttaggcggacaagaattatgaacccaaaccccttccgtttccgcctgattacccttgacgaagtaagtatgccaatcggcaacggtcagattgtaggctttgagcggttttggtttgacaacggttttgcggacggtttgggttctgccgctttcggataacagcctgcttcccgctttcaaatcttccgctttaatccatttgccgtccgaataaaacggatggatgcggttggaaatcaggatttggctgttgccgatgccgtctgaaagccggatatcgcttcagacggcattttgattgccgggttttgctattttttgttgtaataatcaaatcgcacgttgactatgtctttctcggtaaaaatataacggagcatcgttgtgaatctttcataacgttcatgaattcccacactatcaggcaaccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaataaggaacgtttcttataatatccttgaactcacacataataatgtatctccaatataattaaacttttcgtctcaatctacctttactatgttgtattggaaagtaaaaaaatttccagtcctctacatctagatcagtaaaaatataacggagcattaccctgaacctttcataacgctcattaattttgacacttttaggcaaccaagtagaagctttaatttcaaaaagtttccaattttgaaccattaaaaaatcaataatggtaccgattccaatcacgatgtcccttggtatatccatcggataaggatatttttttctaacctcaattaaatcattctccaatttccaatattcttcatcatcccacaccccgtcatcataccatttgccaataaatgaattttcgtcatactccttaaaacaagggatgtttcttctaaaatccttgaactcgcacataataattaatctccaatacgatttaggtttttatcaaatgtaccgtttcttgtttcttttctgttcagtttttcgggtgaagatgcctctttccaagcacctccattatgtgaatctacatcgcgtgatatataactctttccttttttaaaaatagcagcatcatttctcgttctttcttttatttttctatatcccaattcctttgctgctgcatatgcttctgaatcattcccatatatgggggtagatggtgtttttcttggcggacaatcattatgaacccaaaccccttccgtttccgcccgattgcccttgacgaagtaagtatgccagtcggcaacggtcagattgtaggctttgagcggctgctgtttgagggtaatgttttgaaccgtctgttttgcaccgctttcggaaagcagggtgtcgccttttttcagacgacctgcctgtatccattttccttgactgtaaaacgggtggattttattggaaatcagggtttggttgttgccgatgccgtctgaaatttcaatgtaaacggtttcttgatacggattgccgtatcgggcggtaacgggtttgtatcccgtttttccgcttgcctcgtccttggcgaagacgcggtcgccggttcggatacgggcaatggctttgtagccgtctgccgttttgaccaaggtgctgccgtggaaggagcaggtgtaggatttttaaagaacttagttctcaatatcctgtttcattcatcaaaatgccgtctgaaagctgaataccgcttcagacggcattttggtggttgggtttttaagccaacctacgcttactgaaaaccaaattgagtttcagacagtttttaggtttgggtgtccaatctaacttatatttgtccatttaattagtcgtttgtatcaaatttccattatttattttccaatttactttataattatcttcataataatctaattcaaaaaaacctgatatttcaatatccaattccattattgttttaatacatttttcaaaataaataatgaaataagattttacgcatgcaccaaaaaaaatatagctgctccaattaaaactatttgtcgggaaaacccacccgcttttatatatttttgcagattctttctcttcgatattaaagggacaattattccaaaaattattaatgttttcttggatgatttttatatcatcgtcagagcattcaatccatccttttatggaaacatatgatgccatgtttaatctcctaaacctgttttaacaatgccgccttttgattcaatatatgacttaacttgtgaatgaacaccgtatttaaaccaaaattctgcacgttttccctgttggtttgctgcttcgatggttgctttaatttgctttctatttttttgatttaagaaatttttaggtttatctattgctgaaattgttcttttggcttgtattaaagcatcattcgtaacagcgtcaatttctctgccgttaataaattttgatgaaccatcagtttttcttctaattaaatcttcataatgtatatctagagcttctctatactttgcattttgatataactgtctcgcactatcagacaaagccaatttctttttataagaatcagcaaaatccccgctaaccgcagccttccctggttttgccgcctttgccaacttcgcgactttggctgctgcggcaacgttgaagacggcttcgacggtttcggcggcattgggattttcctgtatccaccggtcaacggcttcgcgcgtattcttttcaaagcccgccacgctgcccaagccgccgatgacggcgaatttgccctcggcgggcaagggggcgatgttgcgcattgcggctttgtctatggcatagcgcgttccgtacagtatgtcgcctatgcccaaggcttcgcccgcgctgataaaggggttgagcgcgccggcggcgacgccgttgataaactccatgctgttgccccagcggtcgagcttggcattgtgctcgaacatttttctgttggcttcatcggcgcggtcggagaaattgctgccgaggttgctgtaattgtcggatatgcgttgccggatgctgcgggtgtcggtcggattgagtttgatactgcgggctgtgccgttgacgtgataggtgtattcgtctcgtgcgcccgtaggtttggggtaattgccgcccttcgggccgtcgtaggcatcggcgggatgatgttcgtgtccttcccagttgagccggtatacggtaaagccttcgtcaacgttgcctttttcttcgctcgcgctgtcggcggcgtggttgtcgaagggggcgtgttcttcgtgtccgtgtccggaaaagcgggtgtggtagccgattgtgccgttgatgtttgcctgttggatgagcaggttgcccatctggtgggtatagtcttggatgacgttgattttgccggtgcggtcggaaacgctgccgcgcgggtcgccgaagaggtggtatttgccgccgggttcgtagtgctgccgttgggcgttatcggtaatgaacgggtcttgcgccaagtccgccgcgagggcgggctgtatgagtgcggccgccgctacggcgcaggcggcaaggaggtttgtcagtctgcgcagcggtttcacggtttatcctcctttgcggcggcggatgacttcgttgccgacatcgggttttttaccgttgttttgtttgaagtcgggacggttttgggcggttgtgtcgccgtagggggtaatgtcggagaaatcgaccatcaggcggtctgaggctttgacggttttgctgactttgtaagggccggtccaaagggcgtattgttcttggtattgggattcgtaggcggcggttttaggggtaatcagcagtttccggctgtcgcggtcaacggcgaaatattcgagcttggtttgggctttaagggtttcggcgttgtagaggtgcagttcggtacggctgcggacggtgccgaatacgtcgacggttacgaatacgtcggtgtcggcgtattcgggcggtacgacttcgatgccgcgcaggtagaagacggtttggatgaggttggtcaggaaggaaacgtcgcgggggttggcgagcagggtttcgttgcggtagtcgcccgtgccgttgacggacagtccggcggagcgttcgcctttgcgtccgctgtttttcgtcagggcggcggcgggggcgttcaaaagcgatgtggaagtggttacgctggagagcgcgtcggatttggtggtggcggtagtgtcgtaggcggggtagctgtattgggtggcactttcggggttgttgtggtagccgccgcgtatcagtgcgtcgatagagtagcgtccgccgcttatgttgcccgaaccttggtcaccg

SEQ ID NO: 16 - DNA, 72750 bp, Neisseria meningitidis
cggcggtatcggcagcatgttgcagagattgacgggtcatttcttttcatcaaaaacattcaacaaaatacactttaggcagtccgattcaggctttacgcttgaaaaacagcctgtccagcgaccatgctccgccgcccgccgccgcgatatagaggaatacgaagcagaacagcactgcggactcgccgccgttggcaatcgggaacaaagcatttccggaagcgtgcgccataaaataggcaaccgccatctggccggacaaaacaaacgcggcagggcgcgcaaacaggcccaacaccagcaaaatgccgccgacaatttctaaaataccggcaagcagcaacgagcccgccgggcgaaccgctgcccatttcaatggggaaggcgaagattttcgacgtaccgtgcaacaaaaacaggtaggcggttacgatacgcaaaacagaaagcaaaaccggttggatacggttgcagcaatcggacataaaagctcctttgatatttgtcttcatttcaggcggtagagtatagatgtttccccttttcaaatatatactgcttttattgatacaacttttccacacaagaaaatatggacaccctgttcagcctcaaggttttccgccaagtcgtccaaagcggcggcttcacccgcgccgccgacgcgctcggcatctccaccgcaatggcaagcaaacacgtcagccacttggaaaacaccgtccaagccaaactcctgcaccgcaacagccgcaacctcagcctgaccgaagccggggaagaatactaccggcaatgcagttacgcgctcgacacgctcgacgatgccgcgcaaaaagccgccggggggacggaaaaaccgcaggggctgctgcgcgtaacgatgccgctgtggtttgccggcagccagatatgcaactggctggcggaataccgcgaacgttatcccgaagtggcattagaactgattttggacaaccgccacgtcgatttgattgccgaaggcgtggatttggcgttgcgcgtttcccaaaccctgtccccgtcgctgattgcgcgcccactggcggaaatcgaatttgccctgctcgcctcgcccgatttcctgaggcgcaacggcgtgccggaaacgccggaagaagtggcggggctgcccgccgtcctgccgacctacaccaaccagcagaaactcgacctcacccgcaaatcggacggcaaaaaataccggcttgaactgacccccgtcatccgtaccgacaacacgctgatgatgcgcgaaatgattaaggcgggcgcgtgcatcggttatcagccgctttgggcggcggaacacgatttgcgctgcggcacgctggtgaggctgctgcccggatacgccgtcccgaccgaccggctgaatgccgtttatgcagacagggcattcttaagcgcgaaagtccgcagcttcatcgattttctgaacgaaaaaatcgccagcaggaaaggctgccgaaatgccgtctgaaaccgcccgccccctttatgcggacacgtgcgccgcacacacgctcgtctggttccgccaaaacctccgcatccgcgacaacgccgccttatgcgccgccgttgccgaagtttgcccattatcggcatttggattgacgatgccgaaacagacaaccctcgccgcgccgcgttctaccgccaatccgccgccgaactcgcccaagggcttgcagggcgcggcatcccgctctacacggcggcatctcctgccgagctcgtccggctcgccgtccgcctcaatatccgcaccgtcatcgccgacgaatcccatacttttgccgacaaactcgccgacaacgccctttggcacgaattggacaaacacggcatcgcgttaaccttcgtcaacgaccgcgccgttttcggcaaaaccgacctgatacccgacggcggcacggcatatgccgatttcgaccgctaccgcgaagtatggctcgaccgcttttccaagcagccccccgccggtccggacctattcgcggcataccgccaacccttccccgaaaacctttccgccccgcagcctgccgcgctttcagacggcatcttcctgccgcaaaacagcggcgaaacggcggcttggcggcagtggcggcggtttctcgaacaggcggattcctactccgttttaaaggatttcccctcgcgcaaacacacttcgctgatgggcgcgtatttgagtgccggctgcatctcgccgcgcctgctcgcgcgggaaagcctcgaacgccgtctgaacgcgtgggcggacaacatcatccgccgcgattttttccttcaacttgccttgcagcacacggatgacgacccttcagacggcaatcctgaacacaccctgcgcctgacgctttggcagcagggccggaccggcattccgattatcgatgccgcgatgcgctgtttgcacaaaaccggcagcctccaccccgccctgagacgcttgagcgcggattttttctgccacgttttaaacctcccccgccgcgaaggcgagatatggtttgcccgacagctgaccgatttcgatgcagcaatcaaccaaggcaactggcggcttgccgcctcacggcacacctgccccgacattgccgccgccgcacacaaaaccgaccccgacggcacctttgtcagacggcacattcccgagcttgcccacctgtccgccgacaccgtccacacgccttggcggtttgcctgttcggtcgatacccacggctatcccgcccatcctgtcgccggtattccctaagcggtacggcaacctaaaacaaatgccgtctgaacttccgtttcagacggcattgcgtccgaatgactcaatatcttccgtttttttcactttcaatcatcaggtatgcccaaatcaccgccacccaagccgacaccgttcccatcgccggcaaaaaatgctgccaatccgtcatcggcggcacagggcaacggccgcattcgatttccgcgccgcccaacaaccggtacagcaacatatccgcaatccaaagcaacaacgggtatttcaaacgctgcaaccaaaaaaccaaccacgtccgcacgattcacctcaccccccattccgacaacgatattgtaccgcttccgtgcaatgttaaaataagcccacttctaccgccgtacaaaacgccatgctcaccgatttagaaaaaaacgccatccgcgaccattaccaaaacatcggcaaaaacctgcccggtttccgtccgcgtgcttcgcagcgggaaatgattgcggcggttgccaacgctttttcgcggacgttggcgcgcgaagaaggcggcgagccgcccaagcgcgaaggcgagagcattgccgtgatcgaagggccgaccggcgtgggcaaatcgttggcctaccttttggccggcggcatcatggcgcaaacacgcggcaagcggctgattgtgagcagcgcgacggttgccttgcaggagcagttggtagaccgcgacctgccgtttctggtcgaaaaaagcggtttggaactgaccttcgcacttgccaaagggcgcggccgctatctctgcccctacaaactctatcgactgacgcaaagcaatgcccagcaaaacctgctcggctttgaagcccccgccgtcttgtgggacagcaaacccaagcccgaagaattgaagctgctgcgcgacatcgccgacgaattttccgcccgacggttcaacggcgaccgcgacacttggccggaaaaaatcgatgacgcgatttggctcaaagtgaccaacgaccgccacggctgcctgaaaaccgcctgtcccaaccgtccggaatgtccgttttacctagcacgcgatgtcttggaaaccgtcgatgtcgtcgttgccaaccacgatcttctgcttgccgacatcagtatgggcggcggcgtgattctgcctgcgcccgaaaacagtttctattgcatcgacgaagcgcaccacctgcccaaaaaagccctcagccgttttgccgccgaacattcatggaatattgccgtttggacgctggaaaaactgccgcagctgaccggcaaaattgccgcgctgaccgataaagccgaacttgccaacctagccgacgaagccgccgcatccttgctcgacagcctgcatgaatggcaattccatttggcggaagagccgtctttaagtctgggggtgtctgaaaacgacagacgaaccaacagcgaaccgacttggctgtgggaagacggcaaaatccccgaaggcctcgaaaccaccgtttccaatacggccattgctgcgcgcagcctgctcaaacacgttatcgggctgaacgatgcgctttctgccgcacgccgcgaaaaagaacaggacggcgcgctcctcgaccgcctgaccagcgagttcggtctttttatcgcccgtatcgaacaaatcagcgcggtttgggatttgctctccactgtccccctcgagggtgaagaaccgttggcgaaatggataacccgccgcgccgacgacaaaaacgactacattttcaacgccagccccatcagcagcgcatcccaccttgccaacagcctgtggcggcgtgcggcaggcgcggtattgacttccgccaccctgcaatccttgggcaacttcaacctgatgctgcgccaaaccgggctgcaatggctgcccgaaaccaccaccctcgccctcaaaagcccctttgactttgaaaaacagggcgaactctacatcccccccatatacgccagccccaaagaccccgaagcccacaccgccgccgtcatcgaatggctgcccaagcttatttcgcccaccgaagccatcggcacgctcgtcttgttttcctcgcgcaaacaaatgcaggatgtcgccctgcgcctgcccggagactacctgccgctcttgctcgtacaaggcgaattacccaaagccgtcctcctgcaaaaacaccaccgggccatagaagaaggcaaagccagcatcatcttcggactcgacagctttgccgaaggactcgacctgcccggcaccgcctgcgtgcaagtcatcatcgccaaacttcccttcgccatgcccgacaaccccatcgaaaaaacccaaaaccgctggatagaacagcgcggcggcaaccccttcatcgaaatcaccgtccccgaagccggcatcaaactcatccaggccgtcggccgcctcatccgcaccgaacaagactacggccgcgtaaccatcctcgacaaccgcatcaaaacacagcggtacggccaacaattattggccggcctgccgccgtttaaaaggatagggtaaacataccgcccttcccgcaacagaaaggaaaaattcatgaactttacccgactgctcaaccaagtcttaagcacggttcaaaaaaaaggcaacacattctccgacagcccgctcaattcattcggcggaggcgcgctggttgccggtgtcgcctccatgctgctgaacggtaaaaaccgcaaaaccatcaccaaaatcggttcgaccgccgctttgggctacctcgcctaccggggctatcagatgtggcagcaaaacaaagggcgggcaaccgtaacacaaagcgatttccaacctgccggagaaactgaagaaacatacagccgtaccgtattgcgcaccatgatagccgccgccgcttcagacggcatgatagacgaagccgaacgccggactatcgaacaggaaagcggcacagaccccgaaactgccgcatggctcgccgccgaataccgccttcccgcaagcatcgaagacatcgccgccgccgtcggcaacgatgaggcgttggcggcggaggcctatctggcggcaaggttggtctgtgccgatttgtcgcggaaagaaaccgtcttcctcgcccgcctgtcgcaggctttgaaactggatgacaatctggtggagagtttggaaaggcaattggggttttgatgacacagccggggagggaaaatcatcaaaaaacggttattccgaccccggcctcaaaacggcaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactataaaagccgccgccccgaacggcaaacagcggcataggctgccaaaggcaatatccgacaagaaggcaggctactgcaatgcgccgccgtgggaagatttaagcaggcgttcgtgtttgtggaattcccgccccatataataagaaccgaaataggtcaggtggtcttggtcgccgtaaagatagcggccgtatatttcgaccgtgtttttgggcaggtatttttgtgcgtccacccaatgcacattgggaatatctttaatcaaatcaaagaccgcctgattgctcttgccgatgtcgcccatagcctgaatggggcggagatattggtttgcggcaaatcttttcaatttttcctccctcaggggcgaacggctgattgatgtgttgtttgcaaaaacatagacgggtttgacggcggctatccttttgacggtttccctgaatcgggctgggaacccgggtattaggaaggattgcgcttcaaatctcggcacaggctggccgcccatcctcaaatcatagaattgggcaatgaaaacggcttcggctttttcaacttcatcccggtattttcgacataacgggttgtctgccagcttctcatctacccaaaccaaacactccgaatcgagggacaggattttggctttccacccttcccggctgccgacataatccagaaaccccctcaggtgtccggcgtgcgagtcgccgagggtcaggacggtttccggaaaatgattttccgcagcaaggggcgcgccgggcaacgggcggaggtgttcctgtttcaatatccccccttgcgtacaggttgtaaccgacaagtatcagggacggggcgagatagaggcagaaaaatgcctttttgaaggtcatcttccgttttctaagcggctgttcaatcaaataataactcaacagggaaaatccggccgtcaacgcggcaaccgccgatacggcaggcagtccgagctgtttgtcgcctgtaatgtaatgggcgaaagcaataaaaatccaatggtacaggtatagggaataagagattttgccgacaaatacgatggggcttgccgacaggatgcgggtcggaagtgtcccgtattgcatactccggataagcagtgccgtcagcaggcagggaaggagcagggtcattcccgggataaacggattgtgtttgtcaatcacgaacaggcaggcaagcaatgcgccgaagcagagtgatgaaagcaactgccgttttccatttgctgtttgccgtctgccgttttgcgtttgcccgtaaaccgccagcagcgaacctgccaacagctcgggaaacctcagtgtcgaaaggtaataagtattgggttggttgaggatgtcggtataaaacccgcttggcaaaaacgatgaggcagtcaaaatcaaaaacaggatgatgctgatgttacgcagcacccgtagcgatttggtttttttgcagcaaaatatcagcaaaaggggatacaggaggtaatactgttcctctactgccaaagaccagatatgcagtacggggttctcgtcggcactcaaatcgaaatacccctgctgaaaccccagataaatattggacaagaaaaccgcagaaagctccacggttttccgcatttggttgaaatcttcgtaaaggaagatttgagaggcaatcaccgaagccagcgacacggccgcaataaaggcaggataaatccgcttaatcctgcgggtataaaaatcccggaaagaaaaagaaccgttctgtatttcagaaagaatgatgccggtaatgaggaatcctgagatgacaaagaaaatgtccacccccaggaatcctccgggcagccagcggttattcaggtggaaaatcatgacggatagcacggcgacggcccgcaatccgtcaatttccggtctgtatcggacagcttgcataaatatcgcccccgtatgtcccgttatcttaaaaatgccgtctgaacgcgcgttcagacggcatcggtttcagtaaacgctcaaatccgtttcgccaacgcttcagccttgcccacatacagcgcgggggtcagctcaagcaatttggctttggcttcggcggggatttccagcaatccgataaagcctttcagcacttcgggcgtgatgccgcctttgccgcgcgtcaggtctttcagtttttcgtaaggattggcgacaccgtaacggcgcattacggtttgaatcggctcggcgagcagctcccaagtggcatccaaatcggcggcaagcgcggcggggttgggttcgagcttgttcagaccgcgcaggtgggcggcgaaacccaatacggcatagcccacgcctacgcccatattgcgcaatacggtgctgtcggtcaggtcgcgctgccagcgggaaatcggcagtttttcggacaaaaagcccaatacggcgtttgccataccgaggttgccctcggagttttcaaagtcgatggggttgactttgtgcggcatggtggaagaaccgacttcgcctgctttgactttttgtttgaagtaacccaatgaaatataaccccaaacgtcgcggttaaagtcgatgagaatcgtgttgatgcggctgagggtttggaagaattccgccatatagtcgtgcggttcgatttggatggtgtaggggttgaaggtcagaccgaggctgatttcgacgaagttgcggcagtgggtttcccaatctacatcaggataggcgaccatatgggcgttgtagttgccgaccgcgccgttgattttgccgaggaactcttgcgcttgcaggtttttaaactggcgttgcaggcggtacacgacattggcggtttctttgcccaaagtggtcggcgtggcgggctggccgtgggtgcggctcatcatcgggacggcggcaaggtcgtgcgccatagcggtcagtttttcgatgatttcggccagcttcggcagcaaaacagcctcacgcgcttcttgcagcattaaagcgtgggacaggttgttgatgtcttcgctggtgcaggcgaagtggatgaactcactcacggcggcgacttccggcacttcggcaaaacgttttttcagccaatattcgatggctttgacatcgtgattggtggtggcttcgatggctttgacggcggccgcgtcttccaatgaaaagttttcaatcaccgtgtcgatttcggcaagcgtttcggcactgaagggcggcacttcggcaatcttcggctcggcggcgagggctttgagccagtttaattcgactttgacgcgcgccttcatcaggccgtattcggaaaaaatcgggcgcaatgcttcaacggattgggcataacggccatctaaaggggaaagcgaggcgatggggttgatcatttcggcatcctgttcgggaaagacatcaaaaattgttaaattgtttgcaattatacatcactctcaggacgctatgccgtctgaagcccgtgttccgacagatacgcaacgatttcgtcttcatcgtccgatatggcaaacaaagagaccgccccttcggaaatcagaccgcgcgccaaaagctgcgcgtttatccactccgccaagcccgaccaaaacgcctttccgaccaaaacaatcggacgcggcggcactttgcccgtctgcaccaaggtcaggatttcaaacaattcgtccagcgtcccgaagccgcccggcatcacgacatatgcttgggaatagcggaaaaacaccgccttgcgttcggcaaaacgggaaaaccgcaaggcgatgtcctgatacggattcggtttctgctcgtgcggcaaaacgatgttcagccccaccgaaaccgacttccctgcaaacgcgcccttgtttgccgcctccataatccccggcccgccgcccgaaatgacggcaatgcccgaatccgacagccgccgcgccagacggcaggcgaacgcataatccgcatgattctgcggcgtgcgcgcgctgccgaagatactgactgccggaaacacgcccgccaatgcttcgtctgcctgcctgcgttcggcatcataacgtgcctgctccggcacacggtttgtattctccattccatcctccgttcaaaaacagcgattgtacaccgtcaaaaacgtatagtggattaacaaaaatcaggacaaggcgacgaagccgcagacagtacaaatagtacggaaccgattcacttggtgcttcagcaccttagagaatcgttctctttgagctaaggcgaggtaacgccgtactggtttttgttaatccactataacgcaagcaccgcaaagccgcgccaaccctctcccaaccttttttcagacggcattttcggtaatctgctaaaatcgcccgcttgagtttccacagaaaaatccgaaaaatgaatattttttacgaagagtccggccaattcaaaatcgccgccatcatccaaaaaaacgatgccacctaccaagtcgataccccacacggcaaacgcaccaaagtgaaggcgaacaacgtctttgccgagtttgacggcgatatggcggcgtttttggaaaacgcgcaggcacaggcggcggacatcgacaccgatttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaacgcaaaaaacagcaagacgcgcaaatcgacgcttgggcagaagccttgaaacgcggcgagatgccgtctgaaatcgcggcggatttgaaaaccatcctgcacgcgcccgacaagcagtcgctgacctacaaagcctttaccaaagccgccgacgcgctgaaaacctctgcctacgaattggcgaaaaaaacgggcggcattacgtccattccccaatacctgcaagacgggtttgaaatcaaatacttccctaaaggaacaggcttccccgaccttgcccttcccgaaatgcccgacctgcccaaggccgacgttaccgccttttccattgacgacgaatcaaccaccgaagtggacgacgctttaagcctgaccgacttggacaacggcacgaagcgtgtcggcatccacatcgccgcgccgtcacttgccgttaaaccgggcgacaaaatggaaaaaaacatcatggaacgcttgagcacggtttatttccccggcggcaaaatcacgatgctgcccgaaaactggattgccgcgttcagccttgatgcaggcgcacaccgccctgccgtcagcatttatttcgatgtggacggcgagttcaacgtcggcgcgccgacctgcaaaatcgaagcggtcaacatcgccacaaacctgcgtatccaagccatcgagccgcatttcaacgccgaaaccggcttggacgaagccggcgaaatgatgttcgcccaccatcaagacctgatttggttctatcaattcgccaccgccctgcaaaaagcgcgcggcaaatacgaacccgaccgcgcgccgcaatacgattacagcatcgaattggatgaggaaggcaaggtatccgtcgtccgccgcgaacgcggctcacccatcgatacgctggtcagcgagatgatgattcttgccaacagcacttgggcacaaatgctccatgacaacgacctgcccggcctcttccgcgtccaacccaccggaaaagtacgcatgagcaccaaatccgagccgcatatcggcatgggcgtgcagcattacggctggtttacctcgccgctgcgccgcgccgccgactacatcaaccaaaagcagctgatcagcctgatagacgacactgccgagccgctgtatcaaaacagcgatgccgagcttttcgccgcactgcgcgactttgatgccgcctataccgcctacgccgatttccaacggcagatggaagcctactggagccttgtgtacctgcaacagcaaggtacaagcgagctgaccgcgaccatcctcaaagaagacctcgtccgcatcgaaggcctgccgctggtcacgcgcgcgaccggtattccgtttgacgcactgcccaaatcacaggcattgttcaaaatcaccgaattggatgccgagaagcagtttgtctcgctcaactacatcaaggcagtcgcacccgcgggtacaacggcaggcaatgccgtctgaagcccgatacggcaaactccggcaaaaacagaaacctgaatctcatcattcccacagtcgggaatccggttttttgggtttccgttgtttttccgtttcaatgaacttccaagccgccgttcccgataaatacccgcaatctaaaatcccgtcattcccgcgaaagcggaaatccggctcgttcggtttcagttttttaggtttcaggcaacttctgaatcgtcattcccacgcaggtgggaatctaggtctgtccgcacgggaacttatgcgccgtcattcccgcgaaagcggaaatccagattcttcggtacagaaacttatcggataaaacggtttctttagattctacgtcctagattcccgcctgcgcgggaatgacggcataggggtttccgttttcccgataaattaccacaacccaaaatcccgtcattcccgtaaaagcgggaatccggctcgttcggtttcagttttttaggtttcaggcaacttctgaatcgtcattcccacacaggtgggaatctaggcctgtccgcacgggaacttatgcgccgtcattcccgcgaaagcgggaatccagaccgttcggcttcagttttttggtttcgggcaacttctgaatcgtcattcccacgcaggtgggaatctaggtctgtccgcacgggaacttatgcgccgtcattcccgcgaaagcgggaatccagaccgttcggcttcagttttttggtttcgggcaacttctgaatcgtcattcccgcgcaggtgggaatataggtctgtccgcacgggaacttatacgccgtcattcccgcgaaagcgggaatccagattcttcggtacagaaacttatcggataaaacggtttctttagattctacgtcctagattcccgcctgcgcgggaatgacggcataggggtttccgttttcccgataaattaccacaacccaaaatcccgtcattcccgcgaaagcggaaatccggctcgttcggtttcagttttttaggtttcaggcaacttctgaatcgtcattcccacgcaggtgggaatctaggtctgtccgcacgggaacttatgcgccgtcattcccgcgaaagcgggaatccagattcttcggtacagaaacttatcggataaaacggtttctttagattctacgtcctagattcccgcctacgcgggaatgacgatggaaagattgttgttgcttcggataaatttctgcagttttaaataaccggattcccgcctgctcgggaatgacggcataggtttttttgtttttccgataaattaccacaacccaaaatcccgtcattcccgcgacggcgggaatccagtcctttaaactccagccattcccgataaattcctgttacttttcgtttctagattcccgctttcgcgggaatgatgaatgacggtgtaaaagtaactcgaaatccaaaaagccataccgcccggatttttgccgatcggtatggctttttgcttcaaaccgccttagcggatgtcgacatacgcgccggaatgcaggtcacgcaacaggttgacggttgcctgttcggctttttgttggaagatgtattgccgcacggaattgcggatacgttcctgaggtgtgccggcatcgcgcacttcgttcaatttgatgatatgccagccgaattgggtgcggacgggcgcgccgacctgtccgggtttgagcgcgtggacggcttcttcaaaggcgggaaccatcacgccgtcggcaaaccagcccaaatctccgccgttgcccgcgctcgcgtcttgcgaatattggcgcgccaggctggaaaagtctgtgccgctgcgggcctctccgtagattttgcggatggtgctttccgcgccgacggcggcgttttcgctgtcggctttaatcaggatgtgttgggcgcggtattggcgcaacggtgcgccttcgggcagggtgatgccttgtttttgcgcctgctcgaggaaggcatcgatttcagcttcgctcacgcggctgttctgcatcactgcctgctggcggactttttcggcaatgatgttgtcggcaaaatcgcggcgttgggcggggctgaggtttttgagggcgggattttttgcgacgacggcatcgatttccgcttcgcttgcttgaatgttgcggcgtttgcccgcctgtacaatcagggattggttgacaagctgcatcagcacctgtcgggacagctcggattcgcttatctgcgcgtctttgggcaggttggctttggcttcggcaacggcttcggcaagccggcggcgcgtgatgacttcgttgtcggcaacggcggcaatgccgtctgaaaagcggataccgccctgctgttgtgcgggtgcggcttctttttgcgccgtggcggcaactttggcaactttggcaactttggcaactttggcagctttggcagctttggcagctttggcggatgcggtttttgccttttgcggtgcggcgtggacatcggctgctgccagcaatgcggcggcaatcatcagggctttgattttcatcattctttccttatcgtttgaatcctgcctttgatggcgggtttggggttgtcggtggaatgccgtcttgtgcgggaacggtgctcctgccaggtttccgacggtcagggtcgtttgttgcgtccggcggaaagagagtgggcggtgatatagccgggaacggcgacatccatcctgtctgcggggtttctgccgacactgctgaggtctttcaactgaagtgagaaaaagacagcgtttttgtaggtgttttcgccggtaacgtagcgttgggcgtacacgcccgcgccccagcagccgcaactgcttttgtattccgcacccgccagcacctctatcggttttttggcttcaaaaccgtagttgtaacggacgacggccgacaggttgcgcgtcagcggccattgtgcggacaggtcgagctggctgagtttgtcgtaaaaataggaaccgtcggacttcaggtagattttttcgttgcgcccgtatttgtagcgggcgttcagcactttgccctgtgcgggacggtagcttgcaccgacggcgtagttctcggcgcgtttgtcgttttggttgtagtggatgctgctgtcgaggatgaagcggctgccgatgctgccggaggcaaatgccacccagtcggaacggttgcgcggttttttgccgacgctgccgtcaagcatcaccgcatcatccttgaaatagaatttctgaccgatgccggcgcggaaacgctcttcccccgtcgcgccgtccaaaatacggctttgcacggcggcggaaaggctgtttgcggtgttaatcctgtcgttgccgtaatagaggttttcgcgaaagagctgcccgtagccgaagctgctttccgacgaatcgaaattgggcaggtcgttttgggatttggcaggaatatagttgtagaacaggcgcggctcgagggtttgcaggacttctccgccgaacatccgcgtattccgctcaaaagttgcgccgctgtcgatgttgacaatgggcagagtgcggctgacgcgtcgggcttcttggctgccgaagcggttgaggctgtaataggtggcgtgcagtccgagtttgggacggacatagccccagctgttgctgaaatcccatttgatgtcgggatagacgaccaggcggctgccgtcttggcggctgtcgtggctgaatcgggtaaattgtgcggacacgccgatttgcgccctgccggtgtttttacgccactcgaccgaaaggcgcggcatgagggcatacggtttgtctttgtagccgctttggtttgccagcgtctggtatttcagaaccgaaaggccggcattcaggctgccgcccgccgccctgccgccataatccagccatacacggcggttgaggttgacgttgccggcgatttctttgttgccgtaaaagtcgcggtagtagccgctgtcggagacttggttgaaatcgacacccgcctgaagcgtgtcggaaatgtcgtgccgatgctgccatttcgcctgatagcggttattcctgccgcttttcttgtcgtgcggcagccaggtcaggtcggactggccggcataatccggccgcaggtagcgtacctgcccgtcaaagaccgcgccgcgttcgccgatcacgctgggcgcgaacgtggcatcgagattgggggcaaggttgaaataatagggaacggaaagggaaacgccgtccgaaccggcggacagtgagggaacaagcaggccgcttttgcggttgccgtcaagcgggaagtccgcccaaggggtgtagaaaatgggaacgccgccgaacacgaaggcggcgtgtttggcaacgcctatgcctttttcccgatcggcttcgacagaggctgccttgacataccagccggcatcgccggcggaacaggtgttgaattgggtttccgtcagtttgtaatgcccttcgcccaacatttcggcggtgcggctgacgctttgcagccgccgtccgccttgttcgatttccatgcggacgttgtgcgcttccccggtctgctgctcgagattgtaggtcagggtttcgccccgaatcagcgtaccgtcctgttggagggcgaaccggtcgcctgcggtaacggtgtcgcccgactggtcgtaatccgcccaatcggtattgagggtcgtccggttgcgttcgacgacgacgttgccttcggcacgcacctgcacctgcgactgtccttccatcctgtcggcaacaatgcgcgtatagtcttcggggatggatgcttcgccgctgccttggacggcggcttcggttctctcggggctgccgctttcgttactgcaaaacaggcaggtcgaaccgaggctcaggctggtaggctgtatgggttcggacacgctccgaacgctttctccggcggtcggattgtccgtttcctccgccgcaacggcatcggcggcggcgcaatgcgtgccgaagcagaggcccaatgccagcaccagtggtttgagtgaaaataaacgagccaaaatcgcccctcaagtcggtttgccagttagaatagcgtttattgtaacctgaaatgctttagtactgttatgcaacgacaaatcaaactgaaaaattggcttcagaccgtttatcccgaacgggacttcgatctgacttttgcggcggcggatgctgatttccgccgctatttccgtgcaacgttttcagacggcagcagtgtcgtctgcatggatgcaccgcccgacaagatgagtgtcgcaccttatttgaaagtgcagaaactgtttgacatggtcaatgtgccgcaggtattgcacgcggacacggatctggggtttgtggtattgaacgacttgggcaatacgacgtttttgaccgcaatgcttcaggaacagggcgaaacggcgcacaaagccctgcttttggaggcaatcggcgagttggtcgaattgcagaaggcgagccgtgaaggggttttgcccgaatatgaccgtgaaacgatgttgcgcgaaatcaacctgttcccggaatggtttgtcgcaaaagaattggggcgcgaattaacattcaaacaacgccaactttggcagcaaaccgtcgatacgctgctgccgcccctgttggcgcagcccaaagtctatgtgcaccgcgactttatcgtccgcaacctgatgctgacgcgcggcaggccgggcgttttagacttccaagacgcgctttacggcccgatttcctacgatttggtgtcgctgttgcgcgatgcctttatcgaatgggaagaagaatttgtcttggacttggttatccgctactgggaaaaggcgcgggctgccggcttgcccgtccccgaagcgtttgacgagttttaccgctggttcgaatggatgggcgtgcagcggcacttgaaggttgcaggcatcttcgcacgcctgtactaccgcgacggcaaagacaaataccgtccggaaatcccgcgtttcttaaactatctgcgccgcgtatcgcgccgttatgccgaactcgccccgctctacgcgctcttggtcgaactggtcggcgatgaagaactggaaacgggctttacgttttaaacccaatcaaaatgccgtctgaaaaccaagtttcagacggcatttttcaaacgggcttactgcgcggctttttgttcttcgcgtactttgtccgccaaaaggtcgatggtgttcataccggactcccagtcggcaaattcaactttatatttaccgccgacgataaccgtgggcgtaccgtcgatttggaaggtttcggtcagctcctgcattttgtcggcgcgcgcctggctttcgggggactcgtaggcggcaaggacttttttgccgtcaaaggcggtttgttcgcccagccattttttgaggacttccggattttgcagcttgattttttggttgaccatcgcatcgaaaatatggctgttcgccacatctttgctgtcggcggcagccatatcgacggcggcggcgaggcgtgccagcgtcagcatttctttctgccagacgacgtgttcggtacgcaggtacatatcgtctttaaaagacttggcgtgtttgcttaaaacaggttcgaggtgggcgcagtgcggacagaaatagccgaaaaactcaaggacttcgactttgcctgcctgctgttggggaatcgggttggcaaggacggtatagttttgcccttcgaccagccctgccggggcggcggctgccgaagcggcaggcgcgctgtcggcggggacgctggtttggactttgctgtcgcacgcggcaagggcgaacagggcggcaacgccgagggcaaggtgtctggatttcatacggttctccgtgatgttggaaacagatgttggaaatcaatcggaatccggctattttattgcatttccgcgtattgatacagtttgccgccggaaaaggacgttttcgtttcaggaaaccgcttcagacggcatcaaacccgatgccgtctgaagcggtttctgtcgtacaatacgcgccgttgccccagacgggtacgactgttgaggaacaatgatgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcggaggcttttatccgccatgtggcggggatgctgtcgtttgtactggttatcgttaccgcgctgggcatacttgccgcgccttgggtgatttatgtttccgcacccggttttgcccaagatgccgacaaatttcagctctccatcgatttgctgcggattacgtttccttatatattattgatttccctgtcttcatttgtcggctcggtactcaattcttatcataagttcggcattccggcgtttacgcccacgtttctgaacgtgtcgtttatcgtattcgcgctgtttttcgtgccgtatttcgatccgcccgttaccgcgctggcgtgggcggtctttgtcggcggcattttgcaactcggcttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgaatttacgctgtttgacgcgcagatgacgcaacacgcgctgattgcctattctttcggtttaatcggcttaatcatgattaaagtgttggcacccggcttctatgcgcggcaaaacatcaaaacgcccgtcaaaatcgccatcttcacgctcatctgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtgatgtgcggcggactgtgggcagcgcaggcttacctgccgtttgaatgggcgcacgccggcggaatgcggaaagcggggcagctctgcatcctgattgccgtcggcggcggactgtatttcgcatcactggcggctttgggcttccgtccgcgccatttcaaacgcgtggaaaactgaccgatgccgatatcctttttcggcaaacgcttttccacgcctatattcgggcgcgcatcccccacgtccgcaccagccggacgggctgccgcatcatcaatgccgtctgaaaacaagaaaaccgataccttatgattttaacaccgccggacacgccctttttcctccgcaacggcaatgccgacacgattgccgccaaattcctgcaacgccccgcgcccgcataccgccgagagctgcttcccgacagcacgggtaaaaccaaagtcgcctacgacttttcagacggcatttcgcccgatgcgccgctggtcgtgctgtttcacggtttggaaggaagcagccgcagccattacgcggtcgaactgatgcttgcggtacgcgatcggggttggcacggcgtagtcgtccatttccgcagctgcggcggcattgccaacaccgctccggtgttctaccacttgggcgataccgccgaaatcgcctttactttggacacgttcgccgcgcgttaccgtgaaatatacgccgtcggcgtatcgctgggcggcaacgcgctggcaaaatatttgggcgaacagggcaaaaaggcattgccgcaagccgctgccgtcatctccgcccccgtcgatgcagaggcggcaggcagacgcttcgacagcggcatcacgcggctgctctacacgcgctacttcctccgcaccctgatacccaaagcaaaatcgctccaaggttttcagacggcatttgccgcagggtgcaaaacactgggcgagtttgacgaccgcttcaccgcaccgctgcacggctttgccgaccggcacgactactaccgccaaacttcctgcaaaccgctgctcaaacacgttgccaaaccgctgctcctgctcaatgccgtcaacgaccccttcctgccgcccgaagccctgccccgcgcagacgaagtatccgaagccgttaccctgttccagccggcatatggtggtcatgtcggctttgtcagcagcaccggcggcaggctgcacctgcaatggctgccgcagaccgtcctgtcctatttcgacagcttccgcacaaacaggcgttaacggtttgatgctaatattccccctttccccagacgaatacggaacccgacatgaccgacatcctcaataaaatccttgccaccaaagcacaggaagttgccgctcaaaaagccgccgtcaacgccgaacacatccgcacacttgccgcagaagccgcgcccgtccgcagcttcatcgattcgatacgcggcaaacaccgcctaaacctgcccgccgtcatagccgaaatcaaaaaggcaagcccgagcaaagggttaatccgtccggacttccgccctgccgagattgcacgcgcctatgaaaacgccggagcggcgtgtttgtccgtactgaccgacgaaccctatttccaaggttcgcccgaatacctcaaacaggcgcgcgaagccgtatcgctgcccgtgctgcgcaaagacttcatcatcgacgaataccaggtttatcaggcgcgcgcatggggggcggatgccgtcctgctgattgccgcagcactggaacaggaacaattggaacgctttgaagcggtggcgcacgaattgggcatgaccgtcctactcgagctgcacgacgaaaccgaattggaaaaatgccgcaacctgaccacgccgctgtggggcgtaaacaaccgcaacctgaggacttttgaagtctccctcgaccaaaccctgtcgctgctgcccgcgctggaaggcaaaaccgtcgttaccgaaagcggcattacaggcaaggcggatgtggaatttatgcaatcgcgcggcgtgcataccttcctgatcggcgaaacgtttatgcgtgccgacgatattgaagcagaagtgggcaaactattctaaatcccgatttcagacggcatattgccgccgaccgatcaacacccttaccgagcacggaaccatcatgcaccgaccgaccgccaaacagattctgcacgaagtatttggttatcccgaatttcgcggcaggcaggaggctgtcatcaatactttggcaggcggcgggagtttgacggtgctgatgccgacgggcggtggcaagtctttgtgttaccagattcccgcgctgatgcgcgaaggcgtggcggttgtcgtatcgccgctgattgcgctgatgaacgaccaagtggcaaacctgcacgccgccggcatcgaagcggcggcagtcaacagcggcacatcggcagacgaggcgcgcgagattgccgaccggcttgcccaaggccgtctgaagctgctttatgtcgcgccggaacgcttggttaccgaccgctttttgcgttttctcgaccaacaaaccgtcagtctgtttgccattgatgaggcgcattgcgtcagccaatggggacacgatttccgccctgaatatcaacagctcggcatgcttgccgaacgctatccgaacgtcccgcgcatcgctctgaccgctaccgccgatgccgccacgcgcgccgacatcaagcattatctgcacttggacgatgcgcccgaatttgtctccagctttgaccgtccgaatatttattatcaggttatcgaaaaaaacaacggcaaaaaacaattgctggatttcatccgcaaagaaatgacggggcaaagcggcattgtgtattgcctaagccgcaaaaaggtggaagatgtggcgcagtttttgcgtgaaaacggattaaacgcgattccgtatcatgctggtttgagcatggacgtacgcgaggaaaaccaacgccgctttacgcatgaagacaatattatcgtggtggcgaccgtggcgttcggcatgggcatagacaaacccgacgtgcgctttgtcgcccatctcgatatgccccagagtgtcgaacatttctatcaagaatcggggcgcgccggacgggacgggctgccggccgcaagctggctgtgttacggtttgaacgattgggtgttgctgcgcgaacggattgccgaaggcaacagcgacgaggtgcaaaagcaaatcgaaatgcaaaaactcgatgccatgcttgccgtctgcgaaaccgccgcctgccgccgcgtactgctgctcaaacatttcggcgaagcatccgaaccctgcggccattgcgacaactgcctgcatccgcccgtacggtttgacggcacggtgttggtgcaaaaattactcagctgcgtgtaccgcgccggacaacgttttgccgccggttacatcaccaacattttacgaggtaaaagcgacgattggatacgcggcaaccggcacgaacaactgtccacattcggcatcggtacggagttgtccgacaaagaatggcgcagcgtcatccgccagtgtatcagcctcggctacctcaccgtcaacattacccgatatcaggcattgcaactgaccgaagccgccaaaaaagtcctcaaaggcgaaaccgaagtgatgctgcgtccgctcaagcgcgacaagcccgccgcccgcaccctcaaagacaactggctgcgtaccgaacgcgaagaacgcctgtggcaggcattgcgcgtttggcgtatgaaacaggcagaagccgaaggcatccccgcctatatgattttcggcgacaaaaccctgcgcgaccttgtcgaaaaaatgccgcaagacctcaacggtctgcacgacatctacggtttgggcgaagccaaaatcgaccgtttcggacacggcatcctcgaagtctgccgcaacgccgccggcttcagccgcgacgcggtcatccgtccgcaaaccgaacgcgaacaacaactgcgtcaaaaactcgaagcctggcggtatgaacaggcaagggcggaaaactgcgccctgcatgccgtcctctccgacgaaagccttgccgatatgcttgccgatacgcccgaaaccgaaaccgacctcgaaggcgtgtacggcttgggcagcgtacgcgccgccaaatacggacgggacatcctcgccgtctgccgtccgttttcagacggcatcgatgaaaccgccaaacgcaaacgccgcctgatgcgcgccctgatccaatggtgcggcgaaacggcaaaacacgaacagtccgaaccctaccgcattctcagcaaagccgcactgcgcgccattgccgccaaacagccggaaggcttggcggagcttgccgccgtatacggcgtaggcgaagaaaaagccgcacgttacggtgcggcggtgttggcggtattggaacgaaatgccgtctgaagcccgttaccaagtttcagacggcattgcctctatttaaaaattcctgtttttatagtggattaacaaaaatcaggacaaggcggcgagccgcagacagtacaaatagtacggaaccgattcacttggtgcttcagcaccttagagaatcgttctctttgagctaaggcgaggcaacgccgtactggtttttgttaatccactatcatatagatttttatgccatttggtcagaaacagcgaagacaggcagggaaacgccttcagttccatcgcgtcttcaaaatcatcccaaacatcgctcaaattctgtttggatatgccgtattcccgtccggcaaacatcacggtctttttgcttttggcggcttttttgaatgcctttctctgtttttcgggtatctgctgccatctcaactgacggtacacgtcgtagccgtcgccccaaaaagaggcataccgttgcgtgtcttcgccgaccagcggcgcggtattcccaacccgtacatatcccgtcggcacgacggcacttgccttatacatgtgcagaccgcgttcccaatacatattcaattgaatcgctcataaatttttgctccaaaatttaaagttttactatagtagaaataaatatcaaaactgaaaatattactgaaaaaattttatattgtttaacttttcttttatacgaattcgcctttgttgaaattaattgataatcaaaccagcaagaaataattccataataaaacattccaatccaataataaaattcaggtctcttagaattagtaaaaattttaaatccataatctctttcaaaagtagctattatacaagtaaacaatatcaccaaccctaaacagtccaacataaaaatatagtttaattttttgttcatacaatatttccaatattattctttaagtctttgtaaagcgatttcaaatccgccagctcctccgccccaagcggtttgttgccctgccagtccaaagccagcagggtcgcatgtgttttttttgccaccgtgttcttcaactcgggtaacctggcaggcagtgtactgcttcagtctgatgttatagacgcaatatacgtctccggcatcagcatatagtggattaacaaaaatcaggacaaggcggcgaagccgcagacagtacaaatagtacggaaccgattcacttggtgcttcagcaccttagagaatcgttctctttgagctaaggcgaggcaacgctgtactggtttaaatttaattcactatacatcggcatttcctttatttctgtcggttttcacagacaaatgccgtctgaaacctggaaacggcttcagacggcatctgcacatcatctcttcggaaaaaactgcaccacgttctccccttgcggcagcatcagttttttcacggcgtgtccgtacaccgtttccagcgtaatgcccaaaccgccttcccgctcaaatattgtcccgacacacgaacgcgcggcgttttcatcgttccacgccatcgcccgccaaacgcccagcgtgtccatatccgcccaaaacgtttccgcctttttgtaatccaacaccagcttcgccgtatcggtaacggggtcgtaaaagccgttttcagcaagcatatcgcccaagtcgtgcatatcagggaaaagcgcgctgcggctttcaatgccgttttctttcagacggcatttcagttccgccaaggtatctcgcccgaagcaggtaaaaaacagcagcccgtccgtcttcaaggcgcgcgcccagttgtgcagcacaggaaggatttgttccgccgccaacagtccgagattcgaccacaacatatcggcacacgcttcgggcagcggcgcgatcggggattggcagtgttgcaccacgcccttacccgtaaacctttgccaaaaaccgcctttgcgggcggcagcggcagccgccaaaaaatccgcacgggaatcgtattcttcaaataccgcctgcggatagcgtttcgccagcaggctgcggctgatgtccgcatccgcaccggcaagcaggatatgcttgggcgcgttgcggacgagtgtcagccgttggtcggtatgttcggcaagatggcggtgaacctgccagcgtgcgtcctgatggttcatctcaaacccccttcaacaaagtcgcggtacagcgcggcaaacgcttccgcatggctcaaaaacggcgcatgcgccgccttttccatcacaaccaacctgctgcccttcaaacggcggtgcagatattcacccatacgcggcggcgtaatcgcgtctttgccgccgaacaccagcagtaccggaacatctatcttgtccaacaaatgccgcgcatccgccctttccgccgcgtccaacgcctcctgcaaggcttgaggcgtgccgcagcgcgccaaatcgggcaggattctgcctatgattccgtccgcatcaggcgtgtgcagaagctgtaattgtagaaactgtttgatatgtttggcataatccgaacggaacgcaccgaccattttgcccaatgcaggcgcggcaagcccttcgggatagtcttcgtcagccgtcagccgtgcgaaactcgccgtcaggcagagcgaacggactttgtcgggatggcgcgccgccagatacagcgcgaccaatccgccgagcgaccagccgagaatgtcggccggagcgtcaatttgagcggcaatgccgtcggccgcagccgcaatgtcgaaaggtcggacaaacggagcgtccccgtgtccgggcaaatcgacggcggacaccggccacgttgcaggcaggcgcggcatcaaatcgtcgaacatgtggcggttcgccccccaaccgtgtatcaggtaaacttttttgacggcatcaggcatggattttctctctcgttggcggcgcatcgcagacgcgcccactatcaggcgttgcgtattatgccacggttcgtctggcgtttcagacggcatctgcgccggctgccgcgacgatttggcggcataccgcaccgacgcggcaaacagctgccccctgtgtttcagacacatccaaggcggatcggtgtgcggcggctgtcagaaaaaaccgcccgcattcgaccggatgtgggcttcgctgcattacgaaccgcccgtcagcaatatgatacacgcgctgaagcacttggctgatttgagcatggtgcagccgctggcagacctgatgatgcagaatccgcccgaccggcttgcagacgaatgtttcgatttcgtcctgcccgtaccgctaagcagggagcggctgctgcaacgcgggttcaaccaaagtgaaagcatcgtcgggctgctggcacaacgctacggctggcagatactgccccgacacaccgttttccgacaccaccgcccgccgcaaagcacgctcaaaggcggcgaacggcggcgaaacatcaaaaacgcctttgaaatccgcacaccgataccggaaaactgtaatattctgttaatcgacgatgtctttaccaccggcgcgacgctggacgaattggcaaagacgctgaaaaaatcgggcgcaaaccgaatctgctgctggacgctggcacgcacgccaatgaaaaaataactaaattttttgacaccccatccgccttgtggcaaggttacgcgcctataagtgattgatatttatgtttaccatcgttttataccagccggaaatcccgccgaacacgggcaacatcatccgcctgtgcgccaataccggcgcggatttgcaccttgtcaaaccgctcggcttcccattggattccgccaaaatgaaacgcgccgggctcgactaccacgagttcgccagcctgacggtgcacgaaaacttcgacgactgcctcaaggcactcgcaggcaggcgcattttcgccctgaccaccaaaggcacggcgcgccccgatgaaaccgcgtttcaaaaaggcgacgttttactgttcgggccggaaacgcgcggactgcctgccgacatcctcgacagcctgcccgccgcgcaaaaaatccgcctgccgatgcagcccggcagccggagtatgaacctttccaacaccgtcgccgtgattctctttgaagcgtggcggcaacacggttacgcaggcggcgtttgaacgcaggttcatgccgtctgaaaacctatccggacacattccgaaccgccgtccgcactgtacggcggttcggaacgtatccggcgggcatgatgcccattcgtcttcaactcaagaacggaacacgttttgactttaacccgaaaaacccttttccttctcaccgccgcattcggcacacactcccttcagacggcatccgccgacgcagtggtcaaggcagaaaaactgcacgcctccgccaaccgcagctacaaagtcgccggaaaacgctacacgccgaaaaaccaagtcgccgaattcacgcaaaccggcaacgcctcgtggtacggcggcaggtttcacgggcgcaaaacttccggcggagaacgatacgatatgaacgcctttaccgccgcccacaaaaccctgcccatccccagctatgtgcgcgtaaccaataccaaaaacggcaaaagcgtcatcgtccgcgtcaacgaccgcggccccttccacggcaaccgcatcatcgacgtatccaaagccgccgcgcaaaaattgggctttgtcaaccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaacttcgccgtttcgtcatcgggtacgaacctctcggttgaaaaacgccgttacgaatacgtcgtcaaaatgggaccgtttacctcgcaggaacgcgccgccgaagccgaagctcaggcgcgcggtatggttcgggcggtattgaccgccggctgacggttatttgataccttattaatatccacattttccaacccacgatttacaaaggcaaaatatgaacatcaaacaccttctcttgacctccgccgcaaccgcactgctgagcatttccgcccccgcgctcgcccaccacgacggacacggcgatgacgaccacggacacgccgcacaccaacacaacaaacaagacaaaatcatcagccgcgcccaagccgaaaaagcagcgttggcgcgtgtcggcggcaaaatcaccgacatcgatctcgaacacgacaacggccgtccgcactatgatgtcgaaatcgtcaaaaacggacaggaatacaaagtcgttgtcgatgcccgtaccggccgcgtgatttcctcccgccgcgacgactgaatttgatacaatccgtgccgtctgaagcccaaaccggtttcagacggcattttgcacccgacacttcaggattcggcacacatgatcagcagactgaccggcaaactggttgaaaaaaaccctccgcaaatcgtcatcgatgtcaacggtgtcggctatgaggccgacgtatcgatgcagaccttctacaacctgccgcccgtgggtgaaagcgtacaactgtttacccagcttatcattcgggaagacgcacatcttttatttggttttgccactgcggaagaacgcaagaccttccgccaactgatcaaggtcggcggcatcggcgcgaaaacggctttgggcattttgtcggcaatgactgccgacgaactggcgcgggcggttgcagaagaagatgtcaaacgcctctcctccgccccgggaatcggcaaaaaaaccgccgaacgtatggttttggaactgcgcggcaagctggtcgcgcatacggtaacggacgggctgtttgccgccgcacccgccgccgacgaaacggaagacatcgtcagcacgctgcttgcgctgggttacagcgaacgcgaagcaaaagcggcggtcaaaggcgttccggaggggacggacgtgggcgaaggcgtgcgccttgctttgaaaaacctgctgaaataatgccgcctgaaggcggcgcggcgtttgccctgacgaaaccctgcgtttccgcctcgcgctgtcttcccgacggcttttcccgtaaaatggcgttattgtccttcctttcagacggcattgtgtttgatgccgtctgaaactgttttaccgaaatcgaaaacaatgttgaacaaaatattttcctggttcgagtcccgaatcgacccttatcccgaagccgccccgaaaacgccagaaaaaggcttgtggcggtttgtctggagcagcatggccggcgtgcggaaatggatagccgccctggctgcgctgaccgccggcatcggcattatggaagccctggtttttcaatttatgggcaaaatcgtggagtggctcggcaaatacgcgcccgccgaactgtttgccgaaaaaagttgggaactggcggcaatggcggcgatgatggtattttcggttgcgtgggcgtttgccgcgtccaacgtgcgcctgcaaacccttcagggcgtgttccccatgcgcctgcgctggaacttccaccgcctgatgctgaaccaaagcctcggtttttatcaggacgaatttgccggacgcgtgtccgccaaagtcatgcagaccgcgctggcgttgcgcgacgcggtgatgacggttgccgatatggtcgtttatgtgtcggtgtatttcattacctccggcgtgattctcgcctcgctcgactcatggctgctgctgccctttatcggctggattgtcggtttcgcttcggtgatgcgcctgctgattcccaaattggggcaaaccgccgcatggcaggcggatgcccgctcgctgatgaccggccgcattaccgatgcctattccaatatcgccaccgtcaaactcttctcccacggcgcgcgtgaagccgcctatgccaagcagtcgatggaagaatttatggttacggtgcgcgcccaaatgcggctggcgacgctgctgcattcgtgcagcttcatcgtcaacacctccctgaccctctccaccgccgcactgggcatctggctctggcacaacgggcaggtcggcgtgggcgcggttgctacagccaccgccatggcgttgcgcgtcaacggtttgtcgcaatacattatgtgggaatccgcgcggctgtttgaaaacatcggcaccgtcggcgacggcatggcaaccctgtccaaaccgcacaccatcctcgacaagccccgggcactgccgctgaacgtgccgcaaggcgcaatcaaatttgaacacgtcgatttctcctacgaagcgggcaaaccgctgctcaacggcttcaacctcaccatccgcccgggcgaaaaagtcggcttgatcggacgcagcggcgcgggcaaatccaccatcgtcaacctgcttttgcgcttctacgaaccgcaaagcggcacggtttcgatcgacgggcaggacataagcggcgttacccaagaatctttacgcgcccaaatcggtttggtcacgcaagatacctcgctgctgcaccgttccgtgcgcgacaacattatttacggccgccccgacgcgaccgatgccgaaatggtttctgccgccgaacgcgccgaagccgccggcttcatccccgacctttccgatgccaaagggcggcgcggctacgacgcacacgtcggcgaacgcggcgtgaaactctccggcgggcaacgccagcgcatcgccatcgcccgcgtgatgctcaaagacgcaccgattcttcttttggacgaagccaccagcgcgctcgattccgaagtcgaagccgccatccaagaaagcctcgacaaaatgatggacggcaaaaccgtcatcgccatcgcccaccgcctctccaccatcgccgcaatggacaggctcgtcgtcctcgacaaaggccgcatcatcgaagaaggcacacacgccgaactcctcgaaaaacgcgggctttacgccaaactctgggcgcaccagagcggcggcttcctcaacgaacacgtcgagtggcagcacgactgaaccgatgccgtccgaacacccgttttcagacggcattcccacacccaaccccaaagaaaccatgaacgacaccgcccaaattaccgccagctacggccgccgctacattgtccgcacgcccgacggcacaacctacgaagccagcacccgcaaaaaacgcgtcgatttcgcctgcggcgaccgcgtccgcatcagccccgtcaacgccgaacaagttgtgattgaagattttttaccgcgccaaagcctgctctaccgccaagacgcgtggaaaaccaaactcatcgccgccaacgttacccaactcctcatcgtaaccgccgccgtcccgagtccgagcgtgcggctgctgcaacgcgccctgcttgccgccgaagccgccggtattgaagccgtcatcgtcctgaacaaagccgacctgcccgaaaccgccctttggcgcgaaaaactcaaattctacgaaacgctgggttatcccgtcatcgaaacccgcgcactggaaaacgccggcagcctgcgccccgccctgcaagggcacagcaacatcctgctcgggcagagcggtatgggcaaatccaccctgaccaacgcccttttgggcagccaaaccgcccgcaccggcgacatttccgccgcactcgactcgggaaaacacaccaccacccacgcccggctttatgatttgaacggcgaaacccaactcatcgactccccgggtttgcaagaatttggtttacaccacctccaagccgccgatttgccgcgctatttccccgatttccgccaccttgtcgggcaatgccgcttccacaactgcacccaccgcgccgaacccggctgcgccttcaaagccgccgcgcaaaccggggcggcaagccccgaacgcctcgcctttttgcagggcatcaccgacgaactgcccgggtaacgccttgccgcctgggcggaaaaaatgccgtctgaagccggattcgggtttcagacggcatccgtttttcaaaaatgctacaatccgctttttaccggaacatccgaaactatgttccaacacacaggacggcacataaagcaccgccctatgtattgccctgatttggaaagggttacacccctcccaaataaagtctgatcctgccgccctaaagggcggggtttcaaccgaaaaggaaatacgatgaagaaaaacgccccgaaatcgtttgaagaagccttgtcgcgcctcgaatcgctgacgcagtctatgcagggcgaaatgcccttggaagacgcgcttgccgcctatcaggaaggcaacgaactggtcaggtactgccaaaccaaactggcacaagtcgaacaaaagctacaggttttagacacagacgggctgaaggagttaaaccttgaatccgacgaatgatttgaaaacgtggcaacagagggcgcaggcgcaaacagagctgctgcttgaacggtttttaccgtctgagggggaaataccgcacacactgcacgaagcgatgcgttatgcggctttggacggcggtaagcgtctgcggccgatgctggttctggcagcttcggaattaggcgaagccgtgcatgaagcagtagaacaggcaatggcggcaatcgaaatgatccacgtctattctttggttcacgacgatatgccggcgatggacaacgacagcctgcggcgcggcaaaccgacttgccacatcaaatatggcgaagcgaccgcccttctgaccggcgacgctttgcagacacaggcatttgacgtgttgagccgtccgacagaactgcccgccgcacgccagttggcaatgttgtcggtgttggcgaaagcgggcggcagcaggggtatggcgggcggtcaggcaatcgatttggcgaatgtcggcaaacaaatggttcaagccgatttggaacagatgcacagcctgaaaacgggtgcgctaatccgtgcggcggttttattgggggcgacggcgtgtcctgatctgtcagatgcggaactttccgtattggacgcttacgcggcaaaactggggctggcgttccaagtcattgacgatgtgttggattgtgaagcggacacggcgactttgggcaaaacggcgggcaaagacgcagacaacgacaagccgacttatgtgaaactgatgggcttggaagcggcgcgctcatacgcacacaaactggttgccgaagcggtcgcgctgctcgaacccttcggcgacaaagccctgcgcctgcggcagttggcagaatttgcagtcgcccgcaaatattaaaaccggcgtatatcgccggctgaaacgtgccggcacagcgatgccggcctgcacttgaatgaaacaaatgccgtctgaaagggtttcagacggcattcctatgcttgtctattccctgttgcgcgtgtgccaaaaataccgccacacaaaacatggaaacgcaaaaatcaggtacaggcagacgactgtggcataaaactcccaaccctgatcgtgtaccgatcctgcacgggattcgaggatgtaggcaagaacggcggtcagcgcgaaacctgccgccagctcgatcatgtggtgtccgaaatgtttgcgcttgagtgcggccacgccgaacagtctggtcgtgaggaagggggcgttggcaaagatgagtgccaagaccaaaaggatgtacatggatgcggtcatggtgggctttctgtttaggcgttgtcggcggcgatgccgtctgaaccgcgttgcggaacggcatatcttaacaaaaacggcagcctctgacacggctgccgttgcggcggcttacagcgtgttctccaacgccttggcgcaccagtcgataacggtttgcggcatgatgccccacaggagcagcaagaaggcattgaccgtcagaacaaatttggcggcatagttgctgccgaccggctggtcatgatcaggcacatcgaagtagatgactttgaccacgcgcaggtagtagaacgcaccaatcagcgacatgatgacggcaaatacagacaaccaaacatggccttgtttcaagagtgccataatcacgccgaatttggcgtaaaaacccatcagcggcggaatgcccgccatagagaacataaccagcagcatcaaaaaggcaagccatacgcggtgttggttcaaccctgccaaatcgctgatgttttcgcactcgttgtccccgtccgacaacaccatcaacactccgaaccctgccgccgccatcagcgcgtaggtaatggcgtaatagaggcccgccgcaaagccgaccgcgcccgccataaacgccaacaggatgaaacccatatgcgatacggtggaataggcgaacatacgtttgatattggtctgcatgatggcggcaaggttgccgaccagcagcgaggcggcggcaagcagggcaaacatcagagaccagtcatgatgcacggttcccagcccggtaacgaggatgcggaaagtgaaaacgacggcggcgattttcggggcagtgccgaccaaggcggtaacagaagtgggcgcgccgtgatacacgtcgggcacccacatatggaacggcaccgcaccgagtttgaacgcgacggcgacgacgataaacaccaaacccagtttcaacagccattcgttggcttcttcattgaaggaagaggcgagcacgccggcaaattccagcgaaccggttgcgccgtaaaccatagaaataccgtagagcagcaggccggatgccagcgcgcccaaaacaaaatatttcaaggcggcttcggcggcaaagccggaatcgcggcgcagggcaatcagggcgtaaagggcaagcgacaagagttccaaaccgatataggcagttaaaaaatgccccgcgctcaccatcacactcatacccaacagggcaaacaatgacagggtgtaaaactcgcctttaaaaataccgcgcacttggttgtagggcttggcatagacaaacagggcaaaggtcaaggcatataaaaccatttttgccaaacgcgacataccgtctgcaatatacatcccgttgaacgaagacgtgctgccctgttcccacaccgccaactgcaccacagccgtaaccgccaccgttgccaacgcgccgtaatgcgtccacgggcgtttgtcatcactgacccacaagtccgccagcaacaataacaccagcagcgacagcagcacgatttcgggcatggcgggcattaaattcaaatcagaccagttcatttacacacctcaaatcttgctttgtgccacatgggcaatcaaatcgtttgccgcctgatgcaccacttcgataaatgcgttcggatacaggcccatacccaaaacagccaccgccaaaattgccaaaatcgcaaattcgcggcaattgatgtcttgcatttcggcaacgtgcggattgtggatcgcaccaaaaataacgcgtttgtacatccacagggtataagatgcaccgtaaatcagggtcatggcggccaacgcgccgacccagaaattcactttgaccgcgcccataatcaccataaactcgcccacgaagccggaagtcgcaggcaaacccgcgttcgccataccgaacagcatcataaacgccgcaaacttgggcatcacattgaccacgccgccataatcagcaatattgcgcgtgtgcaggcggtcgtacatcacgccgatacacataaacatcgcggcagacacgaaaccgtgcgaaatcatttgaatgattgcacctttcaatgcccagtcgtccaactgcccgtcaacaaacaaaaacatcccaagcgttacaaaacccatatggctgatggacgaatacgccaccagttttttcatatcggtttgcaccaaagccaccataccgatataaatcacggcaatcagacttaatacgatgatcacgggggcaaaatagcgtgccgcatccggcataatcggcaggataaagcgcaagaaaccatacgcacccagtttcagcgtaatggccgccaacaccatcgaaccgccggtcggcgcttcaacgtgggcatccggcaaccaagtgtgcacagggaacatcggcacttttacggcaaatgacaggaagaacgccacaaacaaaagctgttgtacgcccaacggaatctgttcgatgttttggaaatcgacaatagagaagctgcctgtttgataataaaggtaaaccatcgcaaccagcatcaggagcgaacccatcagcgtgtagaggaagagcttgaccgacgcatagacgcggcgcggaccgccccatacaccgataatcaggtacagcggaatcagcataccctcgaagaacacataaaacagaatcgcatcctgcgcggcaaacgcgccgttaatcaaacccgacatgatcaggaatgccgccatatactgcgccggacgtttctgaatgacttcccaacctgccaataccaccaacagcgtaataaacgcattcaagatgataaagagcactgaaataccgtccacgcccaatgcgtagttgattttcagaagcggaatccactcgtggaactcggtaaattgatagccgccgctcaaacggtcgaaaccggtaaacaggggcagtgttaccaagaaaccggcaagcgcacccatgaaggcgagcacgcgggcaaacggcgcacggctgtccgaccccgttgccaaaaccagcacgcctgcggcgatgggtatccatattgccaagctgagtaggtagttggaaaacatagtggttaacctgtggttaaaataaaaatgtgtttatgtggatatttcttcgtttcagacggcctgaaggtttaaggccgtctgaaaccttattcttatcggaacaatccccagaaggtcatgccgagcaagaccaatacgccgaacaccatagcggcggcgtaggtgtagataaagccggtttgggctttacgcacttgcgcggcaatcgcgccgaccagtttggcagagccgttgacaataccgttgtcaataatggcggtatcgccgactttccagaagaaagtgcccaatgcgcgtgtgcctttggcgaaaacgttgaaatacagggcgtcgaggtagtatttgttttcaaacaaaacgtaaatcggacggaacgtctgtgcaattttcgctggcaggtgcggcagtttgacgtacaaaagccatgcgctcaacacgcctgcgatagcaaggtagagtacgggcgaatgcaggctgtgggacaccattgccaatgcgccgtggaactcttccttcatgatgtgtatagtcggatgcgcgtcggcgttgacgaaaatcacgtctttgaagaaatcgccgtagagcatgggttcgatggcgatgtagccgatgatgacggacggaacggcaagcaaaatcaaaggcagggtaaccaccaacgggctttcgtgcggattgtcgtttttacccaaaccgtgatgttcttcgccgtggccgtctgaatggtgttcgggcaggctgcgccatttctcttcgccgtggaacaccataaagtattggcggaacgcgtaaaacgcggtaacaaacacgctggcgaggacggcaaaataggcaaagccgctgcccggcagtgtgctgtatttcgccgcttcgataatcgaatctttggagtagaagccggagaagaacggcgtaccaatcagcgacaagttaccgatcagcatggtcagccaagtaaccggcatatattttttcagattgcccatatggcgcatgtcttggtcgtggtgcataccgataatcgcgctgcctgccgccaagaacaacagggctttaaagaaggcgtgggtcatcacatggaacatcgccacggaataggcagacgcgcccagagccacggtcatgtagcccaattgcgacagggtggaatacgcaactacacgtttgatgtcgttttgaatcacgcccaaaaagcccataaacagggcggtaatcgcgccgatcaccataatgaccgacagcgcggtgctgctcatttcataaatcggcgacatacgcgacaccataaacaaaccggcggtaaccatggttgcggcgtgaatcaatgcagaaatcggggtcgggccttccatcgaatcaggcagccagacgtgcagcgggaattgtgccgatttacccatcgcaccgacaaacaggagcaaacaggttacagtaatcaaagaccattccacaccggggaacagttggatagtggcattttgcacgttgggcagataagcgaatacatcttgatagcgcaagctgccgccgaaataggcaagcaccaagccgataccgagcaaaaagccgaagtcgccgacacggttgatcaaaaaggctttcaggttggcaaatgtcgcgctcgggcgtttgaaatagaaaccgatcaagagatacgacaccaagcccaccgcttcccaaccgaagaagagctgaatgaagttgttgctcataatcagcatcaacatactgaatgtaaacaaagaaatatagctgaagaagcgttggtagccgactttttcatcgtgcatatagccgatggtatagatatgcaccatcaacgacacgcccgttaccacgaccatcatcatcgccgtcatcgtatcgaccaagaagccgacggagaaatccaagccgcccattgtcagccaggtatagacattctcgtcaaacttggcgcggctgccgtcaataaagccccacagcacataagccgacagcacggcggacaccgccacgccgagtatcgtaaccgtatgcgcaccggcacgtccgattttgttgccgaacaaacccgcaatcagcgagcctgccaacggaacaagggcaattatcaaatataaagtcatatcgttcatttgattgaatccgattgatttaaaaatctatgtttgtttcgtacaaaattacttcggaaaaacaaatccaacacgctccaatcgtttgcgtgccacagctaattgctcttcagtaaataaatcacaccacggcttttgtaacaccagatattccatactgtatttcaaggcgtggactccgccaccactcaaaatcagctctgtaaaaccggtctgagtcttcttttcccccgtactcaataatttatccgccgcctctttaccaccaaattcatttacaatttgtaaaaatcgtgtcgccttgtaaggttgcggcaaattcaaagcctcctgataaatatttaacatggctttatgaaattcttgttctaactgatttttatccatcattcttcttccaatatttcagaccggattattcttacccagaatttcttttctcatccgctcccgtctgatcacctaccgaatcaggtcgtctgaaacagtctgaaatcgcttttcagacgaccctcagcctttttcatacccttcgtaataatacgactgctcgatacctttaaagatgatttcacggttgtccacatcgtcagtcaggttgtcctttaacagaaagcgcagttctaaatcgttgacggggctgcgttccatcgcctgcaaatacagggttttacttacattttgccagttcacgacttttttcaggttttttttcagcaccaaatccagccagatgcgggtacttctgccattaccctccaaaaacggatgggcaatgttcatttcaacatatttggcgatgatttcttcaaaagtccgctcgggcatctgctcgattttaaccaaagcctcttttaaatacatggcgttggcaaaacgaaaaccgcctttggaaatgttgtcttccctgatttgacccgcaaaatcatataagccgccgaacaggtaacggtgaatctgttgcaggcccgcggtggtaccgacttcgatacggtcgatgtcgccgctttcaaacaggcggcgggcattatgcaggctttgttcgtctatggatttcatcgtttttcctatcgggttttcagacggcatcggtgtcttgtcaggtctcgacccaacctacctttaccctttcaactcgtccaaatcggcaacgttgattgtttgtcggttgcggtacaccagcaccataatcgccaaaccgatggcagattcggcagcggcaacggtcaatacgaagaatacgaaaatttgtccggcagtatcgcccaaatgttgcgagaaggcgataaagttgaagttcaccgccaaaagcatcagctcgatcgacatcagcaataccagcacgtttttgcggttcataaagatacccattgcgctgataccgaacaggagcgcacccaataccaaataatgcgtcaaggtaatcatgctttgccctcctctttcggcttgaggtcgtctgaaacttcgctttcttcggcagattcgacttgcggtttgaccgcttccattttcaccagacgcatacggccctggtcggcgcgtactttgacttggtcggcaggatccatgcgtttcggattaaccgttttacggtgaaccagcgcaatcgccgccaccatacccaacaacagcaataccgccgccaattcaaacggcaacagatagtcggtataaatacggctgcccaaatcgcggatattgttgtaatcggcaggaatgtctttcatcagaccaaatgcggcaaggtcggttttcgggttgaccagaatcaggatcagcgcaaccgccaacaatgtgccgaccacaccggcaacaggcgcgtgccgccagaaaccggcacgcatttcttcaatgtcgatgttcaacatcatcacgacgaacaggaacaacaccatcacggcgccgacgtaaaccaccaccagcgtcacgcccaaaaactcagcctgcatcagcatccaaagcatcgcgctcacgcagaaggtcagcaccagatgcaaagcggcgtgaacagggtttttagcggtgacggttttgagcgcgccataaagaattatcactgcaaaaatataaaataaaatcagttggaaagtcatagtctatgctttctttattaatcaaaaatatggtttcaagcagtctgaaaatcctggttacgcaaacaatcaaacttaatcagttgatccatatccgcacaaatccacgttgtcgcaattttgaataacaacatttctatgtgatacggttttgcttgtttaccataaacttgtttcgccaaatcttgtaacaacccacaatattgatgaaacgaaacgtctggtttccgataattcggtttgatatcagaaaaatgaaacaatacgttcatatttcggatttctagttccctatttctaccttgtggctgaaaaaacaaatctgcatttgtaaatttaaacaacaaccaattcaacgaaaaaatagcgcgtgaatcataaatggcgaatcgctcacaatctataaaagaagccaatttagataatgatgaaattttcaacaaaccactactcaattttcccgaattaagttccgataaaaattgacgaataagctggctattttcagcagattgtttaaaacttttaatcccaccccattcacggataatccaataatgcgtcttcaagctatcatcattttgtaattttggggataaattttcttttaaaaaaatattttgttcaaaattacttaatccacttggcaactcaatcggactatttctagttctaatttcttcaaaattatctattggctcatgttcggctaaatatttcaatgcattaatcagtccttccatatttaaaaccttccaagaagccccaaagcattaacgatacggcgcgtcagcggctttgcgtttggcgatttcagcttcgtatttgtcgccaatggccaaaagaatcggcttggtcatgtgcaagtcgccttttttctcgccgtggtattcaaaaatatgggtttccacaatcgcatcagtcgggcatgcctcttcgcagaaaccgcagaagatgcacttggtcaggtcgatgtcgtaacgcttggtgcggcgcgtaccgtcttcacgttcttccgattcgatgttaatcgccattgccggacacactgcctcacacaacttacacgcgatacaccgctcttcgccgttcggataccgccgctgcgcgtgcagaccgcggaaacgcacggattgcggcgttttctcttcggggaaataaattgtgtctttgcgggcgaaaaagtttttgagcgttacgcccataccttttaccaattcgccaagcagaaaggtttttactaagttagccatattatgttccctcaaaacagggatttcgttaggtattcaaaatcgctttgttcagacggcctcaagatgccgtctgaaacttatttccacaaattcagcggtgaaatcatccacacgcccaaaatcacgatgtaggcgaagccgatcggaatcagcactttccagcccaagcgcatgatttggtcgtaacggtagcgtgggaaggtggcgcgtatccacagataccagtacagaaccgccgccattttcgcgaacatccaaaatgcggaaggcgtaccgacaatgccccagctttgcgggaagggagacagccagccgccgaggaacatcaacgatgtcagcgcggcaatcagaatcatgaaaatgtattcggcaaggaagaacagcgcgaatgcgaagccggaatattcgacgtggtgaccggcaacgatttcagactcgccctctgccacgtcaaacggtgcgcggttggtttcggcaacggcggaaatcagatagacgatgaagatggggaagagcggcagccagttccaagagaataccgaaccgcctgcgatgccttttgcctgcgcggcaacgatgtcggagaagttcatgctgcccgacaccatcacgacgcacaccagcgcggcactcatggcgatttcgtaggaaatgctttgcgcggaagcacgcattgcgcccaagaacgaatatttggagttggaagcccagcccgcgatgatcacgccgtaaaccgacagcgaggtaatcatcaggatgtacaaaagaccgatattgatgttggtcagcacccattcttcattgaacggaatcactgcccacgccgcgaaagacggggcaagcgacataatcgggccgatatagaacagggctttgtttgacagcttcggacgggttacttctttaaacaagagtttgaacacgtcggcaaacggctgaatcagaccccacgggccggttacgttcggaccgacgcgaagctgcatgaagccgatgactttacgttcgaaataagtcaggtaggcgacggtcagaatcagcggaatcaggataatcacaattttgacgatgacggataccaccaagcctacagtaatacccaaatcgcccagaccgagcgttgcggcaaagaggttttggaaccattcctgcataatcaagctcccgccagttcaatagtgtccatcaacgcacccagcgcggcattttcggtatgcagcggcagatgcaccacgttttcaggcagtccggcatcggctttgacggcaaccgatacgcttgcgccgttttgtttggcgacagcggtttgtccgtcttgcaggcccaagcgtgccaatgtatttggatttacacgcgcagcaggcacggcggcatggctggtttcttgcaacggtgcggaacggcgcacgatagaatcggtgtgataaataccgacgccgccgacacggacgaggcggtctgaggtcgtctgaacgccctcccctgtccatgcgttgcggttgtccagtttggacggcaggctttccacatccagcgcgtctttcaaaatcgcagcggtatcgtggtattcaaaacctttcaggtcaaacaggttgcccaatacgcgcaacactttccacagcggacgcgaatcgccgaagccttgtaccacgccgtggaaggattgcagacggccttccatattgatgaagctgcctgaggtttcggtaaacggtgcaatcggcaacaacacgtcgcacacgtccagcagcgtttcgctgacaaacggcgtaaacgccatcacgctttttgcctgtttcaacgcggctacggcttttgcaccgtccgccgtatcgatttcaggctcaacgttgagcagcaagactgcctgtttcggcgcgtttaccatttcgacaacgctcttgccggagtttacattcaagacatccgcaccaacgctgttggcggcttgcggcaaaatgcccagcactgcgccggtcgcgtcagccagctcttgcgcggcggcgtaaaccgcggcgtaatcaggatggttttgcacttccgcgcccaaaatcaccgctgctttttcagcatttttcaggctggcggtaacggcgtgttccgcattgacagacaggtttttcagacggcctgcccactcgtcgggatgtgcggcttcttgagacagaagcggcataaacaattcttctttactgctggccaatacgctcaatgccatacggtctttggcggcgcggcgcaggcgggcagtcaggagcggctgttctttgcgcaagttcgcaccgactaccaatacggcatcgttgtcagccaaagattcaatgctttgtcccaaccattgcgcacctttaaggccgtctgaaagacgtttgtcttgttggcgcaaacgggttgcaaagtttttaacacccaagccgtcggcgagtttcttcgccagatacagttcttcaaccgtattcatcgggttcgcccaaacgccgacttggttttgcttgccgtctttggcgatacattcaatcgcgctgcggacatattccaacgcggttttccaatccacgtccatccactcgccgccctgtttgattttcgggtttttcagacggctttcgtgatacaggccttcgtaggcgaaacggtcgcggtcagacagccagcattcgttaatcgcttcgttttccaacggcaacacgcggcggacggtatggtctttggtctgcacaatcaggttgctgcccaaagcatcgtgggcggaaacggatttgcggcggttcaattcccaagtacgcgcgttgaagcggaacggtttgctggtcagcgcgccgacgggacacaaatcaatgacgttgcccgacaattcggtttccaccgttttgccgataaagggcatgatttcggagtgttcgccgcgattcaccatcgcaatttcctgcaaaccggcgatttcttcagtgaaacgaacgcagcgggtgcagtggatacagcggctcatttcctcggcggaaaccaaggaccccatatctttgccgacgacggaacgtttttcttcggtgtagcggctggtggttttgccgtagcccaccgccaaatcctgcaactggcattcgccgccttggtcgcaggtcggacaatcaagcggatggttgatgagcaggaactccatcacgccttcctgcgcctctcgggcttttgccgaatgcgtacgcacaatcatgccgtctgtaaccggcgtggcacaggcaggcaggggttttggggctttttctacgttcaccagacacatacggcagttggcggcgatggaaagttttttgtggtaacagaaatgcggaatataagtaccgagcttgtgcgcggcttcaatcaccgtcgcgccctgctccacagatacttgtttgccgtcgatttcgatttgtaacatggttcgttcctagttacgggtatttgataaataatcttttatggaggtcgtctgaaaaatgggtttcagacggccttttgagtttcattgacaatcaatactgtttaaaacgtttactgccaccttgccgtcattcccgcacaggcgtgaatccattcttgggttttcggtaactgttttcaaacattggtttcttaacttttgcggtgattcccgccgtagcctgtctgcgcgtaggtggggctggaataacgacagtttttaaagttccagaaataaaactaaacaaacaacacgcccgacaagtccaatcattcagtattttgttcttcaatcagtttaatcttccattcacgtcgccattttttcatcgttttttctttggcaactgcttcaggcatattctcaaaaaactgataccaaactaaatcatgcacatcatatcgggcagtaaagccatcaatattgacatggtttttgtgctgccaaaccctttccggcaaattcatggtaacaccgatatagagtgttccatttttaccgtttgccaaaatatatacggcaggttgtctagtaagcggatggtttcgtattcatttttcctgcaatataaacaacaacttttttaatatcatttacaaccgttttcatctgaaaacatctgcctactcccgccgtcattcccgcgtaggcgggaatccattttttgaatttcggcaactgcttttcaaatatcgggttctgtaaattccactatggattcccgcctacgcgggaatgacggcaaagttaaatttttagcattttgcttttaaccaatataaaaccaactaaaactataactcatttattatatttttaaatgacttaaataactctttaacagcacgctcattgtcttcatctgtaggctcaaacttttcacaccaattaattatatttacatcgccatgcaataactctgcataacatcctactgcatcgcaactaccaccccgtgtccttgacgtgccaaaaataaaatcacaattatgcgaataaagtttgtataaatttcccctaacctcgtattcattatcaccagatgaataaaaaccaattctctgaccttcatgatcaaatactgcaacaaaatctaagccgtttccatgtctttcaaaaaagactagaaatttagaaaatttccgacaaatctgattaaaaagcgtattgagtgtcgtactcttacctttgttggctgcaccgtatagaataaaaattttagcttccaccattaccaccctccccacttatgctctttcatcggcccgccgtgttcgatgtaatgcacaaactcatcacggaaatgcttggtaaagctgcggacggggaagacggcagcatcggcgagggcgcagatggtgcggcctgccatttggttgccgacggaatccagcaaatccaaatcttccattttacctttgccttctacgatgcggtggacgatgcggtaaagccagcccgtaccttctcggcagggggtacattggccgcaagactcgtcgtagtagaagtagctcaaacgctcaagggctttgaccatgcacacgtcttcgtccatgacgataatcgcgccggaaccgagcatggagcctgctttggagatcgagtcgtagtccatattggtctgcatcatgatgtcggcaggcaatacgggcgcggacgaaccgccgggaatgacggctttgagttttttaccgccgcgcataccgcccgccattttcaagacttcggcaaacggcgtacccaatggcacttcatagttgcccggacgctcgacatggccggaaatacagaataatttggtaccgcctgcattcggaatacctttatcggcaaatgcctgtccaccgtcacggataatgaatggaacggaggagaacgtttcagtattgttgatggtagtcggtttgccgtacaggccgaacgaagcagggaatggcggcttaaagcgcggctggccttttttgccttccagcgattcgagcaatgcggtttcctcgccgcaaatatatgcgccgtagccgtggtgggcgaagagttcaaattcaaaatccgaacccaaaatatttttacccaaaaagcctgcggcacgcgcctgctccaaagcggcctcaaagcgttggtagccttcaaaaatttcgccgtggatatagttgtaaccggctttcgcgcccatcgcgtaaccggcgataatcatgccttcgatcagggcatgcggattgaacatgatgatgtcgcggtctttaaacgtacctggttcgccttcgtcggtgttgcaaaccacatatttttcgcccgggaaagaacggggcataaagctccatttcaaaccggtcgggaagcccgcaccgccgcgcccgcgcaaaccggaggttttgacttcgtcaatcacatcggtttgcgagatgttttcggacagaattttacgcagggcggtatagccgccgcgtttgacgtattcgtccaatgtccagcaatcgggattggcggtatccacttggtcaaaaatcacgcctgattggtaaatagccatttttggtgtgcctgtttgttttcgtatcggttgcggccgctgtttcagacgaccttaagatgtctttgtgtaccggcttgtaacgtcgtctgaaataaaatctagtttatcaaatcgatattttcagacgacctttaatcgtttttgttggatctcgaccacttgcttgtctgtcgtcattcccgcgcaggcgggaatccatcctcaatggtaagcaatgtcttattaaattcagaaaccgaatcttaccggtggattcccgcctgcgcgggaatgacggcatttcggtatttcagtagggcggattcttaaatccgacattttgcctttttacccactctgtcggctacaagtatccgacctacgtttaaatcgtcgtttcagacgacctactccaactccgccagtttcttctcaatcgcttcttcggtcataaagctgcacatgctgtggttgttgaccagcataacgggagcgtcgccgcatgcgcccatgcattcgccttcgacaagggtaaacttgccgtcaggggtagtttcgccgtagccgataccgagtttttgtttgaggtattcgccggtagccataccgccgcgcagggcgcagggcaggttggtacaaacggtcagtttgtatttgccgacaggctcaaggtcgtacatattgtagaaagtggcgacttcgtaggcttgtgcaggcgtgatgccgatgtagtcggcgacaaaagcgatggtctcgggagcaagccagcctttttcggtttgggcaatacgcaatgcgcccataatcgcggagcggcgttggtcggcaggatattttgccaactcgatgtcgatttgttttaaagattctgcggataacattatcggtcaacctccccgaatacgatgtcctgcgtaccgatgatggcaacgacgtcggcgagcatgtggccttttgccatttcgtccatgccttgcagatgggcgaagccgggtgcgcggattttcaggcggtagggtttgtttgcgccgtctgaaatgatgtaaacgccgaactcgcctttcggatgttcgacagcggtgtaggtctcgccctcgggaacgtgcataccctcggtaaagagtttgaaatggtgaatcaggtcttccatacctgttttcatttcggtacgtttgggcggagcgaatttgtggtttgtggtaatgaccggacccggattgacacgcaaccactcggaacattgtttgatgatgcgtacggattgacgcatttcttccatacggcagaggtagcggtcgtagcagtcgccgttcacgccgacagggatgtcgaaatccattttgtcgtacacttcgtaaggctgtgtcttacgcacgtcccattccacgcccgaaccgcgcaacatcacgccggtaaagcctttttgcatggcacgttcgggggagacgacgccgatgccgacggtacgctgtttccaaatacggttgtcggtcaggagggtttcgagtgtgtcgatatttttggggaagcgttcgcagaaggcatcgataaagtcgagcatggtgccttcgcgggattcgttgagctgcttcaatactttggcattgcggaatttgctgccctcgtatttgggcataaagtcgggcaggtcgcggtaaacgccgccgggacggaagtaggcggcgtgcatacgcgcgccggacacggcttcgtacaagtccatcagctcttcgcggtcgcggaaggcgtaaagaatggcggtcatcgcgccgatgtcgaaggcatgcgaaccgatgcccatcaagtgattgaggatgcgcgttacttcggcaaacatcacgcggatgtattgggcgcggatgggcacatcgataccgacaagtttttctactgccaaacaatacgcctgctcattgaccatcatggaaacatagtccaagcggtccatatagggcagggcttgcagataggttttggtttccgccagtttttcggtacctcggtgcaagaggccgatatgcgggtcggcacggacgatttgttcgccgtccagctccaaaatcatacgcaatacgccgtgcgccgcagggtgttgcgggccgaagttgatggtgtagtttcttaatttattggccaccgtagttctcctcacggacgatacgcggcgtgatctcgcgcggctcaatggtaacaggttggtaaatcacgcgtttttgctcttcgtcgtaacgcatttccacatagccggaaatcgggaagtctttgcggaacggatgtccgacgaagccgtaatcggtcaggatgcggcgcaagtccggatggttgttgaacatgatgccgtacatatcgaaggcttcgcgttcgtaccaatccgcgctgttgtaaatatcgactacagattcgactacggggaagtcgtcgtctgaaacccagacgcgcacgcggatgcgttgattgtttttaacggaaagcaactgactgacgacggcaaagcgtttgccctgccatgcttcgtttttgtaagtgctgtaatcgacaccgcacaagtcaaccagaagctcgaaatgcaactcttcatggtcacgcaatgcggtcatgactgaaatatagtgctcgggcagacactcgacggtaatctcgcccaaagcggaaatgactttgcctgcctgattgcccaaaacgcggctgacggtttcgtataagtcttgaatgcttgccatatcgtcctctccttactcgtcacgcgcaatggtggaagtgcgcttgattttttgttggagctgaatcaggccgtaaatcagggcttccgcagtcggcggacaacccggcacataaacatctaccggcacgacgcggtcggcaccgcgcacaacggaataagaatagtgataatagccgccgccgttggcacatgagcccatagacaatacccagcgcggctcggcgagctggtcgtacactcggcgcagggcgggcgccattttattggtgagcgtacccgccacaatcatcaggtcggcctgacggggggacggacggaaaataataccgaaacggtcaaggtcgtaacgcgccatacccgcgtgcatcatttccacggcgcagcaggccaagccgaaagtaaccggccacaacgaaccggtacgcatatagttcagcaccgtatccgcgctggtggtgatgaaaccttttttcaaaacgccttctattcccattccagcgcaccttttttccattcgtaaacaaagcctaccgtcagaacaacgataaacaccagcatagaccagaagccgtacgcgcccaaatctttgaacacgactgcccacggcagcataaacgcgacctccaaatcaaacaggatgaagaggatggcgacgaggtaatagcgcacgtcgaacttcatcctggcgttttcaaaagcttcaaaaccgcattcgtaaggcgcgtctttttcggcatagtggcgtttcgggcctaaaatcgtgccgagcaggataaacagcacgccggccgcgaggccgatgaggataaagacaaagacgggaaagtaagcggacaacatggttacacccaaatccgttaacaaaatttctacaataatttcgtattttagcgaatttcaaaaaccattaaaaggtaaatatcggcaaaacgcccaaaaaaacccaataaatacaatcatgttatgataacgattcttatttgattttataaggtcatataaatttttacaccgtaattcgtggtatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttttgttaatccactatatataggaataagaattcgggacaaaatgtttaaaccattttgtcccgactgctgtgatgcggtttttttgaactagcaggacgttacctaaaacctgcgttgcctgaaaccctttaagacggttaaatccctctgccgtatttgtattctacaatcatattatcgtcggtaataacttccgccccagccgaaggttccgtcatctgaatcagcatacgagagacaaccttttgtgctgcagcatccacggtgctgctgtcaaatacgtgcctgccgctttccggccaaatcaaccgggagagacgttgcttgagcagttctttattagggaaaactaccggggttgccgagccgactaccatatgcccatagcggtatgcatagggaatactgtgtacggcggtagcaaaagcatgcgggctgtgcgtggtattaaacattacaataccatccggggtaaggtggctttgcacctgttttaaaaattccgcactcaacaggttggtggaataggcacgccagtaccaagtcgtattcatcaaaatcaggtcgaatttttcatcaggatggcgacgcagccatttcctaccgtcatccaatacaatttcaacacgtttgtcctgcaaaagcggggcgatttgcggctcgtccgcgataaggctacggtatgccggattgatttccgcaacgatcatcgactgcatttccggaatggcagacaagacgcgcgcccacgaacctgtactcagtccaacgacgaaaatgcggcgtatgccagacttcagggagggtagcagataggcacgttcgatgccgttgacactattgaatacatcggtattgtatgcgccgtcgtatacattcgccccataaacaaccttatcaccatctctatggtaaaccgcaacaatgccgtgtttgttttcaatcagcctatccggacggtcagcaatattttgaaagacagaatccggcagtaggaacatgaggatgccgaacattagggaaactgctaccgacactgcattcagtcggagacttttttggaacagtgtacaaaacaaagggacagcagcagaaatcaaacagatgagcaggtaaatctgttgggtggacaagaaatcaagtatcacaaagccgataaggaccggacccaatgcactgccggcaacgttggcgaaataaacattggaaacctgtcgtccggatttgttgccatccgtacccacatggtgtacgagcgggaaaatcaaccctctgacgacggcagacagggtaatgaagataccggcgtggtggacgaagccggaaaaacccgtcaacaaccacgcagcacccaaaatcaaaaagtcggcaatacccgcccacaagaagcactgcccgataaagggaatatcaacaaagcggctgcggcaaatccgtttgccaaaatacgcgccgacggcgataccggtcagaaaacaggcaagggtaaatgaaaatgcctgaggcacggactgtgctgcgaacgaaaacatcctcacccacaagacttctatacccaagctcaataagccgctaaggaaagaaagcatataaatcaaactagtattcggtttagtgttcactatatccatcctttctgtaacgcagccatactgaagcagcaatcagaaggttaaagcaggctgtcagcgcaatggtttgggagagggtaaaaaagacgtagaaaaattcggcggcggcaagcgatccgagtgccgcacccaaagtgttgaaaaaatataaggtaccgatagactcgccaacattatgtattttccggttaaaaaaacaggtcagcaagggcaaggtcgcgcccatcataaaggtaggaagcagcaataagaggaaattggcagcagcgatgatgggcaaatcagcctcaactaaaagatgccccaagccggaaatcagacccctgcttaccaaaccgaacagaccgatggatacttcagcgatgcaaaacagggggatgatacttgaaggaaaacggtcagcaatgcgtccaccgaaatacgcacctacacccaagccgaccataaatacagaaataatgacagtaatcgaactcaaatcgatacctatgtgactgaatagaagcctctgccagctgacctggtaaatcagggcgcagaatccagaggcgaaaaacaccagcgacaatcctttcagggttttacttgcggtcgaattcatattttctattttcaaataggcggaactataaatgaaatgtatcaatgtgtaaacatttgtattaaccgtaggaaatcaccgtattgctcaaactgcaggccgggaaaataaactcgtaagcccgcaaacggcgtatcactgttcaaactgctgtgcggcttcacggtgttataaaaataatggggctgtcctggacaactaagataaactcgattttactaattgttttaaaatggaaatttgaacttttatctcactgttgttaaaacgccattcgcactcctttaaatacagctcaaaatgcgctttgggaatgccgttaaacttgcgtaaatgaatagctacgataacaatccgtataaacaatgctgtcgggctctgttgctgttcttgcagttacacctgcgacaaatagctcaatgagtttattttgtttataccggcttagacgactttttctcatagggataattctaacttaatttgaatttccctatttatctaggacagccctaatgattaaattggatttaaaaagcataaatttatatgatattgattttgaaaaatttacccccgaaattccagataatttccatagatggatagatttggatatcggaatcgaaggagaacaaggctcatctattttttcactttgcatttgttctcctaaatggatttcccatcattgtaataaagaaggttttttttggtctaatgcattaatattagaacagtttgatcataagattattaaaagtgaaattgataaaatattagaatattgctcaaaagaaacttgggatttgacactttcaaacttattacgatttttttcttgggaattcgaagattacaatccaaacacataagagcaatttgggatgataagtctggagcaattgtaatcagagacccaaattcaaaagatggtggaactgcatttagaccaaccttaggcaaaacttactttgacaaacaaaaataaaattattatgaatataatcaattacaaaggtgatgacattattatttctttaacaagagaagagcttcaattattgcgttcccttgttattgaaatttatgcaggtgtttgcatagatgcagaagaatttgagattgtgtcaggaattcgcaatccaaaattggtataagagctagaacaacaattaattgaagcatatgatttaatggatacaacaggataaccgaattatatttgagatagctccaaaattgataagttctgttaataatgtcaatgctgtcggggacagttttttgcaaaggtcttggatggcgcgttccaccaaaccgttttccttacggattcaagcgattacccgttatttcgcccgttttctcttgatgatttcagtttttcaaccaccgttttatatttcttcgtcaataaactcatcttcatgccgcaagctgcggataaaggtttcaaaatcgggggcaagttcgacgatttcaaaatccgattcttgttcgacaaacaccactttcggctcgccgtctttgccgcacgcccgatagtctaaggcaaacatggcatgaccgcctgacgggtcgttggcaaaatacacgccgataggcgggtattcccattcttccagccaaagtttttgccccatcgcgccgcacaaactcccttctttttcaaaaccgattcccgatacctcgcaaatttgcacatgattttccgcccacgaatttctctgcgtggtcggaaaacagtttttgacaaatattccgccgttttgtactgccatcaattcaataaaactttgcggcaatttatagcccagttcactttctacggcagccaaaatttcaggggtaaacggggcttctttgtagttttcatctgcccaactattagttttccatacggaggacaagtcaaaatctttaaaaacttgggacataatgttcttccttattgatctcagtgataacagagggtgggtattcatacccggcttttaccgtccgtcatttatgttccggcgggaatctaggacgtggaatctaaagaaaccttttatccgataagtttccgtgccgaaaggtctggattcccgcctgcgcgggaatgacggcggcggttgcggcaaaattgcccttcccgttttcagacggccttttgctttgtccttactacgttttttgccgtaagtcagattcttgtatccgacatttccaacagcggtgtttcggaaacaatagacgcgtcaaatgtttttgtcggatacgaatatccgacccacatctctatttgctctgtgtgtacattgtagcgtgggcttcatccacgataatgacggctaaaaatgccgtctgaaattttgggcttgattcatagaaaaagcccacgctacgggtttctattctctcctgctaaggtttttgccgtaggtcggatacgaatatccgacctacatttcaaatttacatctcttccaatttcgcaaacttggtgtccaactctttcacgccctgtttgccgaaattgatggtcagtcgggcggattcgcctttatctgcggcatcgataatcacgccggtgccgaatttggcgtggcggacgttttgtccgatacggaaacctgcgtaggtttggggctgtttgtagtcgtcgatgattttatctttggatgcggcggtttggcgcgtgttgccgtaactgtcgtaggcaggctttttgacggacaggtagtgcaatacttcgggtgggatctcttcgacgaagcgggagacgatgccgaattgggtttgtccgtgcagcatgcgttgttgcgccatggtgatgtagaggcgtttgcgggcgcgggtgatggcgacgtacatgaggcggcgttcttcttcgaggccgccgcgttcggcaaggctcatttcgctggggaagcggccttcttccatgccggtgaggaagacggcgttaaattccaagcctttggcggcgtggacggtcatgagttggacggccttttcgcctgcgcctgcctggttttcaccggattcgagggcggcattgcttaggaaggcgagaatggggaaggcggggtcgtctgaaatgttttcaggcaggatttcgaagttgctgtcttcgggtttgaattcgatggcggcgttgacgagttcgtcaaggttgtcgagacggtcttggttgtcgcctttttgggtgcggtagtgttcggtcaagccactgtctttgaggatgccgacgatgatttcggacagggacagttgtccgacttggttgcgcagggcttcaatcaggcggacgaaggcgacgactttggcggctttcgcgccggcgttgcaggcggcttgccagagggtgatgccttgttcgtttgaggccgtctgaagattttcgacggtacgtgcaccgatgccgcgcggtgggaagttgatgacacgcaagagggcgttgtcgtcgtcgggattgacggcgaggcgcaggtaggcgagcgcgtgtttgatttcttggcgttcgtaaaaacgcaagccgccgtagattttgtagggaatgccgctgcggaacaggctttgttcgataacgcgggattgggcgttgctacggtagaggacggcgatttcgtccaaatcccagccttcgcgttcgagggctttggtttcgtccaagatgaaccgggcttcttcgaggtcggtaaaggcggagtagtagcggattttgtcgcctgcttcggcgtcggtgcgcaggtttttgccgagtcgttcgtcgttgttttcaatcacggcattggcggcggcaaggatgttgccgacggagcggtagttttgttcgagtttgacgggcgcgtcgatgtggaattcttccatcagcgcggtcatgttgccgacgcttgcgccacggaaacggtaaatgctttggtcgtcgtcgccgacggcaaatactgctgcgtggttgccggcaatcagtttcagccaagcatattgcagtttgttggtgtcttggaactcgtcaacgagaatgtggttgaagcggttttggtagtgctggcgcaggatttcgttgttttgcagcatttcgtagctgcggagcatgagttcggcaaaatcgaccacgccttcgcgttggcagattttgtcgtattcggcgtagcactcaatcatgcggcgtgtgtgcggatcgggcgcgctcaacacggaagcgcgcaaaccggattctttttgcgcgttgataaagccttgcagcgaacgcggcgcgatgatttcttcggcgatgttgaggcttttgagcaggcgtttgatgagggaaagctggtcgccgccgtcgaggatttgaaaggaagacggcagaccggcgtcgcggtggtgcaggcgcaaaaagcggtggcagagaccgtggaacgtgccgagccacatggcgcggacattgatgggaatcatcgcgcccaaacgggtttgcatttctttggcggctttgttggtaaacgttaccgccataatgctgtgcacgctggcttgtccgctttgcaacagccatgcgatgcgcgtggtcagcacgcgcgttttgccgctgcccgcgcccgccagcacaagtgcggattgcggcggccaggttacggcggagagttgttcgggattcaagccttgcagcaggttgggggcggattggtcgggaaacataaggatgccgtctgaaaagtggaatgcgctattttaatagaaacggtttaaggtcgtctgaaaaagtgcagcggcagggcagcacttttccaatcgacggtttgatgatgcagcacagaagatattgacaaaccgccgcccctgcatatagattcattaaaacataaccaaaatgaacaacaaatgagaatagagatcacaccaatcagcgaatccgctttggtctaccgactgaatgcgccttccgaactgggcaaacagcaaaagttgtgggcgtttgccgctgcgctcgggcagcacgacaggattgaggaagtggtggtcggcatgaacaatctgaccgtgtttacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcccggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatgattcacgtttcggcagtgcaggcaccggcgcatattcaggataccggacgctacggacaccggcgttacggcatcggtcatgccggtgcgatggacacggttgctttggcggcgggcaatattttattgggcaacgacgaaggcacggccgcaatcgaaatcgctttgggcgggataatgctggtgtttgaacgggatacgccgttttgtctcaccggtgccgtgtatcaggcggaattggacggcgaaccggtctattcgtattggcgttataccgcccgcaaagggcagaccttgaaactggtgcgtgccgtgcagggcatgtacggctatgtgtgcgtggcgggcggatttgatgtgccggaagtgatgggttcgagaagcaccgacctgaaagccggtttcggcggccatcagggcagaatgctgcaaaaaggcgattatctccccatcggcaaaggtgcgcaggaattgtccaaagtcggcattgccccgataccgtttaccgataccgtccaccttgttccttcgtcggaatatgccgctttcagtgaaaaagggcgtctgaatctggaacgggaaacgtggacgctgcaaagcgatagcaaccgcatgggctaccgcttcgacggacagccgctgaccctgtcgcaacctttggaaatgctgtcccacgctgttcaggcaggaaccgtgcaggtgccgcccggcggcaaaccgattatcctgctggccgatgcgcaaaccaccggcggttatccgaaaatcgctaccgttgccgccgccgatttgggcaggctggcacaggtgcgcttcggcagcaaagtcaaattcaaaataatcggcttgaaagaagccaccgccctgcggcgcaaaaacaagcctatctgaaccaaatacggagaatcacccatgaagcaggttgatttaaacgccgatctcgccgaaggctgcggcagcgacgaagccttgttgcagctgattacttcggccaacatcgcctgcgcccaacacgccggcagcattgccgatattcgggcggcattggcgtatgcccaacaaaacggcgtgcgcatcggagcacaccccggctatcccgatcgggaaaacttcggccgtaccgaaatgaatctgtccgaagccgatttgcgggcgtgtctgaattaccagttgggcgcattgcaggccttgtgccgtgatcagggtttggaaatggcttatgtcaaaccgcacggcgcaatgtacaatcaagcggcgaaaaaccgtgcgctggcggataccgttgcccgaattgtggcggatttcgacccgaaattgaaattgatggcactttccggcagcctgctcttggaagccggaaaagccgcaggcttgggtgtgatttccgaagtattcgccgaccgccgctatatgcccgacggtacgctggttccccgcagccgccccgatgcgcaggtggacagcgacgaagaagccatcgcccaagtattgcagatggtgcgggacgggcaggtcaaagcagtggacggcagcctggttgccgtgcaagccgacagcatctgtctgcacggagacgggccgcacgccgtggtgtttgccgaaaaaatccggcaggaactactggcggcaggcatcaaagtttctgcttgaaaaacagttcataggccgtctgaaaaccgcaggtttcgccaaaacgagcaaagcgagtttctgcgtagctaaaaccgcaggtttcgcccaaacacagcaacaaccaattttatagaggataagcgattatgtctgatcaaaaaaaccgcagaaatgccttaatcggcgctgcattcctgatggcgacttccgccatcggcccgggctttctgacccaaaccgccaccttcacccaagcactggcggcaagtttcggctttgtgattctgctctcgattctgctcgacatcggggcgcagctcaatatttggcggattgtcgccgtttccgaaaaacaggcgcaggatattgccaatcaggtcttgcccggcgcaggctatttcttggctgtgctgattgtgatgggcggtttggcgttcaatattggcaacgtcggcggcgcaggcttgggtctgaacctgctgaccggactgtcaccggaaaccggtgccgtgatcagcggcgtgattgccatcggtgtgtttctgtttaaagaagcaggcaaagtgatggacaaattcgcccaagtgatgggtttcgtaatgattgcgctgacggtttatgtggcatggcaggcgaatccgccgctggcagatgccgccgtgcatacctttatgccggaaaaactcgatgcaatggcgattgttacactggtgggcggcacggtcggcggctacatcaccttcgccggtgcgcaccgtctgctggacgcaggtatcaaaggcaaatcggcgttgccggaagtgagccaaagctcggtgcgggcgatcctgattgcctcgattatgcggattgtattgtttttggcggttttgggcgtggtcagccaaggcgtacagctcaatcccgacaaccctgcttccacaccgtttgaatatgcggcgggatacatcggcctgctgattttcggcgtggtgatttgggcggcttcgattacttcggtgattggtgcggcttatacttcggtgtcgttcttctccggtctcagcccgtctatcgaacgcaataaaaacaaatggattattgcctttatcgccgtgtccaccgccgtattttccaccatcggcaaaccggcgcaggtgctggtgttcgtaggcgcattaaacggcctgattttaccgatttccctcggtctgattctgattgccgcctacaaaaccaaaattgtcggcgactacaaacacccgctgtggctcaccgtttccggcgtgattgtggtcggtttgatggcagtactcagcgccatcaccatcagcaaatatatcggcggcttgttcggctgaaccttgtagcgcagatgtttgattttgtatattatccgaagtttgccgcctgatatggaaaattcctgtttcagacgatgtatccggtctgaaacctattcacaactatgaaacgcttcacctatactctttccgacggtttgtgcatcgaaatcgaactcaaacgcagtgccaagaaaaatctgattctgcgccccgtcaatatgcagacggtcagcatcaacgtcccacccttttttcaagaccacgcgttagcaaactggctggcggcaaacgaaacgattttgcggaacacgcttgccaaaacgcccgtgcatcctgtttcccacccaaacttacccgagtggatttggtatcggggaataaagaccaagctggatacccacagccaaagccatatccgtatcacgtcgtctgaaatcctgcttccccgaaaagaaaccgccgcacaaatcgaccacctgcgccgcctgttgaacgaacgcgcccgcgaatacctgctgccccgccttgaaaaacacgcagccgaaacaggactgacgcccaccgccacagacctgagcaacgccaaaaccttttggggcgtatgccgcccgcacaccggcatccgcctcaactggcggctgatcggcacgcccgaatacgtcgccgactatgtctgcatccacgaactctgccacctccgccaccccgaccacagtccgcgcttttggcatttggtgaacacgctgacgccgcataccgacaatgctaaaagttggctgaaggcgcacgggcgggaattgtttgtgctggggtaaaggctaaccgtagcgtgggcttcgcccgcgagaatccaccccctcccgtacggagggagagggttggagagagggtggctcttgtcccttgttctgtatatttgcaagccaccctatcctagccttcccccgttggataagggaaagggatcaagctgctgtaactgaaagaggtcggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggccgtctaaaaagtagaatgcgctattttaatggaaacggcggggttttaaacggttcttatttgtttgttttgatttttgcttggataaaaaatcccatcattcccacaaaaacagaagcctgaaatcccgtcattcccgcgaaagaggaatccggtttttgggtttcagccattcccgataaatcgctttagctctgccgcaaccttaaaacggcacggtacgaaaataccgtctgaaacccagattgtcaggcttcagacggcattttttgttcagacggttgccgcttcttcgccgaacacttcccgccacaatttcctgacattgccgtaatgtgccaacagttcgccggttacttcggtttttgccgcgtcgcgcagtttggtgttgtgctgctgccggcggtagaagcgataggcggtgcggctttgtccggcgagggttttgtcaatcaaaccgcagtcggcggagatgtttaagagggcgatgttgccgtagttgtccaagagttgcggatactggcgggcatgggcaagtatcagatattggacgataaattcgacatcgaccacgccaccgcgcgcgtatttgacgttgctgtcggcaggcgggtgggtggggaacattttttcgcgcatttcgatgatttcgcctgccaaggcggtttggtcgcgttcggcggtgaggatttcggtgcggatgcggtcgaaggccgtctgaatttcggacgtgccgcagatgaagcgggcgcgggtaagggattggtgttcccacgtccaggcgttttcgcgctggtatttttcaaaggcggcgatgctgtgggcgaggaaaccggcgtcgccattagggcgcaggcgcaggtcggtttcgtagaggctgcctgcgccagtggcggcggaaagccagttggtcaggcggcgggcgaggcggctgtacacgtcgcctgcgtcggggtgggggtcgtcgtagagatagacgaggtcgaggtcggaggcgtagccgagttctttaccgccgagtttgccgtagccgacgacggcgaattgcggtgtgtcgcggtgttttttgggcatgtccgcccatgcgcacagcagggcggcggcgaggatggtgtcggcgagggcggagagttggtcggagagggattctaccgtccacagtccggcgaggtcttggacggcgagacggaagacttgggcgtgctggaagcggcgcagggtgtccatttgcgcttcagtatcgccgccgcaggctttgaggtcgtctgaaagggcggcggcgagcgcctgccaatcaaacgcggtatccaaaagctgcgcgctgatgagttcgtccaacaaaatcggatatttgttcagatacgccgccacccaagaactttggcccataatctgcgccagttgcgccaaggtttgcggatgttcgttgaggaaggcgagataggcggatcggcggctgatgttttcgagaaaatccaacagccgcatcaatgtatcggtcgggttgctttgcgctgccgccgcctgtacgaacagcggcacaaccgcatcgaaacgcggctgggcgtgtgcggaaagatggcggtatttatggccgtggcggatttggtcgagccttgcggcgacggtttcggcatcgaacccgtgcgccttcagacggcatcgccgcccttcttcgtcgggtttgtcctgccatgcccattgccattcgctgttgtcttgcgtttgctcttcgggttcgctcaaaatttcgttgaacaactgattgactttgttccgatgaacattgagaccgtctgaaaaagcggaataactgtcgaaacccatgctttcggcgagcagttgccgctgttcgggcgaggtcggcagggtttgggtttgctggtcatcccagtattgcaggcggtgttcaacatcgcgcaggaagcggtaggcggcaagcagggtttcgacgtgttcagacagcatgatgcccagctcggcaagcttcttcagcgtttcctgcgtgcctttcagttgcagcgcgcgcatttgtccgccgcgtatcatctggaaaatctgggcgataaattcgacttcgcggatgccgcccgcgccgagtttgatgttgtccgccatgccttttttgctgacttcgctgctgatttggcggtgcagcttacgcatcgcctcatacgcgccgtaatccagatatttgcggaacacaaaggggcgcaccagtgctttgatgtcgttcggatacggcgtaaccacgcgacctttgcaccacgcgtagcgttcccattctcgcccctgtgtaatcaaatattgctccagcgcggtttcgctcaataccaacgcgcccgaatcgccgtccggccgcagccgcatatcgacgcggaacacctgcccatcggcggtaatgtcgttcagcagcgcaatcagtttctgcccgactttggtgaaaaattcctgattgccccgttcgcgcctgccgtcggtgtcgcctgattcgggatagacgaaaatcaaatcgatgtcggaagacacgttcaactcatagccgcccgccttgcccatcgccaccacgctcaaatgctgcggcgatttggtataacgcccgatcggcgtgccgtacatgtcccgataataggcgtaggcaaaatccagcgcggtattgacggcaaaatcggcaaacagcgtaatcgtgcgggttacttcgttcaaatcgctgatacggttgatatcgcgcacgataatctgcgacaccacataacggcgcaactcgcgcaactgccgcgccaattcttcctcgttttcttccgcgcggatttcgccccagtcggcaaaggcttggaaatccgcttcggtcaaaaccttgtcgagcataggcaggaatatttcgggcttgagtttgccgttgtcgagctggcgggcgaggaagagggaatggcggcgggcggtgtcgaggcggttgtcggacatttcggattccgtttggaaggatgacgggaatgagatagtggattaactttaaatcaggacaaggcgaggggatgccgtaccggtttaaagtcaagccactatatcatagcaaccttcgatgtcgtctgaaaccttgccccgatattcggacggatgcctaccaataaaaaacagcggcaaatgccgccgtttcctgttcacacctcgccacgctcttttaaaatagcataagccgcacttttctcccgtgtggaatttttaaaaaaaccatcactcttgacgatttcatgcagctcctcacttgatttctccgcatattccattttcaacgccttatgctcattgccggcttcaatcattccctctcccactgcttttgctgcttttgccacaccattccaaaaacccataatcatgtcctccaatcgtttcaaataaggtcgttgtttctgtcaagaaacaacgacagtttataaactgtcggaaaacaaaatgccgtctgaaggccggataatgcttcagacggcatcggattgccggttttaaccctgccctccgccgttgttcaaatagtgttcccagtgagaatataaccgggcaatattttcttcataggtgtgggcagaaggaatataaccgtctttgggcggcatatacctgacaaatgattctatttcttccggataatcaaaatctgcataaattttttcaacttcccccaaaggatcctcaaattcttcttttctatggaatacatcgcttaagaggacgtacagccaatttttaggggaataatccctcatttccgaagccaaatcttccagaacaggctttaattcaagaatattggatttgttgattaaagatagtttgaacacacgttcatcatgatctgaaagcgtcatttttcgggcataagctgccacatcagcccaacccaagtatttattcccatacccccacagaatatccttccaagaaagacggactttttgcgcggttaaatcaaggttcattttttactccgattgcctgctccgtgttcacgcatcggtttgccttatttcaaacagggcggcgcgtaagggattttcaaggggcgtcaggcggaaaaaggaaatgaaaatgccgtctgaacggcaaaacgtgcgttcagacggcattttgggcggatcgcgtcatcgcgccaaagccttcaaacattctttgaccaatgccggacctttgtatatcaatccgctgtacacttggacggcggtcgcgcccaagcggattttatctgccgagtcctcgccttccataatgccgcctacgccgataatcggcagcttgccgtctatgtggtctgccaacagcttcaacacccgattacttttttcatgaacgggcagcccgctcaaaccgccctgctcgcctgcgagcggatggctgccgagacttgatttgtcgatggtggtattggtagcgatgatgccgtccatttcgacggatttgacaacgtgggcgatgtcttcgatttgtgcttcatccaaatcgggggcgattttgacggcgagcgggacgtatttcccgtgtacagaggcaagctgtgcctgtttgtttttcaaagcctcaagcaatgcgctcaactcgtcgccaccttgcagcgcgcggaggtttttagtgttgggcgaggaaatattgacggtaatgtaacttgcgtgtgcgtaggctttttcaaggcagattaaataatcatcggcagcgttttcgatgggtgtaaccgcgtttttaccgatgttgatgcccaatacgccactgaatttacttttttcgatgttgcgtatcatggtgtcgataccgtggttgttgaaacccatgcggttgatgatgccttggtgttcgggaacgcgaaagaggcgcggctgcgggttgccgggctgcgggttgggcgttaccgtgccgatttcgatgaaaccaaagccgagcgcgcccaatgcgtcgatgtattcgccgtttttgtcgagtccggcggcaagtccgacagggttgggcaaatccatacccatcaattttacaggtttggtacggttgtcggttacaggaatcaaacccaatttataaaccgtgtagagcgcgtcgagcgtgaagtggtgggctttttcggcatcgagtgcaaacaggatgcgacgggcaagtggatacatgacagggctttctgcttcagatggaaatgccgccattttaaccgaaatcccgccaaacatacggcacacaggtcaaacttgaacgacaaaacccgccgcacccaaaaatgtacaaatcggcaaatattgatataatagtcattagatagaaaactctattaaaagtcggtacaataccaccgatttatttcccttaaacaacctgccgcaaggcataaaggaacgactgatatgtcaaacatcgaacaacaagttaaaaa

SEQ ID NO: 17 - DNA, 60872 bp, Neisseria meningitidis
ctgcttgccgccacggcaacagacagaccgatgaccatgatgacggggccgatgacgaccggaggcagcagtttgtgtaccgctgccagtccgcgccaacggatcagcgcggcaaacacaaaatacataaagccggcggcaaacagtccgaacatggtggaaggcagcccccattcgccgacggagtagataatcggtgcgataaaggcaaacgaacaaccaagaaaaatcggcactttgcgtttggttgtgatttggaacagcagcgttcccaagcctgcgcccaaaagcgcaagagccggattcagaccggtcagcaggggaaccagcaccattgcgccgaatgccacaaataaaatctgtgcaccggaaacggcaagtttcagttggttcataccatcttctttcaatcggttcaaacggcacggattatactggtttgccgagggtctgcgtaaaaatacatacgtcgggcaacagatatgccgtctgaaaggcaatgtctgtctgttgcaggatgaaagcaggagaaatggagtataatccgacactttccatattcaatccgcaagccgtccggcttccttatttcagacggcattttccggtaatacggcatgacagaaaaatcccataaaaaaacagcaaaaggcagggcgggaagcccgtccccaacgtccgcacgcaacaagaaagccgacaacggcgcacggggcaataaagtttccgagcggctcaaggcggtcaaagagttgcagaaaaccgaaaccaaaaaggcgcgtcccgaacatgtcgtcaaccttatcggcgacgcactgtggctgatgggtttggcggcaaccctgtatttggcgatttccctgatcagtttcgatatgggcgatccgtcttggtcgcacagttcgccggttgtggaagatgtcgccaattggggcggactgttcggcgcgtatgttgccgatgtcggctattatcttttcggctggtcgttctggtggtggatagcggctgcctgcgtcgtgctgtataaaaatttccgcctgcacgcaaaacagacggaaaacgaggcatacaaccacaaaatcgctgccgccgcgctgtttgtcctgacggtcttcagccccgtcttggagtattttgtgctgggcggaaaatatgccgactccctgcctgtcggagcaggcggtatggtcggcatacgcgtcggcgcagtgtttgcgtggctgctggggaaatcgggcagcctgctgattatcttggttgttctgctgttgtcgttgtccctgctggtgcagatttcatggctggaatttttgaacggtgcgggcagggcggttcaaaaccgcctgagtgccttatccggcaaggtcatggctttaggaaaacgccggccgaataccaaaacagacggtgtcgatacccaaaatacacggcgcatggtaaaagaagccaagaatattacggccaaacccgttgccttgcccgaaggcagcagcagcaaccgcaaatccgtcgcggtttccgtcgcgccgccgcccaaaattcaggtttctctgtttgaagatgacgaacctcggcaggcgggcgaataccacaagcctacattgaacctattgcggattcctgacagcgaacccgtcagcatcaatcccgccgaattggagcgcactgccgaactgatcgaatccaaactggcagaattcggcatcggcgtacaagtcgtatccgccacatccggccccgtcatcacgcgctacgaaatcgaacccgcgcaaggtgttaaaggcagccaaattgttgccttgtcgaaagatttggcacgctctatgtcgctgcagtccgtgcgtatcgtcgaaaccatcgcaggtaaaaacacgatgggcatcgagttgcccaacgacaaacgccaagacgtgatgttgagtgaaatcttgtcctcgcccgtgtttgccgaagccaaatccaagctgaccgtcgcgctgggcaaagacattgccggtacccccgttgtcggcgacttggcgaaaatgccgcaccttttggtcgccggtatgactggttcgggcaagtccgtcggcgtgaacggcatgattatgtctatgcttttcaaagctacgcccgacgaagtccgcttcattatgatagacccgaaaatgctcgagttgagcatttacgacggtattccgcacytgctctgtcccgtcgtgaccgatatgcgcgaagcagggcaggcgttgaactggtgcgtcgccgaaatggaaaaacgctaccgcctgctttcccatgccggtgtgcgtaatttggagggcttcaaccaaaaagtcgaagccgcaaaagcggcaggcaagccgctgctcaatccgttcagcctgaaccccgacgagcccgagccgctggaaaaactgccgttgattgtggtcgttatcgacgaacttgccgacctgatgatgaccgaacgcaaagccgtcgagcagcaaatcgcccgtctcgcccaaaaagcgcgcgccgccggtatccatatgattgtcgccacccaacgtcccagtgtcgatgtcgttaccggcctgattaaagccaacatcccgacgcgtatggcgtttaccgtgcaaagcaaaatcgacagccgtaccatcctcgaccaaatgggcgcggacgaactgctcaaatatggcgattcgctgttcctccagcccggcagtgccgaaccgactcgcctgcaaggcgcgtttgtttcagacgacgaagtacatcaagtcgtcaactatgtcaaatcgcaagccccagccgactatattgaaggtctgctcagcggcgaggccgcgctggaaactgccaatatcgttaatccgaatgcagacagcgacgaattgttcgatcaggcagtcgcctatgttttggaaagcaaaaaaacctccatttcgtctttgcagcggcagctgcgcatcggctataaccgcgcggcaaacctgatggaggcactggaaaatgcgggtgtcgtttcttccaccgacctcaacggcagccgtaaaattttggcgcacaaggaccatttgtagcccgtattgcaaaatgccgtctgaacggcggaattggcgtttcagacggcatattatgtttcaggcgaaacattgtgatatacttgccagctaaaatttcccctttgcggcaatgcggttcaaatatcgtaccgttgcgctgtttgcttccccatgtagggaagaaagtttatcattttatcaacacaacaaatttaagggcttatgatgagcgtaactgttgaaactttagaaaatctggaacgcaaagtagtgttgtccctgccttggtccgaaatcaacgcagaaaccgataaaaaactgaaacaaacccaacgccgtgcaaaaatcgacggtttccgtccgggtaaagcacctttaaaaatgattgcccaaatgtacggtgcgagcgcacaaaacgacgtgatcaacgagctggtgcaacgccgcttctacgatgttgccgttgcccaagagttgaaagtggcaggcttcccccgttttgaaggcgttgaagaacaagacgataaagagtctttcaaagttgccgccatttttgaagtgttccccgaagtcgttatcggcgatttgtctgcacaagaagttgaaaaagtaaccgcttccgtcggtgatgccgaagtggaccaaaccgtagaaatcctgcgcaaacaacgcacccgcttcaaccatgtcgaacgcgaagcccgaaacggcgaccgcgtcatcattgactttgaaggcaaaatcgacggcgaaccttttgccggcggcgcatccaaaaactacgccttcgtattgggcgcaagtcaaatgctgcctgaatttgaagccggcgtagtcggcatgaaggctggcgaaagtaaagacgttaccgtcaatttccctgaagactaccacggtaaagacgttgccggtaaaactgccgtgtttaccattacgctgaacaacgtttccgaagcgactctgcctgaagtcgatgcagattttgcaaaagccttgggtattgcggatggcgacgttgccaaaatgcgcgaagaagtgcagaaaaacgtaagccgcgaagtggaacgccgcgtaaacgaacaaaccaaagaatccgtaatgaacgcgctgctcaaagccgtagagctgaaagcacctgttgctttggtcaatgaagaagccgcacgcttggcaaacgaaatgaaacaaaattttgttaaccaaggtatggctgatgctgccaacttggatctgcctttggatatgttcaaagaacaagccgaacgccgcgtatctttaggtctgattttagccaaactggttgacgaaaacaaactggaaccgactgaagagcaaatcaaagccgttgttgccaactttgcagaaagctacgaagatcctcaagaagtgattgactggtactacgcagatccttcccgcctgcaagccccgacttctttggcggtagaaagcaacgtcgttgatttcgttttgggcaaagccaaagtaaatgaaaaagctttgtcttttgacgaagtgatgggcgcgcaagcctgattatcctgaaaatgccgtctgaaggcagtttttgaaagcaccgaagccgcttttaaagctcgctttggtgcttttccatcatgaaaggagacgaaatgtcttttgataactatcttgtcctaccgttatcgagcagagcggtcgcggtgagcgtgcattcgatatctattcccggcttttgaaagagcgcatcgtattcttggtcggaccggtaaccgacgagtccgccaatctggtggttgcccaactgttgtttttggaaagtgagaatccggataaggatattttcttctatattaactcgccgggcgrttcggtaacggccggtatgtcgatttacgacaccatgaatttcatcaagcccgatgtatcgactttgtgcttggggcaggcggcaagtatgggcgcgttcttattgtcggcaggcgagaaaggcaaacgttttgccmtacccaacagccggattatgattcaccagcctttaatcagcggcggtctgggcggtcaggcatccgacattgaaattcacgcacgcgaacttttaaaaatcaaagaaaaactcaaccgcctgatggcgaaacattgcgaccgcgatttggcagatttggaacgcgacaccgaccgtgataatttcatgtctgccgaagaagccaaagaatatggtttgattgaccagattttggaaaaccgcgcttctttgcggctttaataaaagaaacctgagagaaaccgatgccgtctgaaacgttcagacggcatttgtttcaagctgcgtttgatatggtatcgataccgtcatccacgggacggaagaaggatttggagttttttaaaggatccccgttcccgcctgtgatggacggatgccgtctgaaagccaaatggggcagcagtttttgcaagggcgcgacactcgcatcctcctgaatctgccggtacggttattgagaaaagacaagggcaggaagcggtatcccgccttccttatttatacctgcaattcatctccgtatttgccgattgtattttcatattgcgcctccattccttatcggtttaaaaaaatgccttttccaatgggatgggttttatatcaatgaaaataaacggtttttatttaaaaatagccaaggtaggctggcggttggattttatagggagtgtatcgggataaccttcccttgatggcgtttgagtccgttctccccataattggttttgacatactcttcaacaatagccagaaattccgttgcaatgttgtcgcctttcagcgttactttacgttcaccatctacataaacaggggcaacgggtgtttctcccgtaccgggcaggctgatgccgatgtcggccaatttgctttctccgggcccattgacaacgcagcccattacggcaacgttcagggattcaaccccaggataaagggtacgccatatagacattttttggcgcaggtaattttgaacatcttgtgccagctcttgaaatacggtactggtggtacgcccgcagccggggcaggcggtaaccatcggcgtaaacgaacgcaatcccatagtctgtaaaatctcttgcccgacgacgacctcctgagtacgcgggctgccaggttccggagtcagtgaaatgcggatggtgtcgccgattccttcttgaagcaagacggataatgccgccgttgatgcgacaatgcctttgctgcccataccggcttcggtcaaacccaaatgcagcggataggcgcaacggctgcccagttcgcggtaaacctgaatcaaatcctgaaccgcgctgactttgcacgacaggatgattttgtcttcgggcagtcccaatagaacggctttttcggcagattccaaagcggagacaatcagtgcttccttcgtcacttcttcgggcggtttcggcgcggaagaagcgaggttggcatccatcatacgtttggcgaggctttgatccaaagaaccccagtttacgccgatgcggacggctttatcgttttcagcagcagtccgaatcataaaggcaaatttttcatcgccttttacgcctttgccgacattgccgggattgatgcggtatttggacaatgctttgccgcattctggaaattccgccaacaggcgttcgccgttgaagtggaaatcgccgataagcggtgtggcatagcccatatcgtccaagcggcggcggatttcggcaactttggacgcggcttcggggctgttgacggtaatacgcaccatttcggatccggcatcgctcaattccttaatctgcaatgcggtggcttttgcatcggcagtgtcggtgttggtcatagattggataacgacgggtgcttctgaaccgacggtaatatgatcgatgcggacttgatgcgtcttgcggcgttggagtgtgttcatatggtttgaatctgtttattgaccggtgaggacggtttgcaattcttccgagtaggggaaattcgcctgcaattgtgcttcatattcgtatgccgcctgtgcgttgccgagggctttggcaattttccagcctagcagcaaatcatcggcctgaaggacttctaccctgctttggtattttttaaagtagtaatcggcatcgcccaactgcccggccagcattttggtgcgcgccagttctttaaatgcgggtgggaactgcggctgggcggcgagggaacgtttcaaataggcttccgccaatccgaattgcccctgttttgcgctgcatatgcctttattcaggttggcaatataaggggtcgggtaggtggggtcggccagagctttgtcgaaatatgccatagattcggcagggcggttgagcctgccgcataggaaccaaccgtagttgttgttgatttcggcactgtcgggtttgatggagagggcttgccggaaactttcctgcgccttgtcgttaactttcaggtattgatagatttcggcacggaccagccaggcaagctcgtttttagggtccgatttcagggcgtcttcaatacttgccgtcgcctgacggtagtcctgaccgcgcatatattccattgccaactgggttttgatattggaaacctgattggctttttctgcccgcgaggggcggtaggaagtgctgcacgcgcccaaggcaagaacgagtaataaagagattcgtttggatggcttaaaaggcataattacccctgttgtccgattaaaatctgctgccatttttgttggcggcgcgttttatcctgaacctgccccgccaactgtccgcaggcggcatcgatgtcgtcgccgcgcgtttttcgtacggtaacgacaaatcctgcctgctgcaaaatatcgcggaacacacggatgttctcattgctggagcgttcgtatccggagtttgggaagggattgaacggaatcagattgaacttgcagggaacatctgtgaccagttcgatcagttcgcgcgcatgttgcgccttatcgtttattccgtccaacatgacgtattcgaaagtgatgaaatccctgggtgctttgaccagatagcgttggcatgcggccatcaattctttcaagggatattttttgttcaacggtacgatttggttgcggacttcgtcattggaagcgtggagggaaaccgccaaagccaccggcatgacatcgcgcaacctgtccatttggggaaccatacccgaagtggaaacggttacgcggcggcggctcaaaccgtagccgtggtcgtccagcatgatgcttaaggcggtaacgacattgtcgaagttcgccatcggctcgcccatgcccatcatgacgacgttggaaatcacgcgctcgtttttcggtgtaacgcccatcgctttgtttgcccaccacaattgcccgatgatttcggcagcagtcaaattgcggttgaagccctgccggccggtcgaacaaaatgtacattccaaagcgcagccgacttgtgaggaaatgcagagcgtgccgcgatccgattcggggatgaagacggtttccacgccgttgcccgtaccgacatccaaaagccattttcgagtgccgtctgaagatttttgagacatcatcagcttgggaatttcgatgcctgcctgttcgttcagtttatggcgcaacgattttgccaaatcggtcatttcgtcaaaattttgcgcgccggattggtgcatccaacgcataacctgtttggcacggaaaggtttttcgcccatatcggcaaaatgtcgggtcagcccttgaaggtcgtagttgagcagattggttttcatgtgtttgtgtttttcttaaatcaaggcttcaaataaaaaattgcagggcaggcaagtttgatttgaagccttttgcaacagagttttcagacggcatggatatatttatgccgtctgaagaggagttgggcggtgtattgtatcaacgggggcagatttcggtttggctgaaaaagtaggcaatttccaaagcggcattttccacgctgtcggaaccgtgtacggcattaatgctgaccgaagtggcaaagtccgcgcgtatcgtgccttcggcggcttcggaaggattagttgcacccatcagttcgcggtttttcaggacggcgttttcaccctctaatacctgaatcataaccggaccgccggtcataaattcaaccaatccggcgtagaaggggcggtctttatgaaccgcataaaattcttgcgcctctttgagagtaagctgcttcattttggcggcaacgattttcagaccgttctcctcaaagcggctgtatattttgccgataacatttttgccgacggcatcgggtttgatgatggagatggtacgttcaatcgccatgctatatccttatttttacttaagaagaatcaaatcggtattctatcaaaaaaataacttatccgcctgaagccttgggagatagggtcaggtgcggctgttccaaataaacttcggactgcatttcgaccatccggctggcggtgcgggtaaattcttcggcaaaatcgccttccgtatagatatggttgacatctaccgcgccggtggcacacagtttgacccggaaatcgtagagtacgtcaatcagccaagtcagccgccgcgcctccgccttttcttgcggtgagagttgttccaaacctgaaataaaaaccatttcataatgttcggccaaatacagatagtcggactgtgagcgggggccgaagcacagtgcgcggaaatcaaaccatatggcacggccggactcggctttgtggggaatctcccgaccgtggatggtgctgatgccggggttcaaatcggtaatgcctgtcatttctttgaacagttttgccagttttgcctcattttcttcattggcaggcgtaaagaaaatctcggcggggcggagggtacgcagtcggtagtcttcaccgccgtcaacgtttaagacggtcaggctggactcgatgagcgcgattgtgggaagaaaactgctccggttttgaccttgcgggtagagttcggaaggcgcgtagtttgaagtcgccaccaaaacaacgccctcgttaagcaggttttccagcagacggcctaaaatcattgcatccgcaatatcgctgacatgaaattcgtcaaaacacaatacgcgggtttctttggcaatctcggcggcaacggatttcaacgggttgctttcgcttttcagggttttcagccgctggtggatttctgccataaaggcatgaaagtggacgcggcgtttgcggcggtacgggaggcagccgaaaaaagcgtccatcagaaagcttttgccgcgtccgaccccgccatagaaataaagccctttggggacttgcggggaacgcaaactcctgcctaaaaaacggtttcttttgcgtttgaacatcatcaattcggtccaaagccgatcgaggtgttcgatggcggctgcctgcgcgtcgtcgcggatgaagttgggcagttgtgaggcagcctgataccaggtcagcgggctgtggttttcaaacggcggggctttaaaaagttggtctctattactcatatttaaccttgttatacttcttgcggctaagaaagaaaatgcttaccgtcggtattataaatgatttccttcaaacttggcattttccgtggaaaagaataatgacgcgcacaagggggtataagcaaaggcggcgtttcaatatggtgcagatatgagctcaaatgccttttatagtagattaaatttaaaccagtacagcgttgcctcgccttgccgtactatctgtactgtctgcggcttcgtcgccttgtcctgatttttgttaatccactataatccgtagagtcggctcctttcggctcagacggcatacgtttatgccggcacttcttaccgccctcgtgccggctatcccaaaactgctttgaacactgaacgctctttggtttacttcaaaaacgcggcgtgataagcaatatgctcgccaataaaactggcgatgaagtaatagctgtgatcgtagcctttatggaaacgcacatcgaccggctggtttgccgcacggcaggtttcgataaaatcttcggtacgcaattgtgtcggcaaaaactcatcttccaagccttgatcgatgcgcataccttgcactttatagccttgttgaatgagtgagttagcatcatattgctgccatttttcacggtctttccctaaataagcagtaaaggctttttctccccacggcacgaggcttggcgataaaataggcgaaaaggcagaaacactttgataacgttcctgattccgcagcgccaataccaatgcgccgtgtccgcccattgaatgtcccataatggaacgtttgccgttggtaggaaagtgtttctcaatcagacggggcagctcgttcaaaatgtaatcatacatttgataattcgccgcccaaggctgttcggtcgcattcaaataaaagcctgcactctgtcctaaatcgtaagcatcatcgttcggcacttgctctccgcgagggctggtatcgggggccaccacaattacttgatgttctgccgcataacgctgaaagcctgacttggtaatgaaattttgttccgtacacgtcaagccggaaagccaataaatcacaccaagcggtcgattttctggattatttggcaaatagacggcaaatttcatttcgcattgcagcgtttgggcatgatgcgcccaaacttgttgcgaaccaccaaaaatttgatgttgttcaatcagtttcatcgcataccttagtagtgaataacggcgcggatcgatttaccttcgtgcattaagtcaaaggctttattgatttgatcgagtgtcattgtgtgggttacaaacggttctaactcaatgtcgcctttcattgaatcttccaccattttcggcagttcagagcgacctttcacaccgccaaatgctgaacctttccaaacacgacctgttaccaactggaacggacgcgttgaaatttcttgtcctgcacctgctacgccgatgataatggattgaccccaaccacgatgtgcactttctaatgcctgacgcattacgtttacattgccgatacattcaaaggtatggtcaatgccccatttattaatgtctaacaacacatctttgatcggtttatcgtaatcgttcgggttcaaacaatccgttgcaccgaactgttttgccaactcaaattttgatggattggtatcaatggcgataatgcggccggctttggcttgacgcgcaccttgcaccaccgccaaaccaatcgcccccaaaccaaacacggcaacagagtcgccttcttgcacttttgccgtattatgtaccgcaccaatacctgtggtaacgccgcagccgagcaaacatacttgttcatggttggcttcagggttgattttcgccagtgaaacttcggcaacaacggagtattcactgaaagtcgaacagcccatatagtgatagattggctgaccttgataagaaaaacgcgtcgtgccgtccggcattaagcctttaccttgtgtatcacgcactgagacgcacaagttggttttacctgaacaacaaaactcacattcgccacattcggcggtgtaaagcggaatcacgtgatcacccggttttacgcttgacacaccttcgcccacagcaacgaccacacccgcaccttcgtgtccaagcaccacagggaatacgccttcaggatcgcttcctgataacgtaaacgcatcagtatggcacacgccagtgtgggtattgcggattaacacctcgcctttacgcggcatttctacgtcgatttccacaatttgtaagggttggttaggggcgaatgccaccgccgcacgagatttgatggttgaatcggcttgtttcatttccattgtctttcctcttaattcattgacaaagttgccttgcctgagcaacatagcaacagtttacactttagagttaactctaaagcaagtgttttttactgtttttgtttagaaggagggaaaatgacttatactactgccaaagccgccgaaaaaataggcatctccgcccacaccctacgtttttacgacaaagaaggtttgttgcccaatatcggacgtgatgaatacggtaaccgctgttttaccgataacgatttgcaatggttgggcttattgcaatgcttgaaaaatacgggaatgagcttaaaagacatcaaacgctttgcggaatgtaccgtcattggcgacgataccattgaagaacgcctttccttgtttgaaaatcaaatagaaaatgtgaagtgtcaaattgccgaattaaaacgctatttagatttgcttgaatacaaattggcgttttaccaaaaagcgaaagcattaggctcggtaaaagctgtaaatttgccgcaaattcctgaaacggcttagttttagtgcaataagcaggatttttgtcctgttcgtaatagaaatcaaaaatttgttgtttaaaaagcggattgtaagcaatgatatagtggattaacaaaaatcaggacaaggcgacgaagccgcagacagtgtaaatagtacggaaccgattcacttggtgcttcagcaccttagagaattgttctctttgagctaaggcgaggcaacgccgtactggtttttgttaatccactataaaaaaatccacgctctaatccgttgcttgcttggctcaaggtattgaagcaacggatgaagttaaaccacagaaaaaacgccgcgtaacagcggcgttttgatgctaaggtttaattggcattttcttttaaagccaagtcgacccgctcgcgcaattctttaccgggcttgaagtggggtacatgtttttcaggtacttccacacgctcgccggttttgggattgcgaccgatgcgggcaggacgatggttcaaatcgaagctgccgaaaccgcggatttcgatgcgttgacctcgggcaagcgatctagtcatggtgtcaaccaagacttttacgctgtactctacgtcttttgccagaagatgcgtgccgtttttggcggcaaacacttctgccaaacgaaccattaactcagactttgtcatgtctgcaaccttattcttgttcgccggagagtttggctttcagcaggtcgcccaagctggtggtgccggcattcgcattggcggcggcattgacggagttcagtgcttcgcggctttctttggcatctttggctttaacggaaagtttgatgctgcggtttttgcggtcaacggtaacgatgacggcttcaacttcgtcgccttctttcagtttggtggtcaaatcttcaacgcggtcggctgcaaattcggaagcaggcaggtagccttctacttcgtcagacagggcgataacagcacctttggcgtcaacagatttcacggaacctttaaccaaagaacctttgtcgttcacgctgatgaagttgccgaacggatcgccttccagttgtttgatacccaaggagatgcgttctttttccacgtcgattgccaatacgacggcttcgacttcttcgccttttttgtatttgcgtacggcttcttcgccggattcggtccaggacaggtcggacaggtgaaccaaaccgtcgatgccgccgggcaggccgacgaatacgccgaaatcggtaatggatttaaccgcgccggagattttgtcgcctttgttgtggttggcggcaaattcttcccaaggattggcttggcattgtttcatacccaaagagatacggcggcggccttcgtcgatttccaaaatcatgacttcgacttcgtcgcccagttgtacgactttgctcgggtgtacgtttttgttggtccagtccatttcggagacgtgtaccaaaccttcgatgccttgttcgatttcgacgaatgcgccgtagtcggtcaggttggatactttgccgaacaggcgggtgccttgaggataacggcgggtcagaccgctccaaggatcttcgcccagttgtttcatacccaaggaaacgcgttgtttttcttggtcgaatttcaatactttggcttcaacttcctgaccgacttccaagacttcactcgggtgtttcacgcgccgccatgccaaatcggtgatgtgcaacagaccgtcgatgccgcccaagtcaacgaatgcaccgtaatcggtaatgtttttaacgatgcctttgatgacggagccttcttgcaggttttccagcagggctttgcgttcttcacccaaagtggcttccagaacggcgcggcgggaaacaacgacgttgttgcgttttttgtccagtttgatcactttgaattcgatctctttgccttcgaagtgagaagtgtcttttacaggacgtacgtcgaccaaagaacccggcaggaatgcgcggatgctgctaatcataacggtcaggccgcctttgacttttccgttgatgatgccggacaggatgtcgccgttttccatggcttcttccagggcaatccaatcggctgcacgtttggctttttcgcgggacagtttggtttcgccgaagccgttttcgacggattcgatggtaacggtaacgaagtcgccgactttaacttcaatttcgccttgagcgtttttgaattcagctacatcaatcagggattctgatttcagacctgcgtttacggtaacgaagttttggtcgattgccactacttcagcggtaatcacctcacccgggttcatttcttgcagggtaaagctttcttccaacagctgagcaaaattttccatagacatatataactcttttcggtacaccgccaaggggtgcggggtgggttggtggatatctgccgtccttggcagggcagacgggtacataaggtttcagacggcatatgggggatttttatgccgtctgaaacgtaatttgtgcgattatacctgaaaatttaaacttcacgataccaatcaagcactttttttacagtttcttctatagtcaggcggcttgtgtccaaaagcagggcatcgggctgttgtttcaggggggcaactttgcggtttcggtctgcctcgtctctggcttcgatgtcggacaggatgcgctcgaatgccaaaccttcgcaggggatgccgatttgtttggcgcggcgttcggcacggattttggattctgccgtcaggaagattttaagttcggcttgggggaagacgaccgatccggtgtcccgtccgtcggcaaccagtcctttttcggtcagaaaatcgcgttggcgttgcagcagggcggcgcggactttaggcaactgtgcgactgcggatgcgcccatgccgatggcttctgtccggatgccgtctgaaacgtcttcgccgccgagcaggatgcggctgcctgaaaatacggcgggcagtttttttgccagttcggaaacgttttcttcatcgtgccatcccacgccttgtttttgtgcatatagggcagtcaggcggtagagtgcgccggtatcgagataatcgtatcccaatgcggcggcaacgcgggcggcaaccgtgcctttgcccgatgcgcccgggccgtcgatggcgatgactttttgtctgttcataagggggattcctgatggtttggggtatgggttttgccgtctgaaggatgtgtttcccgttggggcggattctacctgttttaaaggacgattgtctaagcagacggaacgccgcctgcccggaaacatccgacagaagccggcaagccggttcggatttcggcgttgcgggtattgtggcgggcatcaaggcaatgctgtctgaaagaggtatgaccttcagacggcatcgattgctgcggattagaacaggttgctgacgaaaatcagcagaatcaccagcggcacaagatatttcacataagcaaaccaaatattgaccgtcgtatggttgcctttataaagcaattcgtccttcgcttcgtccttcatcacaaaaccggcaaacagcgcggaaccgagcgcggtcagcataaacaagatgttgccgctgatgtagtcgaaggcatcgaaaatatttttgccgaacacggaacgtctttccacggaccatagctcagaatggacgggatgttgccgaaaatgaagatggcagccaatacaatcgtaatcgcggcggtacggcggattttggttttttcctgaatggtcgtaatcaacacttcataaatggtcagcgaagttgtcaacgcggcaatcaggagcagcgagaagaaaatcacggcgaacacagatcccgcccacatatgtgagaacacaatcggcaagctttggaacaccaaagtcgggccggaatcgggggcaacgccgaagctgaagagcgacgggaaaatcataaagcccgcaagtatggcgatgatggtattggtaattgccgtgataactgccgtctgaaccagattttcgtttttatccaaatagctggacaaggtaatcatcacgccgaaacccaagctcagggcaaaaaatacctgccccaaaacgaagacgaacagttcggcggtaatcttgctgaaatcaggtttcagatagaaagcaaccccttccattgcgcccggaagggtaacgttgcggacgaccatcgcgattaggaacaaaaacagcagcggcatcagctattttgccgctttttcaatgccgccgataacgcctttgaccaaaatccattggttcacggcgacaaaaagcagcgtataaaacgcaatttcccaagggctgtttcaatgtgttcggcaaagaagccttttgtaaccacaccgtcgacggggctggaaatattcaaatttcctccaataatattaacgatatagctgattacccagccgccgagtaccatgtaataagccatgatgccgaacgcgccgagcagcccatccagccgaccagtttccaaattttggcaatgggtttgccgttcatcgggccgccgaacgcatccagcgcgttcacgcctttgcgccgtccgatgacattttccaccaaaatcatcgggatgccgataaccagcatcgcgatacagaataaaaacacatacgcgcaccaccgttttcaccgaccaaatacgggaaacgccacgtcgcgccgaaaccgacagtcgcgccggcaacggtcaggatataggttaatcggctggaccaggtttgacgattggtatttgaaggggaagacatattgaaaccgtgtccgattgagataaagcggaaattctacacgcgttttttaacaggaactgactgattgcttttcaactgtctagtgattttccatgtaaaaggcatatatttcagtgagtatttctgatgagtataacccgatgaggaagaatcggagtttataaatagattaatttgttattcttctacatcggtgtatggaaatgaaattttgttaattatattaatgatagcatttaaataatgatgaaagagagggaatttgaaatatagtggattaacaaaaatcaggacaaggcgacgaagccgcagacagtacaaatagtacggcaaggcgaggcaacgctgtactggtttaaatttaatccactataaaaaaaccatctatacaaggggagaagtatagatggcaaaacacattacggggaaaacgtcttactcataagcctgcttgaacaggcgttactcagacaaatggattatatcgtaaattgattttttgcgttaaattgggttaaaccatatatttaatgagtatgtggatgaatataaatggaattcttggatgttatttcagaattttggacattcgataaatttccattccccgggtttgaggttttctgtttccagatgtgcgaatcgccggcgatgaaggtgttgcacgcggttgccggcggcggcgatcatgcgtttgacttggtggtattttccttcggtaatggtcagcagcagggtggtcgggtttttcaaaacggcatcggcggcacaaacggtttcgttttcgtcgtggagcagcacgccgtttttcaaggtttcgcagagcgtttctcctgtggggtgtttgagcgttacttcgtacagcttgggaatttttctgctcggcgaagtcaggctgtggttcagtttgccgtcgttggtaatcagcaatacgccggtcgtatctgcatccagcctgccgaccgcctgcatatcgatgttccgcatattgtcggggaacaggctgaatacgctgcggtagtgcttgggtttgtgcgaagtttcgtaatcttcaggcttgttgagcatgatgtagaaatagggttcgggaacgacggttactgcttccccgtcaatatccaacgtttcgacggatgaggaatcgatgtctgcatcggtgtcgtccatgcaggttccgttgatgaaaacataaccgccggcaatcagccattggcactgcttgcggcttcctatgccttgatattgcaggtatttgataagtttcatgatggtatgggaaatgtgggatgaaaaagacaggactgagaaagtcctgtcatgtgccgtatccgaatcagcttccaatcagtttgaccctctgtcccggattgatggtgttcaggttgggattgagccggcggatgtcgtcgatatggatattgaagcgcgcggcgatacttttgaaggtgtcgcctttgcgcgcggtgtaggatactttttcaatacgggtttgggcaggggctgcctgcgccaggcggagtacctgtcctttttggatggtgttgcctttgatgttgttggcgacaatcaggtcggctacactgacgttgtagcgtttggcaatgttgaacagggtgtcgccttctacaacgcggtggatgctggcatggagcggggagatttcggcttcgccgtcggcagctttggctacgcgcgtttccaaacgtacccggcgtttgccgtcggcggcagcggtatgttgcggagatgcggaaattttgtgttcggcaactgtgtcaggcgtgccgatgacggcggagatggtttcttcagcctgtcggcgcaggttgtttcgggcaacaagctgcatgagttcgtctgccgcctgcatgtcgttttgggggatgatctgcgcgagtgttgcggtttgggtttcagacggcatggcggtctgtttttcggtttgaggttgcgctgcggctgtcgcaagggcaggttcggcaatacggacaaggggatcgggttccgtacggacggttttctgcggcaaaggtgcgacggtaatgtccgctgtctgtgcggcggcgggtcggattcgggcaatgccgacgttcaccgtgcctgccggcatattggaacggtaggtgtcgggcgtattgtcgatgtcgatggaaacgacggattccgatgccgtctgaagggttttgccgttcttggcgacaaggatgctgcgtcctgcgttgacaaggttgccgttcaggttgttgaggcgtttgatgtcggcaatgctcatgccggttgccgtcgagatgtcggacaggctggttttggcggcaggcgtatagacttcccatgaaaacaggctgtcgggtgcggcgttgaggtagttgctttggaaggtttgtacggacgcgacaggaagcagcagtttgcgtttgcttttggggataaacgcggggacgttgaatgcggggtttagggcgagcagctcgctttgcgtgatgccggcaagccgggcgatggcttcgttgtcgagcggacgatccggttcgactgcctgaaaatagggtttgttgtctatgtcgctgatattcatgccgaaagattggggagtggcaataatgttgcgcacggcgagcagcttggggacatagttgcgcgtttcgttgggcatacgcaggttttcgtaggtcggttcgagcccttgggcgcgggcgcggttgatggcgcgtccgacgttgccttcaccccagttgtaggcggcaaaggcaagcggccagtcgccgaacagtccatagaggtattgcagatagttgagtgcggcatcggtggcggcgtaaacgtcgtgcctgccgtcgtaaaccggtgttttttccaggccgtaatgcctgccggtagcgggcataaactgccataatcctgatgcgccgacgtgtgatttggctttggtgacgaacgcgctttcgatgaagggaagcagggcggcttcggcgggcatattgcgttttttgacttcgttggcgatatggtacatatagggtctactccggttgatgaccctgttgaaatagctgtggcttgcgatgaatttgctttcgtggcggcgtaccagttcgggattgacttcgcccatccggaagccttggcgcagctcgccccacaggctgccggattggaaatattgttttgtcgggggcaggtcgagtattgaagagtttaagcgcataatcgccaaaccgatttggtgtgatgaggtgttttgggcgtataggaaacccggacaaacggacagacctgatgcggtcagagcgatggttttgagtttggacatgatttatattcggcggaataaacatattttatcgtccgatggtactgtttgactgaaaaagcgtcaagttttacaggaactttatgcggattcggaaatgggcggccgatgtgttttttgacagaaatcctgtttggaatagaatatcggcaggcaatctgtttgaaacggacgcaatatggatgcatggtttgaagatacggcgatggggcggtatgttgcaaaattggaacaggatttcttcgggcggtatctggattcataccgtttttcgggaatgtgtgcggttcaggtgggcggtccgtggctgagcctgtctgaagatgttgtctgtgtgccgcgagatatgtcgatgtcggcggagaatatggctttggcggatgtttctgcggatatgctgctttttccgcatacgcttgaaggcggtgttccttcgcaaatcctgtcggaagcgcaccggatattgaaaccgtgcggacgcttgatgctgacgggtttcaatccgtattcgctctggggattcagccgttggtttgacggcgaacgcctgccggaaaaacggttttgtctgccgctgcccgagttgaaaagacggcttgcggatgtcggtttcgatattgaatttgggaaatttatggtgtatctgccgccggtttcgtcgctcgggcaaatacgcttttggcggtttatggaaaaggcgggcgaccgttggtggccgcagtgtgccgcagtgtacggtttggttttggtcaaaagggcagcgggcgtaacgcccctgcccgcgtgggacgggtatttgggcggcaaagcccttgcggcgggtgcggcaagggttgcggattagggacagccgtctttcagacggcatctgtcagaagaaatgtcgggaggggttatgcctgaattgccggaagtggaaacgacgttgcgcggcatcgcgccgcatattgaagggaaaacggtggaagccgtggtattgcgccaattgaagctgcgctggcagattaatcccgatttgggggagattttgtccggccggcaggtgttgtcctgcggcaggagggcgaaatacctgcttatccgctttcaaacgggcgtgctgctgattcacttggggatgtcgggcagcttgcggatttttacgccgtcggacggacgtatcggcaggccggacagacacgatcacgtcgatattgtgttttcagacggcacggtcatgcgttaccgcgatccgagaaagttcggcgcgatactttggtatgagggaatcgaagaacatcatccgctgttggaaaaactggggccggagcctttgtcggaggcattttgtgcggattatctgtatgcaaggctgaaggcgcagaagcgcgcggtcaaacttgccctgatggacaatgcggtcgtggtcggtgtgggcaacatttatgccaacgagagcctgttcagagcgggcatttcgccccaccgtcctgccaaccgcctgaaaaagaaagagtgcgcgcttttggttgaaaccgtcaaagcggtgttgcagcgcgccattgaaacgggcggcagtaccttgagggattttgtggacagcgacggcaaaagcggctacttccaacaggaatatacagtgtacgggcggcacaatcagccgtgcccccggtgcggcggtttggttgtgaaagaaactttggggcagcgcggcacgttttattgcccgaactgtcagaaataggactgaaaacggtttcagacggcattttatcggtatgccgtccgaacgtttcaacaacaaacaccgattatcgggaaagaattgctcatgtcttcaaataaagcttcattttttacacgtctgcgccgcttgtgccgtttggcggtctggctgttcaaaaccgggaaaaacctgcgcggtattgacggcggttgccccgagtcgcgcaatcgggcggtaatcgagttgggcaggggggttttggcggctttggatatcggattggaggtgggcagacccgcacccgaacatccgaacggtgtcttggttgccgccaaccacgtgtcctggctggatattttcgcgatgagcgcggtttatccgagcagctttatcgccaagcaggaaatcaaaagctggccggtattgggcaagatggggcagaacgcgggaacggtgttcatcaaccgcaattcgcggcgcgacatcgaaccgattaaccgcgccgtctgcgaaaccttgcaacgcggtcaaaacgtcagttttttccccgaagcgcggacttcctccggattggggcttttgccgttcaaagccgcgctgttccaatccgccatcgatgcgggggcaaaggttttggcggtcgcgctgcgttattatgacgaaacgggaaaaaggacggctcgtccctcatatgccgatgtcggtttgccgacctgcctgtggcgcatcgtgtctatgaaaaaattgacgataagagtcgatttcgtttgcgtggcggatgcggcggaaagcgaagaccgttatgctttaaaagataaaatcgaagaaagcatccgtgccgttgtcgccgacgatgcggatatcgctgtctgaaaccggttgtcggaatgtggcagtatgattcgcttttgtggatgtatagtggattaacaaaaaccagtacagcgttgcctcgccttagctcaaagagaacgattctctaaggtgctgaagcaccaagtgaatcggtttcgtactatctgtactgtctgcggcttcgtcgccttgtcctgatttttgttaatccactatattaaggctgcggcaacgggaggacctcaaacgaaatggcgtaaggatagtttgttgtatctatggaaaatgccgtctgaacctgtgttcagacggcatattttatatgggattaacggcggaaactgccgccgtcgaaatcatcgaaagcctcataagccgcccggcattggattttctgttccgcataaggcagggagcggaatgctttgcgcgcctttttgttttcgcgcaattcctgcacgttgccttgcgatcggtaccacgcggcacggcgttccaaatatttcctgcattcggggtgcagcatctgcttgtttgccttgcggatatgtttggtatcgcggtgggcgggttctgacgtaccggcagcggcagttgtcgataccagtcccaatattgcagacaacagtatggcaagcatctttttgacagacatgacgatcctttcagtttgtcattctttccagtataggatggaaggatggaacgggcaaattgtcggcagtttcagactcattcagccgacaaaacttgccgtttgatatgcagattcaaataacacattaatctcaataataaattccaatcggtaagaaaatggaatttgtcggcggcggcgcggcaaaatcatactttgcaaaatttaacaatttgcaggggcagaaaacaggaagctttcctttttcgtcggaaaatccttatttcaccgccttgtagccggagccggtcaaaaggcaaaaaatttacccgttttttatcggtaaagaattatcagataaaacaaatattataggaaaaatacgacaggcgggttttatcgcgcattgcctgaaactgaaaaatacaaccgttgtcaagactggagaaaatgccaaaaatccactatattgtctgccttaatttatttgaaaagactgtgtcttgaatatcaagagtggaagaggaagcgatgaatacaccgactgatttgaaagtaaccaaacgagacggaagattagaagccattgatttggataagattcaccgtgtcgtcacttgggcggcggacggattggaaaatgtttccgtgtcgcaggtcgagttgaaatcgcacatccagttctacaacggcatccgcaccgacgacatccacgaaaccatcatcaaagccgctgccgatttaatttcggaagataccccggactaccaataccttgccgcgcgtttggcgattttccatcttcgtaaaatagcctacggcgagtacgagccgccgcacctttacgaccacgttaaaaaacttaccgatgccggaaaatacgacaggcatatccttgaggattacagccgcgaagaatttgacgaactgaacgcctatatcgaccacgaacgcgatatgtccttttcctatgccgctgtcaaacagctcgaaggcaaatatctggtacagaaccgcgttacccgccaaatttacgaaacgccgcagtttttatatgttttggtggcgatgtgccttttcagcaaatacccgaaagaggcgcgcttgggttacgtcaaacggttttacgatgccgtttctacatttaaagtatcgctgccgactccgattatgagcggcgtgcgtacgcctacgcgccagttctcaagctgtgtgctgattgaatgcgacgatagtttggattccatcaatgccactaccagcgcgattgtgaaatacgtttcccagcgtgcgggcatcggcatcaatgccggacgtatccgcggtttggacagcgaaatccggggcggcgaagcgcggcataccggctgcattcccttctttaaaatgtttcaggcggcggtcaaatcctgttcgcaaggcggcgtgcgcggcggcgcggcaaccttgttctaccccttgtggcatatcgaagccgaaagcctgctggtgttgaaaaacaaccgcggtgtggaagacaaccgtatccgtcagcttgattacggcgtgcaaatcaaccgcctgctgtacacccgcctgattaagggcggcaacattacgctgttttcgcccaacgaggttccgggattgtacgaagcgttttttgccgaccaagacgaatttgagcggctctatacgaaatacgagcaagaccctgatatccgcaagcgcatcattccggctgccgacctgttttccacgctgatgcaggagcgtgccggaaccgggcgcatctacattcaaaacgtcgatcactgcaatacgcacagcccgttcgatccgcgcgtcgcgcctgttcatcagtccaacttgtgtatggaaatcgccctgccgaccaaaccgctggacaatatcaacgatccgaacggcgaaatcgccctgtgtacactgtctgcctttaacttgggcgcattaaacagcttggacgaattggaagggcttgccgacttgaccgttcgtgcgctcgatgcacttttagattatcagggatatccggtagaagccgcgcgtacctctactatgggccgccgttcgctcggcatcggcgtgattaactatgcttattatctggcgaaaaacggtgtccgctacagcgacggttccgcgctcggtctgacccaccgtacctttgaagccatacagtattacctgctcaaagcatcggcaaaccttgccaaagaatacggtgcgtgcacgctctttaaccaaaccgtttattcgcaaggcaaactgcccatcgacacttacaaaaaagatttggatgccgtctgcggcgagcctttgcattacgactgggaaagcctgcgtgccgaaatcgtcaaatacggcctgcgcaactctactctgaccgcgctcatgccgtctgaaaccagctctcaaatcgccaacgccaccaacggcatcgagccgccgcgcggattggtaacggtcaaagcatcgaaagacggcattttgaaacaagtcgtgccggagtttgaaaccctgaaaaatgcctatgaaaccctgtggcagcttcccggcaacgaaggctacctgaaacttgtcggcgtgatgcaaaaattcgtcgatcaatcgatttccgccaataccgcctacgacccgggcaaattcgaaggcggcaaagtttctatgaaacaaatgctcaaagacctgctgaccgcctacaaatacggcgtcaaaaccctgtactaccataacacccgcgacggtgcggacgatacgcagaccgatattcaggatgacggctgcgcgggcggggcttgtaagatttgatgaaagggggagttttcagatggcctttagattaataaatcatctgaaatataaaatatgaaaaataaaatacaaaatcaattagataatatagttaccttaaataatgagaaatttacttttattgatttatttgcgggaataggtggttttcgcattgcaatggagaatgttggtgggcgatgtgtattttctagtgaatgggatgataaagcccgtcaaacctaccaagtaaattttaatgatattccttatggagatattacattaaaggaaaccaaagcagctattccaagtaagtttgatgtattaacagcaggattcccgtgtcagccattctctatagctggtgtttcaaagaaaaaaagcctaggacgagaaacaggcttcttagataaggcgcagggaactctattttttgatgttgctgaaattattggaaaacatcgacctaaaatttttcttttagagaatgtgaaaaaccttgtttcgcatgacaaaggaaatacatttaaagtaattaaagggactttagaagagcttgactatcagatattttatcaagttatgaatgcaaaatattatgttcctcaaaatagggagcgtatttttattgtaggttttgatagacaatattttaataaggaaataaatttcaattttccttccccaccagaatcacaaccaaaattaaagcaaattttggaagatgatgtagataattcttttactctttctgataacttatggctttaccttcaaaattacgctaaaaaacataaggcaaagggtaatggatttggttttggattagttgatttagatggaatatcacgaactctatctgcacgatattacaaagatggttccgaaatactcatccctcagaaaggaaaaaatcctaggaagctgacacctagggagtgctcgcgtttaatgggatttcctaaagattttgttattgatgcagtatccaagacagctgcatacaagcagtttggcaattcaattgctgtaccgttggttcaagctattgctaaacaaattataaatgagttaaaaaatgaatgacttggcagctcagacaatacaagtagtaaataaatccgatgacttagtagcttcagcaatacagacagcaaataaatcaattgcagtatactgtcgttatattcgtcccaatgatgttggtactactggtagtcaccaatcaggattttatattcaaaaacatttttcagacgacctctttgatgtagtttgccaaaagggaacaaataaaactatttcaatcaaaattaattggcaagatggaagcgtcactaatagcaattttaaatattacggccaaggcacgagaaatgaggcgagaattacgggttttggcaagaattttgaatttttaagtgataaatatagtggttccttattggtattgtgcagagcttgttataaagatttattattccatgcttttgttttatcttcagatgaagatattgaaatatttatcgcagaaactaacattttaccaggaagtttatatttacctaaaaaacaagaagtagaggataacctaacaaaattattttcactatttcctaacttccccaaaactgaagaaatggcagttttggcaagggaaaatattgcattaaataaaactaacgttagtaatgtgttaaaacaatgggtttcaaaggaatatgaattattttccatttttgaaaaacgtgaatttgaaattattaaatcaaaaattactgatttggatagcttcattaattttgcacattcttttacaaatcgcagaaaagcaagagcaggaaaatctttagagttacatttatcaagaatatttgacgaattttccttaaaatttgagacgcaagcgaagacagaagggaaaaagaaaccagattttttatttcctggaagtgaagagtaccatgcgatggatgaatcagggaatttcatatttcaaactgaaaagctgacaatgctaggttcaaagactacttgtaaggatcgctggcgccaagttttaaatgaagcagatcgaattcctcataagcatttatttactctacaagaaggtatatctgatactcaaattcaggaaatgagtgatgagaatttaaccttagttgtccctaaagaatccgtaaaaacatttggaacttttgggaaaacccatgttttaactttagaaaattttattaaatatataaagtctcagcaggttagttaaaacttacagatcatttttaattaatatagagaatagattatgtcctgcgaacacttaactatgtcatacagcacctttcccaaaaccaaaaacgacgcgctgaatgagccgatgttttttggtcagccggttaatgttgcccgttatgaccagcagaaatacgaagtatttgaaaaactgattgaaaaacaattgtctttcttctggcggcctgaagaaatcgatgtctcgcgcgaccgtatcgactacgccaatctgcccgaacacgaaaaacatattttcatcagcaatctgaaataccaaacactgctcgattccatccaagggcgcagtccgaatgttgccttgctgcctttggtttcgattcccgagttggaaacgtggattgaaacgtggagcttcagcgaaaccatacactcgcgcagctatacccacatcatccgcaatattgtgaatgatccgtcggtcgtgtttgatgatattgtcgaaaacgaatacattaccgcccgcgccgaagacattgcctgctattacgatgacttaatcgaatacacccagtattacaacctgttgggcgaaggggtgcacaatgtcggcggcaaacccgttaccgtgtctttgcgcgggttgaagaaaaaactctatctctgcctgatgtgcgtcaacgtgttggaagccatccgtttctacgtttcattcgcctgctcgtttgcttttgccgagcgcgagttgatggaaggcaacgccaaaatcatcaaactgattgcccgcgacgaagccctgcacctgaccggcacgcagcatatgcttaatctgatgcgttctggtgttgatgattctgaaatggcagaaattgccgccgagttgcaggacgaatgtttccaactcttcaaaaaagcggcggaacaggaaaaagaatgggcggcatatttgtttaaagacggttcgatgattggtttgaacaaagaaatcttatcccaatacgtcgaatatattaccaatctgcgtatgcaggcggtggggttgccggccggatttgaaggcgcaaatcaaaacccgattccgtggattaatgcgtggctgtcgtccgacaacgtacaggtcgcgccgcaggaagtggaaatatcctcttatttgatcggtcagatagattctgaagtgaatacggatgatttgggcgattttgagttgtaaatgttttttgaaaaaatgccgtctgaagccggatgtttcagacggcatttgtatgttgtatgatgggaaaaacagcgggtaggatcggttattgttccttttatagtggattatagtggattatagtggattaacaaaaatccggacaaggcgacgaagccgcagacagtacaaatagtacggcaaggcgaggcaacgccgtactggtttaaatttaatccactatatttttgattggtcggaaatggcgcgcattggtacgaataagggtttttttgaactcttggagggcgagactctgttggaaggcttggaacggacggggcatatggtggaatatcagtgccgaagcggatattgcggatcgtgccgagtgaagattttggagggaagcgttacttatcgggagccgcctttggcttttttggggcgggacgagatactgccgtgctgctgttgcgtcgagggggatgtcaggctggattgcggtttgtcgggggaggatgaggggctgtctgacagtttgttgaaataaaagccgtccgaacattggttcggacggctttttgacggtattaccggttatgcctgatgagtcggtaaaaggtttcaccgtcttggatataacccagttctacccgggcgatttccgaaatggcttcttgaccgttttccaaatcatagacttcggcggcaagggaatgattgcgtagggcgagtgtctggtttttttcttcttgaacggcaatctgttctctcagactgctgttgcgtccgatgctgcctttgccgaaccagaggctgtattggcaacagacaagtgcgaaggataaaacgacagttacccacttcataccttaaccttttttatttgcccagttggtagaatgcggctttgctggggtagtcggcggcttccgccaattcttcctcgatacgcagcagttggttgtatttcgccatgcggtcggaacggctcaaagaaccggttttgatctgcatacagttggtggcgactgccaagtcggcaatggtgctgtcttcggtttcgccggagcggtggctcattacgctggcgtagcggttgcgtttggctaagtcgacggctttcagggtctcgctcaaagtaccgatttgattgactttgaccagcaatgcgtttgctacgcctttttcgatgccttcggccaagatttttggattggttacgaacaagtcgtcgccaaccaattgaactctaccgcccagtttttcggtcagcagtttccagccttcccagtcgttttcatccatgccgtcttcgatggagatgatggggaactcgttgaccaggccttccagatattcggcaaattccgcgttggtgtaggagcggccttcggcttccaagtggtatttgccgtctttgtagaactcgctggaggcgcagtccaatgcgaataatacgtcttcgcccgctttgtagccggcggcttcggtcgcctcgaccatcagttgcagggcttctttgtggctgttcaggttgggggcgaaaccgccttcgtcgccgactgtggtcgggaagcctttgctgtcgcacagttttttcaaggcgtggaaaatttccgcaccgcagcgcaacgcttcgcggaaagattttgcgccgacgggcataatcataaactcttggatgttcaggctgttgttggcgtgttcgccgccgttgatgacgttcatcatcggtacgggcagggacatcgggcctgcgccgcccaagtagcggtaaagcggcaggcctgagtcttcggcagcggcgcgtgcaaccgccatagaaaccgccaaagtcgcattcgcacccaaattgcctttgttttcagtaccgtccaattcgatcatgatttggtcgatataagattgctcgttggcatcgataccaatgagggcttgggcgatttggttgttgacgtgttcgaccgccttcaatacgcccttgcccgaataacgggatttgtcgccgtcgcgaagttccaaagcctctttttgaccggtggacgcgccgctcggtacggctgcgcgtcccattacgccggattcgagcaatacatcacactcgactgtggggttgccgcgtgagtccaaaatttcgcgggcgaaaatatcaacgattgcgctcatgaatgttctccaagtgaagtgaagggaggtaaaaaaatgggagggcttcagacggcatctttgccggaaagccgccaacttaaaactgctgaaagtagggcggttgccataaaaacaatactggaaatgccgtgccacattccgaaggatccgcctacaaacgacaacagccaattttcatgtccgtatttcagtgcctcgataacgggtgtaatcaagaatcggttggcggcaagggcggacaataaaaaaagcagcagggcggtttgccgccgggttagggcggcaaaggcggcagccagtaccgcgccccaaacggcaagcccgctccaagagaggatgtcgaacaatacgccggcaatttcgcccgcctgcattttgggcagcattttgaacagcaccggtgcggcgatataacccgccataatctgcataccgagccacaaggttgcgacataccggctgatttttcggaaagtctgcatcataaggcgaaaccgtgttactcgattgttaaaatcggttgtgatttgattaaatcgtccaatgctttgatgcggattaaaaaatcttctaaaaggtgcagcggcagcgcgctggggccgtcgcattttgccagtttcggatcggggtgcgattcgaggaacagaccggcaaggcgggttgccatgcctgcaagtgccaaatccaaagcctgtgcgcgacgaccgccggatgcggcagaaccggcatcgcgggtttgcagggaatgggtaacgtcgaaaataaccggcaggttgccgcaagtctgtttcatcacgccgaaaccgagcatatcgacaacgaggttgtcgtagccgaagctgctgccgcgttcgcataaaatcagtttcccgttgccggcttcgtggaatttttccacaatgtttttcatttgagaggggctgaggaactgaggttttttgatgttgacgacgttgccagtttttgccatggcaaccactaaatcggtctgccgcgcaagaaaggcgggaagctggatgacatcgcacacttcggcgacgggttggcactgatggggttcgtgtacgtcggtaatgacggggatgccgaactctgctttgactttttcaaaaatctttaagccttcttccaagcctacgccgcgataagaatggatggaggaacggtttgccttgtcgaaagaggctttaaagatatagggaataccgagttttcgggtaacttcgacgtaatgcgcgcaggtttggagggtggaatccaagctttccaaaacgttgatgccgccgaataggacgaagggcgagttgttgccgagggtgatgtcgttgattttaatatccataatcgatgtccgtttgcggaattacagcacggtgtgcggcggctcgtaggagatgatgtcgcggattttgttgtttccgtctaccaagacgactttgggttcgtgtgcggcgatttcgggttcggagagttggacgtaagacatgatgatgacgatatcgcctttctgtaccagcctggctgcagcaccgttcagacaaatcacgccgctgccgcgtttccctgcaatggtataggtttcaaaacgttcgccgttgttgttgttgacaatggcgactttttcgttggggtagatgcctgccgcgtctaacaggtcttgatcgacggtaatactgccgacatagttcaaatcggcttcggtaacggtggcgcggtggatttttccgccaagcatggtacggaacatgtatttccttttggtttgtgtgcggtttgacgggcgcgatgccgtctggaaatctgaatgccgtattatagtggagtttccttcaaattcataatggcggctttcggacaaggaaaacggtgtttcagacggcattgcggtgtcggctttatttgggcaggcatctgttttgcaaggtttttaaaacgttttttacggtgttgattctgacctcgatattttccatctctgcggtaaaccgcagcttatcggcgccggcaaggcggtattttttgtcgttctgaatcagcaggatgatttcggttggatcgacattattgtttttaccaaaggttaccgttaccgcttcgccggccgcatcaatggcatcgatacccaattcttttgccataagccgtaagtggtggctttcgataagggttttgacgggttgttcgggcaggccgaagcggtcgacgagttcttcgtgtatggtgttgatttgttgcacggtttcgcagacggcgaggcgtttgtagaggacgagccgttcgtggatgtcggggcagtaatcttcgggcagcagggcggggctgtgcagtttgatttcggtggtgatgcccaacggtgcgtcgaggtcgggctggcggccttttttgaggtcgcgaacggcttgtttgagcatttcggtgtagagcgtgaagccgacctgtatcatttcgccggattgtccttcgccaaggatttcgcctgcaccacggatttccaaatcctgcatggctagggtaaaacctgcgccgagttcgtctgccgccgcaatggcatcgaggcgtttttctgcgtctttagtgatgtattcgggcgtgagcaggtaggcgtaggcttggtgatggctgcggccgacgcgcccgcgaagctggtgcagttgcgccagtccgaatttgtcggcgcggttgatgatgatggtgttggcgttggggatatcgataccggtttcgatgatggtggaacagagcaacacgttaaatcgttgctgcaaaaagtcgcgcatgacttgttccagctcgcgctcgcgcagttgtccgtgcgccacgccgatgcgggcttcgggcagcagggtttccagccgctcgcgcatattttcaatcgtatctacttcattgtgcaggaaaaatacctgtcctccgcgtttgagttcgcgcaacacggcttcgcgcacgctgccttcgctaaagggtttgacaaaggttttgacggcgaggcggcggctgggcgcggtggtaatcagcgagaagtcgcgcagtccttccaacgccatacttaaagtacgcggaatcggcgtggcggtcatggtaaggatatcaacattggcgcgcaggcgtttgagctgctctttctgacgcacgccgaagcggtgttcttcgtcgataatcactaaacctaagtttttgaatttgatgtcgtcctgcaccagtttgtgcgtaccgataacaatatcgaccgtgccgtctgccatgccttccagcgcggctttggtggctttgctgttgttgaaacgcgaaaggctggcgactttcacggggaaatcggcgaaacggtcggcgaagttttgcgcgtgctgctcgaccaaaagcgtggtcggagcaagtacggcgacctgtttgccgcccatcaccgccacaaacgcggcgcgcagggcgacttcggttttgccgaagccgacatcgccgcacacaaggcgatccatcggcttcgcttgcgtcaaatctttaatcacggcggcgatggcggcggcctggtcttcggtttcctcgtagccgaagccgtcggcaaacgcctgatagtccaactcgttgatttcaaacttgtgtcccgattgggcggcgcgttgggcgtagaggttgagcaattcggcggcggtgtcgcgcgctttttcggcggctttgcgcttcgccttgttccacgcgccactgccgagcttgtgcagggcaatgttttcatgcgcctgaccggagtagcggctgattaaatgcagttgcgaaacaggcacataaagctgcgcttcgcctgcgtattcgagcaacatcatttcgttggtttcgccgcccaagtccatcgttaccaagcccatataccgcccgatgccgtgttcttcgtgcacgacggggtcgccgatattgatttcggcaaggtcgcgcaacagcccgtctgaaacggcggcgtgtttcttgcggcggttgtggatgcgcgaacgggcgacgtattggtagagatcggattcggtgatgacggcgatggcactttgagcggcaactgctttgccctctccccaaccctcccccacgggggagggggcaggttgctgttggatttgcccgtgcagattacttttaccggggggcaggctgctttcggttgaaacggcggctgctttcagactgtctgaaacgacggctgcactttgttccctctcctgtgggagagggctagggagagggtttgttgcggctgcggaaaattcggtttgagcggcaactgctttgccctctccccaaccctcccccacgggggagggagtaggttgctgtcggatttgcccgtgcagattatttgcgacgggatgcaggctgcttttggttttcaggtcgtctgaaacggcggctgcactttgttccctctcctgtgggagagggctagggagagggtttgttgcggatgcgggaaattcggtttgagcggcaactgctttgccctctccccaaccctcccccacgggggaaggggcaggttgctgtcggatttgcccgtgcagattacttgtaccgaggggcaggctgctttcggttgaaacggcggctgctttcagactgtctgaaacggcggctgcactttgttccctctcctgtgggagagggctagggagagggtttattgcggctgcggaaaattcagtttgagcggcaactgctttgccctctccccaaccctcccccacgggggagggagtaggttgctgttggttcggcgattgcagtccgcccagtttgaacccgtatgccaacggcgccactgtaatcatcagcggctcgtgtgccgataaaaagccctgccagtcggacacgggtttggctttcaaaccgttttgctgcaagaaaccgagcatagtttcgcgccgtcccaaactttcggcgcacagcaaaatccgtccgtcaaacgccgtctgaaaatccttcaatgcctgcaacggctcatctgcttggcggttgacggcaaggtcgggcagggtgtattccttgccggaaacatcgggcagcacctgtccgtagtttttcagacggcctgcgaacacatcggcagagagatacaaatactgtggaagcaaaggcggataggtttcgtcgccctgcgccatcgcgtaacgcgatttgacatcgctccaaaaacggtttgcctcggcatgaacatcgtctaaagagacaaacagcgcatcttcgccgatatagtcaaacagcgtttccaactcgttttcaaaaaacagcggcaggtagtattccacgcccgcgccgaaatgaccgttgctgacggctttgtacacagccgcatcgttcggattaccatcgacttcctcgcggaagcggctgcggaagattttttgcgcctcgctgtcggtggggaactcgtgcgccggcagcaggcggatttcggaaacgggggaaatggtgcgttgcgtttcggtatcgaaggttttgatgctgtcgatttcatcgtcaaacaaatcgatgcggtacggcatttcgctgcccatcgggaacaaatcgactataccgccgcgcacggcaaattcgcccgccgcgacaacgtgggaaacatggttgtagcccgcatccaccaaatcacttttcagacggcctatatccaaagtctgccccgttttcagccaaaacgtgcgccctgccagaaacggcacgggcggcagcttctgcatcgccgtggcaaccggcacgaacaacacatccgccgcgccgcttttaatctgccacaacgccgacagccgctccgacaccaaatcctgatgcggcgaaaaacgctcgtaaggcagcgtttcccagtccggcaggaacaccgccgtgtcgtgcggacggaaaaaccgccatgccgtctgaaggcgcaacgcctgttccgcatcttgggtcagcacgaccttgagccgcttgtgcggcagataacgcgccaaagccaagggcagcgagccttgcgaaagattgggccaacgggatttttcacggggtttggggatggggtaggtcatagtgcggcaatcggcggacagtgatgcaaacggtcattttagcacgggaggggacgcgatgccgtctgaaaggtcggcggattgttgcccggcgcactttgtggtaaagtttagaaaatcaactctaaactgtggcaggcggtttgaccggccgccgattaatgggaaccgacagaggaagccgatgatacacaccgaaccgagcgcgcagccgtcaactatggacacggctgcttttttaaagcacatcgaatccgcattccgccgcattttttcagacggtatcgacctgatgcgatacctgcccgaagacaaatggcttgccttgaagcaggcgggtttgctgttgcccttcctcgacaaaaaatacggcgggcgcaagggcagccagtttgaaatccaagaagtcctgcggattgcggggcattacggcgtgcccgttacgctgcgtaccggcatcgaaggcgcgctggtgttgcagccactgcaagagttcggcgatgaagcgcaagtcgcgcaaggtttggagatgattttcaaaggcgagggcggcggtttgggtgttaccgaacccgaaacctccggcgcggcgattgcacgcgaaatgcagtcctactacgaatatatcgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacatccttgaaaatctggaacgatacgtccgcaacgacatcaaattcgtcgattacgaacgccgcgaaatccggcgccgccatcaggtttccgagattctttaccgctacgtctgccattccgtttcgcctgttgcccccgtcgcccatcagctgatggaggcgaacatcgtcaaaaccctcgccacggaatacacttacgccgccgcgcaaatgttgcaaaaactcttgggtgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcctgaagacatccgcagcttcctgcaggaacacaccctgaccgatgcctgcgccctgcaaaaagtctttatcggcaaaatcatcgcccgactctttgtcttcgtacaggcgaaacacgaagacaccgcagccttcctgctgaacgacatccgcaaagatatattggactgccgatattgcgggtagcgggcaaatacggcggcaggcaatgccgtctgaaaggggaagtgccttcagacggcattttcggcgacgacatacggatttcgggcggtgcaagaggcaacgtgcggcattccgcaaagccgccgattgcggcggatgccgcatttcgcgccgcccccttgtgccgctttcccacttaccctatttgttcggaacatatttatgaaaaagagaaaaatactgccgctggcaatttgtttggcggctttgtctgcctgtacggcgatggaggcacgcccaccccgggcaaatgaagcccaagccccccgcgcggttgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaacgtcggcgatgtcgcggcatcggttgccaattatatgaagcagcacggttggcgcacgggcgggaaaatgctggtgtctgcaacattggcgccgggtgcggatgttcaggcaatcattggcgaaaaaaccgccctgacgcggacggtggcggatttgaaggcgtacggcatcatccccggcgaagagcttgcagatgatgaaaaggcggttttgttcaaactggaaaccgcaccgggcgtgtttgaatattatttgggcttgaacaatttttatacggtatggcagtacaaccacagccggatgtatgtaacggcggtcagggacattgccaattcgcttggcggcccgggattgtaatgttttttaaaatgccgtctgaaccacgtttcggttcggacggcatttttgcatccttttatggggatttcccgcatcagggcggtattcggggcgaatcccgcttcagacggcattgccggtcaaggcttgtccgaaggaggatgtccctgttctttggcgggcgggaggaaaagtatgcagggattgcttttaatctgattccaaaaacttttaatcagattgcggatgctgccgattttcgtgccgcgcgagcgcagggcgacgaagagggcgaggctgaagctgacgcagaggttgaccaggccgatggcgaggacgctgaaaatgccgagtacgaacgtgcccaaaccgacgttgccgctgacggcggcatagccgaggttggcggaggaaaaggcgacgtggcggatgtccagcggcagcccgaggaggtgtccgaaatagccggtcatacccaagagcatcccgaagatgaagttgccgaccagcgagccgtagtgtttgtggatgtaggcggcgaggacgcggcggggcccggggcgcatgattttacgcagcaaggggttgaagggcaggcgttggcgcaggttgaggtagtcggcgcggttgtcgaaaaaacctgcgatgatgccggagcagaacagccacagacctgcaatggcggcataccacagcgtcgggtaagcgatgatgtctatggatttgaactggtaggcggcggtgtgggcatcgagtatgggcagccggtacagatgggcatagccgaacgatatggcgcacgccaaaaggatggcgatggaaacgttgccgaagacggcgacactttgggagcggcatacgtcgatgaggagcttggcgagtttgttgtccaccgctttgccgccttcgttgagatcgacctgttcggcaaagctggcggcagtcatcgcgggctgcttggtggcgacggtgcagtgcagcatatggatgatcataaagccgatgccgtagttgaacccagccgacaaggaagtgaggaaggggctgaggccgagtgagccgatgcggattttgagcagcgccattagggcgatgatgatgccgccgcctgccgccgagtagaacattttgaaatattctttgcggttgcgggtgatgtagtgttcgccgtggtggcttttgttttcggtaatgctgcgggcgagcatacggatgctgctgcggcgcaggtggcgggtgctgtattgttcgaccgccgcgtagatgagggagttcatcagcgcgatggtcaggcggttgctgttgccggcgccggtttggatgtcggtgagcagcttcagacggtctacggtctgccggagccgttcgagcaggtgggcgactttgaccgacgaaccggagccggcgcccgtccctttgcggcgcaaatagtcaatctggctgaaacattggtcgaacatcacttcgaggtgggcggtgtcgtaaggcgtggtgccgttgcggtagtgttcgaccagtttggcggtttcgcgttggagggcgacgaaggaagaatcggcttccagcaggcgcggggcgatgcggatgaggtcgggttcgatggcttcggatgccgtccagacagacagcatttcgatggcgcgcaaacgcgcatcggcaaggcggatgcccgccgtctgcaatttggacggctcggcgtggctccggatgagttcgtataaaaccagccattggcggatattgagcgtttgcagccatttgtcgtcgttttcggaatggaaaagataaaggaagacttcgcccaagttggcaaaatctttatatgacgggctgaagcgttcgtagatgcgtatgcccatttcccgggcaaagctgtggcgcgagaagatgccgagtttgatgagtgccggataaatgtgtatttgcgcgagccaaatgtaaaaacaccggctgaagcgggacagtaattccctgtcttgtttgaatgtgtcgataatcaggtcgaaacgttcccccgcacattttttgccgccacggcgcaaaaatttaatcagtgcgttgaggacgttgacaaaatcggtatgtcccaagctttccgaaagcagggggcgcaggttttgaggggtaattttcttcatatcagccattgtaccgcatcggcaatccggcgttaaacgccccgatagcggggagggcgcgcctgcggtgggcggcgcattttccgccggtttgaaatcaaactatattaatgatataataaatatcgataaatcaatctgatagaataatccgtattgatttttaattttttcgattataacaatttcggccggtttgtgcatttcgtcatccggaagccggtattttaccggcaggttttgaccgctttgcccgatgaccgggtttgtctgtttttaacaaaggagtgagaaggtttgtccctgtctgaatttatagaacgccgaacgtcatttaatccgatggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcagcgtgcaggttttgattatcgccgccgtcatgtccctcgccgtcgtttcggcaatatccggcgtggggaagggcgtgaaggtgttgagcgagttgaacctgggccttgcgtttttgctgctgttttttgttttggcggcgggacccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggttaaccctaccagtgtattttggacgggcggcaagtggaaagaacggctggtgcagataatgagccagacgcaggagcaggatattttaaaattcctcaaacagactgcatcgcccgctatgcacgagttgcaacgggagctttcggaagaatacggcttgagcgtccgggtcgataaaatgtttcatcgggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaaatgccctccctccggtgtttgtcaaaaaaatgcggtgaatcagattcaccgcatttttttgccggacggggcttcggacggcacggcgttcatttgtttccgtcaaactgctccttcaacacccgtttcaataccttgcccgtagcgttgcgcggcagcccgtctttaaagtggatttgtttggggattttgaaatttgccagcacggtacgcaggtggcggcggatttcgttctcgcccaaatccataccttccttcaattggacgaaggcgacgatttcctcgtcggcataacggtctttcacgccgatgacggcggcggcttcgacggcatcgagtttgtagatttcttcttcaatctcgcgcggatagacattttgacctttggaaataatcaaatcttttttgcggtcgacgataaagataaagccgtcttcgtctatggtaacgaaatcgcccgttttcaaccagccgttgacgatggtttcatcggtggcggcaggcatattgaggtagccccgcatcaccgaaccgcccctgacgatcagttcgcccacttcgccgcgcggcacttcgaccaattcttcatcgacggctttggcttccaaaccgggcagggggatgccgacgctgcgggctttttgcctctcgggcgtattgacggcgacgacgggagaggcttcgctcagtccgtagccttccagcaatttggcgcgggggaacttggctttgaaatcgaggatggtttgttccgccaaaggcgcgccgccgctgataaacaggcgaatgcggttgaaccatctgaaataccaagggattttcgccttgctcatcgcggtgtaaatcgcgggtacgcccaaaaacacggtcgcgcgtttgagcagtgtctgtttcaaaacgttggaaaacggaaaaacggatttgaccaaaataatcgaacacgccatataaatcggcagcagcaccatagccgtcagcgtgaagctgtggaacatcggcaggaaaacgataaagcggtcgcgcttggaaattttaaagatgcgttcgatgccgttcaggttggcgaacaggttggcgtaactgattagcgcgcctttgggatgccccgtcgtgccggaggtgtagatgatgtgtgccaaatcatttatccggggttggcggcccaagtcgggtttttcggggaagcggcgcacgtcttcaaaaaaggcatcgccttccgccgtttcgccggtcggacggcttttgtccgtccaaatgattttttcgacgggcgtttgcgccttcaagcccgccaattcttttgacaggccggccgaggcgaacaggaagcgcgccttgcagtcgttcaggatatacgcgtattcgctgtttttcaaaaatgtgttcatcggtacggcgaccgcgccgatggcggagatggcgaaataggcggtaataaattctgtggaattggaaaccgccagcgcgaccgtgtcgccgaacttcacgccgatattttgcagatacgccgcgacggcttcggcctcctgcttgagcgcgcggtaggcggttttttccttgccgtcgaacactgccgtgccgtttccgtttttgcggcaggcggcggcgagcatttcgtagaaattggcataagtccggttcatgaaacttcctttatggttgcggacggagaacgccctcatttgaaaacaatatgccgtctgaaaacggaaggcggcagtttatcatctttgccttcagacggcatatcaaacgccgcctttgcgccgtatgccggaggttcgcctgcgtccttccgatgcctgaggcgaatgccggttgcgtccggcaaaccgtgcgcggggtggctatgccgtctgaagcaatatgaaggtatgcgtttcagacggcatccccctgttgcggaaataccgtccgcctcctgtccgattattgcctgattgcagcggagcggacgagttcttcgaggctgtcggcgagcatttccgccgcgcgccggtagcctttggcggagaagtgtacgccgtctttggcggcccatccttggttgagccagtttttcatgctgcatatgccgcccatggcgttttgccaagaccagaacatcgtctgcccctgacgggcgacgcgccgctgcatctgttggacttcggtcaggcggacggggcgtgtgccgcatacgccgagcgtgtttttcagggattcgggtgcgccgatgatgaggatgccggcggcaggcaggctgtcgcggatttggcggacggtatccagccatttttgttcggtgtcggcaatgtcgatgttgttgttgaaagcttcgttggtgccgtaggaaaggataaccaaatcggcgccggtttgggcgaggtcgttcatacggtcggcacgccatttcgaccactgggttaattgtgcgccgttgatgcccatcgcggaaacggtaatgccgccggcgggattttcgatgttgatgaagccgatgtcccacggcatttcggtgtgtatggtcaggggcagtgccgcgcccgtatccagtacctgccagccgccgccgttggcggagacggtgttgccgttgacggtcagggtttgttcggcaagcaggggtttggcaaacagggaaacgcgctgcttgcttgctatgccgtccgatgcggtcagggtcatgctgccgccgctgccggtgtgggcgaggatgccgccgagcgggaagtctccggtgttgttcctgctggtgaggctttgccagttaccgttgtgccggacggccgccatgcgctgccctttgacgttggcggggtaaacccagcctatgccgccgtcgccccaagttttttgcaggcgtttgcgcaggctgtcggtaaagaagtcgccggcggtatgcgagtcgccgatttgcaggatacggaaggtctcgccgctgccttgtgcgacggattggagttttttcatccaaggcgaggcggaggcgttgccgtagtcggtcagcagcccgtttgtatcggtgtagggggcggacggggaaacggtaacggtgtcgaggctgacggaggcgacaggtagggcttctgcctgcgtggcggcgaatagggcggaaaatgcgatgaggtgtttggggttcatggctgtgtacttgatggttgcgtacttggttcaaaaacgattttttccattatttttgccgccagcagtttttgtccttcggcggtaaagtgtatgccgtccttgctgcggtagcggacgggtttgccgttgacgttgacggagtcggtgtagcggtctttcccgccgctcagggtgtgcgtggtgggaatcaggatgattttgcctttcaaatgttccgaaagcagtttgtctaggtagcgcatctgtccgtcgagcttggcttttttcatgtaggggatgccgagccagacgacttggacgcggtgcgtgtgtgcggcttcaaggatgcggtcgacacgtttcaggtattcttgcgcccattcgtcggaagcgaatttgagatagagtttgccgacggggaaatcccacgggtcgttcggtccgaggaagacggcgagtacgctgatttcgggatgtttttgcagggtttcttcaatcgttttcggccagtcgaagaatgaggggtaggacagccccgtgctttgtttgctgaggttgacggattcgatgccgtattgctgtttcaggcttttttgcacgaagggggcaacgccctgcatcagcgagtcgccgacaaaaaagactttgtcgccgctgcggacggcggcggcttcggtgtcttgtttccattctgtttcaccggtttgagggacggcttcggatgcggcggcttcagacggcatatctgccgaaccgccgtcttgagccgtcggcggcgtttcgccggacaggaaggctttgatgccgtctgaaagggcgtaggcgttttcttgcaacgccgcaccgctccgccaccatccgtaggcggcaagcggttcgagcgggctgttgcggtggtaggtctgctgccagtaggcgttgatggggttttggctgaaccacacggcaatcagggcagacatcagtatggaggagaaaagggaaagaaagtttttcatgtccaaacccttaaaaattggcataaataaagccgggtatccccgagggggcgaggacgataatcagcagcaggacggcggaaacggggataaaccacagccacatcgggattttttccaaacctttgaccgcgccgtcgaaagcgcgttgcaggtaagggtagagcagcatcacggatgcaaacgaggcaagcaacagcatgtttgcctgttgcggcgcattccagccgttggcattggcaaagagggcactgaaaactgcgcctgcatcgtcgggatttgcggtattgaagacgacaaagctaaggcagacgaaatggaaggtaatgagccatgagagcggcgcgaagtatttcagacggcatagcgcgtcgcgtccgaaatagcggtcgcccgtgttgagcagcaccagtgccgtgccgtgcagcgcgccccaaatgaggaagttccagccgtagccgtgccagatgcctgagagcaccattgccgccatcaggttgagctgtgtccgtaaaaagccttttttgctgccgcccaaggggatgtagatgtagtcgcgtatccaggtggaaaggctgatgtgccatttgtcccaaaatgcgcggatgtttaaagcacgaagcggtgcggagaaatttttgggcagcctaaagcccagcagcatcgccatgccgataaccaaatcggaatatccggaaaagtctaaaaagagttggaaggtatagccgtacacgccgcccaatacgccccagccgtcgaattgggcgggattttcaaatacgggcgacacccagttttccgccagcatccccgccagccaccattttttggcaatacccagcagaatcagggaaacggcgagtgcggggcggacgggcgaacgcgctcggcgggtacggatttgcgccaatgcgcctgcctgctcgccgtctgcgcttttgaatgcggcggcgcggataatcgggccggaggtaacggtggggaaaaaactcaggtgcagcagcagctcgtgccagctgaaacgcgcggcgtgcggggcgcggaagcagtaaaccagataggcgagcgactggaaggtgtaatacgaaagccccagcggcatcaggatgtcgattgcgccgccttttccggcatattgggcaatcatcgggcggaaaaagtcgaaatatttgaaaaagcccaagacggtcagcgaggcggcaatgccgcaccccagccagaaacggcgcgtattttcgcgatcggaacggagcagttcgcccaaaaggtacacgcaggaggaataaaggacgatgattgccgcaaatacagggccgatatggtagagccagcccataccggcagccaaaagcagcaggttttggacggacgggtatttcgccaagccccagtaaatcggcaggaaggcgagaaagaacagtgcgaactcgacagacagcagcggcataaaccatccttggaacaaaaaataggcgttaaaacacggcaaagcccgttattttaagcaggggtggatatttcttcaatcaaaatgccgtctgaagggcgggaggggcttcagacggcatcgtgcggtcaggttcggatatggcggttcaggttcaggcagacccacaaacctgccgccgccgtcagcatacccgcaacgccgatgcaggaaatgcccgagtattgcgtaacccaatgccccagcagcgcgccgccgccgataccgacgttgtatagtggattaacaaaaatcaggacaaggcaacgaagccgcagacagtacaaatagtacggaaccgattcacttggtgcttcagcaccttagagaatcgttctctttgagctaaggcgaggcaacgacgtactggtttttgttaatccactataaatgcgccgattgccaaggcaatgatgctcaaccagggtttttgcgaagcgttcattgttgttgtcctgatgggaattgccgccattatgcgcaagcgtccgtattttttcaaaccgccgcaccgtttccgcgtttgcccaagttcacgccccgacttacaataacgcccgtcagaatgcagtaccaacgaaaggaaaaatcatggaaacccttatcctcgacatcggcggcatgagctgcggcggctgcgtcaaaagcgttacccggatattggaaggcgtaaaaggcgtggcaagcgtcgaagtcagccttgaaaacaaaagtgcgaccgtcggatacgaccccgcgcaaaccgatgcaggggcgttgattgaagccgttgaagacggcggctatgatgccgcgttgaaataaagcggcaaaaatgccgtctgaagccttcgcgcctcccagatgccgtctgaagtacgctccgcgccttcagatggcatttgatttagttgaacgggtaggatgaattggttaaacttgcgggcaatagtgccttcagacaaacaaaatatgccgaacaagaagaaaaaagccgcctttgcgcgtgctgcaacggagaacggtgtgccggacgtgtccaacatcaaaaattcatatgatgatttgatgtacgaatccggcgcattctctcaaaccgccatcaataatttggaggcgcgcgcccgcctgatgggtttgcagcccgcgcccgccgccaatgccaaggtcttggagctgggctgttcgatgggcggaaacatcatcacgcaggcactttattacccggatgcggaatttgtcggtatcgacctgtccggcaggcaggttgcacagggcaacgccatcattgaaaaaatgggcttgaaaaatgtgcgtctggaagaaaaagatattttgaccatcgatgagtcattcgggaagtttgactatatcatcgtccacggcatttggtcgtgggtgcctgacgcagttaaagacaaaattttttcgatttgctggaacaacctgaccaaacacggcattgcctatatttcatacaatgtttaccccggctggaaacggcaggagcagttgcgcgaaattatgtactttgccggcagggatgtgcttgaagaacccttggaagcgcggacgcggaaaggcttggacgcgctcaaggcgctggcggaaattttggaaaacgacaagggcttggacggcggcggcaaacttccggcgattcaaaaaatattgaatcataatttttattacatcgcacacgaatatatggaggcgtttaacgacccgatttacgtcaacggcttcatcgaatgggctaaccgccacaggctcgcatatatcggggataccaatttgcacgtgtcttttgtttcttggatggcggagcatacgcgggagcggattctggcattggcaggggacgattatattgccaaagaattttacagtgatattttatccgaccgccaattccgccgttcgcttttatgccgtgaggaagtcggggatactgtcaggcgtgatgagtcggttgccgtcgaagtgatagaaagtttgaatttccgcccggcaagaggggaaacaatcaactttgatgaaaacgatatcctgctttcgggcatacgcgatgtgatgaaaaccggagaggcgtttaaaacggaagatgttgcggaaaatctcgcccgccgatttcccggtttggaatttgaccgcatgaaaatcaattcccagcttttattgcaaaccattctcgggcgtttttctgtttcatcagacaatgcgggcaaaccattttttgaagaccataaaacctatgtgccggcgcgctttacaaactatgccgccgcctttgtggaacacggcgcggaagcgtttgtccggcctgccaaccgttacaacgaaagcaccccctcattcggatacgggcatttgtacattatgcgccaattgtcgcggccgacgagcaaacaggcattgattgaaacggttgccgaaaacttgaacatcgtcagcaccacgcccgacggtttgacattccatccgcctgccgaagtgtatgtggaagaaatattggcagacttggcagacaggcattttctcgtttcggcggattgacgggcaagtcccggcggcaatccgtccgatatattttcagacaggaaagacacacactgcgaaaagcggtgcacgacacatatgaaccagacatttaccttgcccgatacgcgcccgtatccccaaaatccgattaaaaaccacctgctgctcaatgcctaccagttggcgcataattcttcccaggcttcgcgcaaactctcgtccggccaacttcaaaccgaaatcaggggaatgcttgagcaaaaccactatatcaacctttccctcgcgctgacgatgtcgcccgatgccggaacttatgccgcgctgctttccagtgtgaacgcggtactcgattgcgagaaagaaggcgaagtgcagtggttcgccctgccggtcgtgctggtgtccggctgcaaaaaagaacgtgcaatcgagatgaagctgccgacggaggcattgtttgcctgcctgcaaaactatccgcacctgcgcgcgttgacgcaagagacgcaatggctgccttatcttgtgcattcttccgatttgagcgcggtcgcgccggatgagtggtggcgtgccaaacaaaataccgaagcggcggcgcaacacttgcgccgtttcgccccgcgccctttgctgttgcccgaagggcagtccgtccacgtcgtttacgcgctgggtttcggcagcggcaaagttcagacggcattgggtcagaaccttcttcaggcaggtctgcccctgatgcaggtatggcaggaaaatcttgcatcggaaggcgttacgctgtttgccaatccgctttccccggattctccggtacgcgcgctttcagacggcagccacacgcgccaacgtatggcgatggatgtgtttgcggcaaacgcgatacgcgccgtccgtatgcagagtccgcgcgtcggcgtggtcgctgcggcaaaggcgggcggacagattttattcgggtttaatgcgaccgacggcgcgtttgaagtcgtgccgcaggtgttttcgtggcagctttcctttaccgacaacatcgccgtcatccagcaaaatttcctcgacctgatggcggagtgccgcgtggaacacgtttacctgttgcacaatcccttgggcgaacaggaaagcatcccgagctatgcggaagcattgaaacgggaagggcacaatccgtttttcagcgcatagtgatttgtagtagtgataggctttctcatttatataataaatcaaaataaagagcacaacactttttcattctgtgttgtgccttgagtgaaacgaaaggatgaattataaatatgaagattgtaattgcaccggattcgtttaaggaaagcttgacagctcaacaggtagctgaagcaataaaaagaggcttccaacaatcgatagcagatgtggaatgtctcctctgtcctgtcggtgatgggggagaaggcactgtagatgctatccgacattctcttgacctagaagaaaaatgtctccaagtgacaggaccttttggacaaaaagaagtcatgcgctattttcaaaaagaacaactagccctattcgaagttgctgatttggttggtcttggaaaaatcccgctagagaaacgaaatccattacaaatccaaactcgtggtattggagaattgattcgccacctcattagtcaagaaattaaagaaatctatattggcgttggcggtacggccagtaatgatggaggtattgggattgctgctggtttaggttatcaattttatgatgaggatggaaatgccttacccgtttgcggtcaatccttactaaacctagcttctgtttcaacagaaaatcgctatgaaattcctgaagatgttcacattcgtattttagcagatgttgtgagtcccttatgtggacaccaaggtgcgacctatacgtttggcaagcaaaaagggttggattctactatgtttgaggccgtagatcaggcaatacaagatttttatgaaaaagtctcccctgcaacattaaaacttaaaggagcaggagctggtggaggcatcgctggtggtttgtgcgcctttgctcaggcaagtatcgtatctggaattgacacctgcctggacttgattgactttgataagaaagtgtcagatgttgacttggttatcgttggtgaaggaagactagatcgtcaaagtttagcagggaaagcgcctattggtgtagcaaaaagaacccctgtcggagttcctgttgtcgctatttgtggcagtctcgttgaagatttgccttccctgccatttgaaaatatccaagctgccttttctattttggagaaaagtgaacctttagaagatagtttgaaaaatgccagcctctatttggagcatacggcttctaatattggacacttattaaatatgcctaagatttagccaaaccatttcttccagatggatgttttggctggttctgccttatgcggttacgattaaccgaccgatgccgtctgaaagggtttccgcttcagacggcatcgcgccggaacagggaggggatatgaaaaaaccgaaaatcctttttgtctgcctcggcaacatctgccgttcgccgatggcggaatacattttgcgccgccgcgccgccgaagcgggcattccccttgaagcggacagcgcggggacatcgggctggcacgacggcgaagatatgcaccgcgagacggcaaagatattgaaaaaacacggtatcgatgcttcaggctttaccagccgcaaaatccgccaaagcgatgcggcggcgtttgactgcatcatcgcgatggacggcaagaatttgtccgaattggaaagaaccttcggcaggcggccggaaaaaatattcaagctgaccgacctgatacccgaaagcggttacgaccatgtccccgatccgtggtatacgggcgattttgaagaaaccttcaggcttgcggatgcgggctgtcgggcattgttggaaaagatttccaaataaagcaattgaatacaaatataaaaccgcctcctgccgtatcggttgttcagacggcataaacagagaatttatgaaaacaaatttcaaacagaaaattatcgaacaggcacgcagcgaaggcttgcaggtaaccgctttgcgcgagcaggtattagatattgtcttgcagcaaagcggcgtgattaaagcctacaacgtcttgtcgcagatgcagcagcaaagcgagggcgtgcttgcaccgcctaccgcctaccgcgcccttgatttttgggcggagcagggcgttttgcacaaagtggcggcggtcaacggctatattttgtgcagccacgcgcagcacgagtgcgacgaccattgccacgaccacgaagaagccgaagcgcaccacagcgcgtttattttggtctgcaccgaatgtggcacggcggacgagcaaaccctgagccacgagtgggcggcactgcgcgcaggcgttgccgaaagcggctttgcgctgaaagaagaacacgttgttttaaccgggatttgtaaaaaatgtcagcagtaatcggtggtttgcattgataataagcctttcgaaaggagcagataatgaaaccgtctcttttgttgcaaagcagaaagaaagaaatattggcagttttcgggaaatatccattgatttgcaatccaagggtattcggttcggtttctcgcggagatgatacggaaaacagcgacattgatttgttggtggatgcaaaaacagggacaacattattggatttgggcgggctgcaagaggaattgcagaaactcttgggcataaaggtcgatttgctgacacccgatgacatctcggcccactttagagataaggtgttgactgaggctgtcgcattatgaaaatgcagaaagaattgtcggtctatttgaaacagatattgcaggcagcgcaatatatccggctatataccgacaaaatggattatgggcaattttctgccgacacaaagactgtgcaggcagtcgtttttaatttgttccttatcggtgaaaacgcaacccatatccttaaatcgtatccggaatttgccgaggaaaccaaatatttgaattggatagggatgagggggtattgcgcaataggattgcccatggctactttgaaatgaacctgtctgtcgtttgggagacggttttgaacgtcataccggcgatgtcagccgatatatcgaatttgctggaacaattgtcaattgatgaagaacatgataacagctgccatcacttttaacattatttaatcatttaaaacaccctatcttcaaattttaaagtgggacatcacatagaaatgaaaaaaaccaaagtccacctgatttcaggttttctgggaacaggcaaaaccaccgcgctcaaaagcctgatggcgcaaaaagacccgaacgaaaaatgggtcatcatcgtcaacgagttcggcgaaatcggcattgacggcgcggtattgagcgacaacggcatccctgtggcagaaatcgccggcggctgtttgtgttgcaccgccggcccgcaaatgggcgtaaccgtgcagaaaatgctgcgcgacgccaagcccgaccgcctgatgattgaagcaagcggactggcgcacgccgccagtgtcattgatgaactgaaaaccaaaccgctggacagccttttggaaatcggcgcagtctttaccgtcgtcgatccgcgccagttcatcaaccccgattacgcgcagcaggcattgtataaagaccaaatcggcatctgcgacgtattggttgccagcaaaaccgatttatgcacccccgaacagcttgccgaatttcacgacaaagccgcaaaactgttcccgcccaaggctaaagtggtcgaagttcaaaacgcacaactcgatatccaatggcttgacatccccgtcatcgaaaaatcacgctaccgcctcaaagccctgccggacaacacgatgggcttccagtcgcaaggtttcacattccccgccggacgcgatttcgacggtgaaaaattgaccaacttcttcaatgatttgcccaatatgaccgaaggactcgtccgtgccaaaggcgtgttccaagtattgggaacgtgggtgtggctcaactgggtggacgggcaatggggtgcgaaccaagtgtcttggcggcgcgactcgcgttttgaattgattgccaaatcgtttgatgcggatttaatcgaacaaaaactcaaagacgcattggaatagcgttaacgagccttcagacggcataggaaatgaaaatgctgtctgaaggtctgaggaggacgggatgaaacccaaattcaaaaccgttttaaccgcgctgcttttggcggtttccctgccgtctatggcggcaacccatgttttgatggaaaccgatatgggcaatatccgtttggttttggacgaatccaaagcccccaaaaccgttgctaatttcgtgcgctatgcccgaaaaggcttttacgacgacaccgtttttcaccgcgttatcgacggttttgttatccagggcggtggattgaccgaggacttggcacaaaaggcaagcgataaggccgttgccaacgaatccggcaacggcttgaaaaacaccgccggcaccatcgccatggcgcggacgacagcccccgattccgccaccagccaattctttatcaatctggcggacaacgcttcgctcgactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaacacgcagacagacgttcagacggcgtcgcccgtttcccaaaaaacgccgtttaaagtaaaaaaatattttaaaacagacagttgatattgacaaattcaaaccgaggattttaaaatgctgccaacccaacccaacccaacccaacccaacccaacccaacccaacccaacccaacccaacccaacccaacccaacccaacccaagccctgatctaagcgacacagccggggcgaacacgg

SEQ ID NO: 18 - DNA, 19231 bp, Neisseria meningitidis
gacttttctactgttttgaagcaggatatcgatgttcgcaattatttgcgtcaaaaattggccaatgcttcggttggtcgagtggwtattgaacgccctgcaaaatctgcacgcattaccattcactccgctcgtccgggtgtggttatcggtaaaaaaggtgaggatatcgaggttttgaaacgtgacttgcaagtcttgatgggtgtacctgttcatgtaaatattgaagagattcgccgtcctgagttggatgctcaaattattgctgacggtattgcccagcagttggaaaagcgcgttcaattccgtcgtgctatgaaacgagcaatgcaaaatgcaatgcgttctggtgctaaaggcattaagattatgacttcaggccgtctgaatggtgcggatattgcccgtagcgaatggtatcgtgaaggtcgcgtgccactgcatactttacgtgcaaatgtagattatgcaaccagcgaagcgcacaccacatatggtgtattgggtctgaaagtttgggtttatacggaaggcaatattaaatcttccaaacctgaacatgagagtaaacaaagaaaggcaggtagacgtaatgctgcagccaactagactgaaataccgtaagcaacaaaagggtcgcaataccggcatcgctactcgcggtaataaggtaagtttcggtgagttcggcttgaaagccgtaggtcgtggtcgtttgactgcccgtcaaatcgaagctgctcgtcgtgcaatgacccgtcatatcaaacgtggtggtcgtatttggattcgtgtattccctgataaaccgattactgaaaagcctattcaagttcgtatgggtggcggtaaaggtaacgtggaatattacattgccgaaattaaaccaggtaaagtgttgtatgaaatggatggcgttccagaggaactggctcgtgaagcattcgagttggctgctgccaaattgcctattcctacaacctttgtagtaagacaggtgggtcaataatgaaagcaaatgaattgaaagacaaatccgttgagcagttgaatgcagatttgttggacttgttgaaagctcagtttggcttacgtatgcaaaacgctaccggtcaattaggcaaaccaagtgaattgaaacgtgtacgtcgcgatattgctcgtattaaaaccgttttaactgaaaaaggtgctaagtaatgagcgaaactaaaaatgttcgtactttgcaaggcaaagtagtaagcgacaaaatggataaaaccgtaacagtattggttgagcgtaaagtaaaacatccgctgtatggtaagattattcgattatctactaaaatccatgcccatgatgaaaataatcaatatggaattggtgatgtggttgttatatcggaatcccgtccattgtcaaaaactaaatcttgggttgtcagtgagctggttgagaaagcacgttctatttaagaattaaagcaacgtgcttggaatgggaaacgaagtattgcagcaaatttaatttgcgtgtaaacttcgtttcctgtctttcagtttcttctggaagtttcttccctttcggggtccaagactggtttacttgaaccgcaaggtttcatttaataagcagcggctttgctgtaagttatctgaaagtggtaaattaagttggttaatttaaaggtaataacatgattcaaatgcagaccatcttagatgtggctgataactctggtgcgcgtcgcgtaatgtgtatcaaggtattgggcggatctaagcgtcgctacgcttctgttggcgatattattaaagtggcagttaaagatgcggctccgcgtggccgtgtcaaaaaaggcgatgtatataatgcggtagttgttcgtactgctaagggtgtacgtcgtcctgatggtgcgttaattaaattcgataacaatgccgccgtgttactgaataataaacttgaacctttgggtactcgtatctttggtccggtaacccgtgaattgcgtactgagcgatttatgaaaatcgtttcattggcacctgaagtattataaggaatggcacgatgaataaaatcattaaaggcgatagggttgtagtaattgctggtaaggataaaggtaagcagggtcaagtagttcgagtgttgggtgataaagttgttgttgagggcgttaatgttgtaaaacgccatcaaaaacctaatccaatgcgtggcattgagggcggtattattactaaagaaatgcctttggatatttctaatatcgcaatcctgaatccggaaactaataaagcggaccgtgttggtattaagctgattgaaaatgaaggcaaagttaaacgcgttcgtttcttcaaatcaaatggctctatcattggggcataaggagataacatggctcggttgagagagttttataaagagacagttgttcctgaattggttaaacaatttggttacaaatcagtaatggaagtcccgcgtattgaaaaaattaccttgaatatgggtgtgggtgaggctgttgctgataaaaaagttatggaacatgctgtttccgatttagagaaaattgccggtcaaaaaccggttgttactgttgcccgtaaatctatcgcaggttttaaaatccgtgataactatccggttggttgcaaagtaacattgcgtcgtgatcaaatgtttgaattcttggatcgtttgattactattgcattacctcgcgtacgtgacttccgtggtgtgagcggtaaatcatttgatggccgtggcaattacaatatgggtgttcgtgagcaaattatttttccggaaattgaatacgataaaattgatgctttgcgtggtttgaatattactattactactacagcaaaaaccgatgaggaagcgaaagctttattgtcattgtttaaatttccgttcaaaggataatcatggctaagaaagcacttattaatcgtgatctgaaacgtcaagctttggctaaaaaatatgcggctaaacgcgcggcaattaaagcggtaatcaatgattcgaatgcaactgaggaagagcgttttgaggctcgtttgaggtttcaatccattcctcgtaatgcggcacctgtgcgtcaacgtcgtcgttgtgctttgacaggtcgccctcgtggtactttccgtaaatttggtttgggtcgtattaaaatccgtgaaatcgccatgcgtggcgaaattccgggtgttgttaaagccagctggtaataggagtaattaagaatgagtatgcatgatcctatttccgatatgttgactcgtatccgcaatgcgcaacgtgctaataaagcagcggttgcaatgccttcttcaaaattaaagtgtgctattgcaaaggtattgaaagaagaaggatatattgaggacttcgcagtttcatctgacgtaaagtctatattggaaattcaattaaaatactatgcaggtcgtcctgtaattgaacaaatcaagcgtgtatctcgccccggtttgcgtatttataaagcgtctagtgagattccaagtgttatgaatggcttgggtattgctattgttagtacttctaaaggtgtaatgactgatcgtaaagcacgttctcaaggtgttggtggtgagttgttatgcattgtagcctagtggaggaaaagaaatgtcacgtgtcgcaaaaaacccagtgactgttcccgctggtgtagaagtaaaatttggagcagaggcattagttattaagggtaagaacggtgaattgtcttttcctttgcattctgatgtagccattgaatttaatgatggcaaattgacttttgttgcgaataacagcagtaaacaagcaaatgcaatgtctggtactgctcgcgcattagtcagcaatatggttaaaggtgtttcagaaggttttgagaaaagattgcaattgataggtgtgggttatcgtgctcaagcacaaggtaaaatcttgaatctgtctttgggtttttctcatccgatcgtatatgaaatgcctgaaggtgtctccgttcaaactcctagccaaacagagattgttttaaccggctcggataaacaagttgttggtcaagttgctgctgagattcgtgcgttccgtgctcctgagccttataaaggtaaaggtgttcgctatgtaggagaagtagtggtaatgaaagaagccaagaaaaaataattgaggttcactaatggataaacatacaacccgactccgtcgtgcacgcaaaacccgtgctcgtattgcggacttgaaaatggtaagattatgtgtgttccgaagcaataatcatatttatgctcaagtaattagtgctgaaggtgataaagtattggctcaagcctctacattggaagctgaggtgcgcggtagtctgaaatctggaagcaatgttgaagcagctgcaatagttggtaaacgtatcgctgaaaaagctaaagcagcaggtgtagaaaaggttgcttttgatcgttcaggtttccaatatcacggtcgtgtgaaggctttggctgaagctgctcgtgaaaatggtttaagcttctaaatatttggagactttcagatggcaaaacatgaaattgaagaacgcggtgacggtctgattgaaaagatggtcgctgttaatcgcgtaactaaagtagttaaaggtggccgtatcatggctttctcagcactgactgttgttggtgatggtgatggtcgcattggtatgggcaaaggtaaatcaaaagaagtaccagttgctgttcaaaaagcaatggatcaagctcgacgctctatgattaaagtacctttgaaaaacggtactattcatcatgaggttattggccgtcatggtgctactaaagtatttatgcagcctgctaaagagggtagtggcgtaaaagccggtggacctatgcgtttggtttttgatgctatgggcattcataatatctccgccaaagtgcacggatctactaacccatataatatcgtacgtgcaacattagatggtttgtctaagttgcatactcctgctgatatcgcagccaaacgtggcttgacagtggaagacattttgggagttaaccatggctgaacaaaaaaagattagggttacattggttaaaagcctgattggtacaattgaatctcatcgtgcatgtgcacgcggtttaggtttgcgtcgtcgcgagcatacggtagaggttttagatacccctgaaaaccgtggtatgattaataaaatcagctacttgttgaaagtggagtcttgatatgtttttgaatacaattcaacctgctgttggtgctacgcatgctggtcgtcgtgttggacgcggtattggtagtggtcttggcaaaacgggtggtcgtggtcataaaggtcaaaagagccggtctggtgggtttcataaggtgggtttcgagggtggtcaaatgcccttgcaacgacgcctccctaaaagaggttttaaatctttaacagcatcagctaatgcacagcttcgtttaagtgaactggaatcaattgctgttaatgagattgatattttggtcttaaagcaagcgggtctgattgcatctacagtctctaatgttaaagttattgcttctggtgaaatttctaaggcagttgctttgaagggtattaaagttaccaaaggtgcgagagctgctatcgaggctgttggtggtaagattgaaatgtaaggtttaatattgtggctaatcaacaaacgtcatcaggttcatccaaatttggagatcttaagaaacgtcttttgtttctatttggagcattgattgtttttcgaattggtgcccatatacccgtacctggagttgatgctgttgctttagctaaattatacgaaagcgctggaaacggcatcctgggaatattgaatatgttttccggtgggtcgttagagcgctttagtatatttgcaataggaattatgccatatatttcagcttctattattgtacagctcgcttctgaaattttgccatcattgaaggctttaaaaaaagaaggggaggctggtagaaaggtaattacgaaatatactaggtatggtactgttttgttagcaattcttcaaagtctaggtgttgcatctttcgtatttcagcaaggaattgttgtaacaagttcatttgagtttcatgtttccacggtagtttctttggtaacgggaaccatgtttcttatgtggcttggggagcaaattactgaaaggggtatcgggaacggtatttctttaatcattacggcaggtattgcttcaggtattccttcgggtattgcaaagctggttacactgacgaaccaaggttctatgagcatgcttacggcgttgtttattgtatttggtgccttattattaatttatttggttgtatactttgaaagtgcacagcggaagattcctattcattatgcaaaacgccagtttaatggtagggcgggtagtcaaaatacgcatatgcctttcaagttgaatatggctggtgttattcccccaatttttgcttccagtattattctatttccatctactcttttaggttggtttggttcggctgatacaaatagtgttttgcacaaaatagctggattgttacaacacggtcaattgctgtatatggctttatttgcagcgacagttattttcttttgttatttttatacggctttggtttttagccctaaagaaatggcagagaatttaaaaaagagtggtgcttttgttcctgggattagacctggtgagcagacctctaggtatttagaaaaagttgtattacgtttgacattgtttggagctctttatattacaactatttgtttaattccagagttcttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatagaattatggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataaaccaataaaaggaaaataaaatgcgtgtacaaccatctgttaagaaaatttgccgaaattgcaagattattcgtcgaaatcgtgtagttcgtgtaatttgtactgatctccgtcacaaacagcgtcaaggttaatggaatatttcttttaatgtgattctgtgatatagtgacacactttgccctaaaaaggaaaaaatatggctcgtattgcaggggtaaatatccctaataacgcacacatcgtaattggtcttcaggctatttacggtattggtgctactcgtgctaaattgatttgtgaggctgcaaatattgcgcctgatactaaagcaaaagatttggacgagactcaattagatgctttgcgtgaccaagttgccaagtatgaagtagaaggtgatttgcgtcgtgaggtaactatgagtatcaagcgattgatggacatgggctgctatcgtggcttccgtcatcgtcgcggcttaccatgccgcggtcaacgcactcgtacaaatgcgcgtacccgcaaaggtccgcgtaaagcgattgctggtaagaaataaattttaaggaattttattaatggctaaagcaaacacagcttcacgtgtacgtaaaaaagtacgtaaaaccgtgagtgagggtattgtgcacgttcatgcatctttcaacaataccatcattacaatcactgaccgtcaaggcaatgcgttgtcttgggctacctctggcggcgctggttttaaaggttctcgtaaaagtacaccatttgcagcacaagttgcagcagaagcagctggtaaagttgcccaagagtatggcgttaaaaatttagaggttcgtattaaaggtccaggtccaggtcgtgaatcctctgtacgtgctttgaatgctcttggtttcaagattaccagcattactgacgttaccccgttgcctcataacggttgccgtccgcctaaaaaacgtcgtatttaatattggagtgatttgaaacatggcacgttatattggccctaaatgtaagttggcacgtcgcgaaggtacggatttgtttttgaagagtgcgcgccgctctttggattctaaatgtaaaattgattccgctcctggtcagcatggtgcaaaaaaaccgcgtttgtcagactatggtttgcagttgcgtgaaaaacaaaaaatccgccgtatttatggcgtattagaacgtcagttccgtcgttatttcgcagaagctgatcgtcgtaaaggttctaccggcgagttgctgttgcagttgctggaatctcgtttggataatgtcgtttatcgtatgggtttcggttctacccgagctgaagcaagacagcttgtttctcataaggcgatagttgtgaatggacaagttgtcaatattccttctttccaagtgaaagctggtgatgttgtctcagttcgtgaaaaagccaaaaaacaggtacgtattcaagaagcattgggtttggcaactcaaatcggcttgccgggttgggtttctgtagatgcggataaacttgagggtgtgttcaaaaacatgccggatcgctcggaattgaccggtgatattaatgaacagctggtggtagagttctactctaaataatgctagctcagtgagggacagttaaatgcagaatagcacaaccgaatttttgaaacctcgtcaaattgatgtaaatactttttctgcaactcgtgcaaaagtatctatgcagccatttgaacgtggtttcggtcataccttaggtaatgctttgcgccgtatcttactgtcatccatgaatggttttgctcctactgaagtagctattgccggtgtattacacgaatattctactgttgatggtattcaggaagatgttgttgacattttgctgaatattaaaggtattgtgtttaaactccatggtcgtagccaagttcaacttgtgttgaagaaatcaggttcaggtgtcgtatctgccggtgatattgagttgccgcatgatgtagaaattctgaatcctggtcatgtcatttgtcatttggctgataacggtcaaattgagatggaaattaaagtagagcaaggtcgtggttatcaatctgtttcaggtcgtcaggtagttcgtgatgagaaccgtcagattggtgcaatccagttggatgcgagcttttcgcccatcagccgtgttagctttgaggttgaacctgcacgtgtagagcagcggacggatcttgataagttggttttggatatcgaaaccgacggttctattgatcctgaggaagctgtacgcagtgcggcacgtattttgattgatcagatgtctatttttgctgatttgcagggtacgcctgtggaggaggttgaagaaaaagcacctcctatcgaccctgttcttttgcgtccggtggatgatctggaattgacagtacgttcagctaattgtttgaaagctgaggatatttattatattggcgatttgattcaacgcactgaaaccgagcttcttaaaacgccgaatttgggacgtaaatctttgaatgagattaaggaagtattggcatctaaaggtttgacactgggttctaagttggaagcatggccacctgtaggcttggaaaagccttaatgaagaattaaaggataattgatatgcgtcatcgtaatggcaatcgcaaattaaaccgtaccagcagtcatcgtgctgcaatgctgcgtaatatggcgaattcattattgactcacgaagctattgtaacaactctgcctaaggccaaggaattgcgccgtgtagtagagccgttgattacattgggtaaaaagccgtcattggcaaaccgccgtttggcatttgaccgtactcgcgaccgtgatgttgtagtaaaactgtttggcgatttgggtcctcgttttactgctcgtaacggtggttatgttcgggtgttgaaatacggattccgtaaaggtgataatgcacctctggcactggttgaattggttgacaaaccggctgctgagtaattttagtcatataacgccatctgccgaaaagcaggtggcgttatttttgcaatatctgataggtaatagggtattggctatcatgtttaaaatattaattgaatagctaaggtttgcgcggtaaacttacatcattaaaaaattctatgatggtttatataatgaatgctttcgatataaagtcgacaaagatggacgtattgtctatatctttgcatacgtcagacttgtttgatttggaagatgtgctggtcaaattgggcaagaagtttcaagagtctggtgttgttccatttgtgctggatgttcaagagtttgattatcccgagtctttggatcttgctgcattggtttcgttgttttcaaggcatggtatgcaaattttgggtctgaagcattctaatgaacgttgggctgctgcggctatgaagtatcatttgctgttttgtctgtctcattcggaaaatgttaaagaactgggtcaggttgaggtgcagaaaacggaggatggtcagaaagcaaggaaaacagtattgattacatcccctgtccgtaccggtcagcaggtttatgccgaagatggcgatttgattgttacgggggcggtcagccagggggcggaattgattgcggatggcaatatacatatttatgcgccgatgagggggcgtgctttggccggtgccaagggtgatacttctgcccgcatatttatccactccatgcaggcagaactggtttctgtggcgggtatttaccgtaattttgaacaggatttgccgaaccatctgcacaagcagccggtacagatattgttgcaggataaccgattggttatcagtgcaattggctcagagtaattgtttgatatttaaaaaggaaatattgtggcaaaaattattgtagtaacttcaggtaagggcggtgtcggtaaaacgactaccagtgccagtattgcgacaggtttggcattacgcggatataaaactgcggtaattgattttgatgtgggtttgcgtaacctcgacctcattatgggttgcgagcgtcgtgtcgtttatgacctgatcaatgtcattcagggggaggcgacgctcaaccaagctttgattaaagataaaaattgtgaaaacctgtttattttgccggcttcccagactcgggataaagacgctttgacacgcgagggcgtagaaaaagtgatgcaggagctgtccggcaagaaaatgggctttgagtatattatttgcgactctcctgccggtattgagcagggtgcattgatggcgttgtattttgctgatgaagccattgtaacgaccaatcctgaggtttccagtgtgcgtgactccgacaggattttgggaattttgcaaagcaaatcccataaggcagagcaaggcggttcggttaaagaacatctgttgattacgcgttattctcccgaacgtgtggcaaaaggcgaaatgctgtctgtacaggatatttgcgatattctgcatattcctttgctgggtgtgattcctgaatcccaaaacgtcttgcaggcatccaattccggagaaccggtcatccatcaggacagcgtggcggcttccgaggcatataaggacgttattgcccgtcttttgggcgagaaccgtgaaatgcgtttcttggaagctgagaaaaaaagcttcttcaaacgtctgtttggaggataaggtatgtcattaatcgaatttttattcggcagaaagcagaaaacggcaaccgttgcccgcgaccgccttcaaatcatcattgcccaagagcgcgcccaagaaggtcaggctccggattacctgccgactttacgtaaagagttgatggaagtcctgtccaaatatgtgaatgtttcattagacaatatccgtatttcccaagaaaagcaggatggtatggatgtgcttgagttgaacattactttgccggaacagaaaaaggtataggacatgaccttaaccgaattgcggtacatcgtcgcagtcgcccaagaacgtcatttcggcagggcggcgcggcgttgttttgtcagccagcccactttgtctattgccattaagaaattggaagaagagcttgccgtctctttgtttgaccggagcagtaacgatattattacgaccgaggcgggggaacgtatcgttgcacaggcgcgtaaggtattggaagaggcggagcttatcaggcatttggcaaatgaagaacaaaacgagctggagggtgcgttcaaactcgggctgatttttacggttgcgccgtacctgctgccgaaactgattgtttcgttgcgccgtactgcaccgaaaatgcctttgatgttggaagagaattacacgcatactttgaccgagtcgctcaaacgcggggacgttgatgcgattatcgttgccgaaccgtttcaagagccgggcattgttaccgaacccttgtatgacgaaccgtttttcgtgattgtcccgaaagggcattcatttgaggaactggatgccgtttcgccccggatgctgggtgaggagcaggttttgctgctgacggaaggcaactgtatgcgggatcaggtactctcaagctgttccgaattggcggcgaaacaacgtatacaggggttgaccaatacattgcagggcagctcgattaatacaatccgccatatggttgccagcggtttggcaatcagcgtgttgccggcaaccgcactgaccgaaaacgatcatatgctgttcagcattattccgtttgagggtacgccgccaagccggcgggtcgtattggcgtaccgccgcaattttgtccgtccgaaggcgttgtcggcgatgaaggcggcgattatgcagtcgcagcttcacggggtaagttttatctgcgactaggcgcaggcattgttttcaaaacgccatttccctgagccgacaacacggtatgccaagatattgccgtcatcatcgattttgagtatagcatcgccacggaaactgccgtcctgaagatattcgacttttgcatcactgtgaatgttttcatcagtgccgatgcaatgccatgtatagtggattaacaaaaaccagtacggcgttgcctcgccttgccgtactatttgtactgtctgcggcttcgtcgccttgtcctgatttttgttaatccactataaaagaggccgtctgaaaaacatttttcagacggccttgtttattcaatcaaatcagtctttcaacttcgccaactgattttgaacttttgccattttgtcttccaattccgccaaatcggctttgtctttttccaccagatgcgcaggggctttttcggtgtagccgggtttggagagtttggcgttgagtttgtccaaggctttttgcagcttctcggcttctttgctcaaacgggcggtttcggcggctttgtcgatttcgactttcaacatcaggcgcgcgccgttgcagacggcgacgggcgcgtcttcgctttcgggtagggcggcgacttgctgtgcttcggtcaggcgggtcatcatcggcaggtatttgaggtagtccgccaagtcgtccgtgctttcgacaaacagcggggcttttacgttgggctggatgcccatttcgccgcgcaggttgcggactgcgccaatcaaatcctgcaacacggtcatttgctcgaatgccgtctgaacaatctcgccgctgtcggcttcggggaagcgggcgagcatgatgctgtcggcggttttcgcgtcgcacataggagcgacggtttgccacagttcttcggtgatgaacgggataatcgggtgcagcaggcgcagggcggcttcgagtacgcgcaataaggtatggcgtgtggcgcgttggcggctggcgcagccggtttgaagctgcactttggcgagttccaaataccagtcgcaatagtcgttccatacgaagctgtacagggtttccgccgccaaatcaaagcggtaggtttcgtaggcttgcgtaacctgttcgatggtctgattcagacggcctacaatccacatatcggggaaggagtagccgcgcggttcggcagcggttgcgccgtaaccgcagtcttggttttcggtgttcatcaagacgaagttggtggcgttccagattttgttgcagaagttgcggtagccttcggcgcgtttgaagtcgaagttgaccgaacgccccaagctggcgtagctcgccatagtgaagcgcaaagcgtccgcgcccatactcggaatgccttcggggaagagttttttcgtggcttcttccactttcggcgcggtttcgggtttgcgcaggccggtggtgcgttttaccagcagtttttccaagccgatgccgtcgatcaaatccacagggtcaatgacgttgccttcggatttggacatttttttgccttcgtggtcgcgcacgatgccgtggatgtacacgtctttaaacggtactttgccggtgaagtgggtggtcatcataatcatacgcgccacccagaagaagatgatttcgtagccggttactaagacattggacggcaggaaggctttgagttcgtcggtttcagacggccagccgagtgtggagaacggcacaagcgcggaggagaaccatgtatccaatacgtcttcttcgcgagtcaagcctgttttgccggcttgtttttcggcttcttcctgattgcgggcaacatacacattgccttcgttgtcgtaccatgcagggatttgatggccccaccacagttggcgtgagatacaccagtcttggatgttgttcatccattggttgtaagtgttgacccagttttcagggataaagcgtaccgcgccgctatcaacggcttttttggctttatcggcgaggctcaagcctttgaactcgctgtccggctcgccgccgtttggggtggcggacatggcgacaaaccattggctggtcagcataggttcaatcaccgaacctgtacggtcgcctttcggcgtcatcagcgtgtgtggtttgatttcgaccaagaaaccttgttcctgcaaatcggcaaccatttgtttgcgcgcggcaaagcggtctaagcctgcgtatttttcaggcagggcaaagcctagttgcgcttcgcctttgaagttgaacacttcggcgtttgccagcactttggcttccaagttgaacacattaatcaggcgcgtgtcgtggcgtttgccgacttcgtagtcgttgaagtcgtgtgcaggcgtgattttcacgcagcctgtgccgaagtctttttcaacgtattcgtcggcaatcacggggatagtacggccggtcagcggcaggattaattccttgccgattaagtgggtataacgttcgtcttcaggattgacggcaacggcaacgtcgcccagcagcgtttcaggacgggtggtcgccacgataacggcttcggcgggattgtccgccagcggatagcggatgtgccacatagagccttgttcttccacgctttccacttccaaatccgataccgccgtgccaagcacgggatcccagttcaccaagcgtttgccgcggtaaatcaagccttgctcatacaggcgcacgaacacttcggttacggtttcggcgcgcacgtcgtccatcgtgaaatactcgcgcgtccagtcggcagagcagcccacgcggcgcatttgttgggtaatcgtgccgccggaaacttctttccattcccacactttctccaaaaatttttcgcgacccaagtcatggcgggacacgttttgcgcagcaagctgacgctcaaccacaatctgcgtggcgatgcccgcgtggtctgtgccgggaatccaggcggtgttgcagcctttcatgcggtagtagcgggtcagaccgtccataatggtttggttgaaggcatgacccatgtgcagcgtgccggttacgttgggcggcggcagttggatggagaaagacggtttcgtcaaatccatatcaggttggaaatagccctgctcttcccagttttgataatgtttggattcgatttcggctggattgtatttgtctaacatgatggaactttgtgaaattaaggttatttttgatgtgcggattataacgcaaaaaggccgtctgaatcatttcagacggcctttggcatacaggttttaaaaatggaacaataccaggctgacggcaatcaccgccatacccgttgtcaggccgtaaacggtttcatggccgtctgaatagcgtttggcagccggcagcagctcgtccaacgccaaaaacaccatcacaccggctatcacgccgaataccgaaccaaacacggcaggcgacaaaaacggctgcaaaaccaaatagcccaaagccgcccccaacggctcggccaagccggatagcagacacgcccacaccgttttcttacggctgcgggtggcaaaataaaccggcgcggcgatggaaatgccctccggaatattatggatggcaatcgccaaggccaaaggcatcccgactgctggattttccaatgtggcaaaaaacgtcgccaagccttcggggaaattgtgcgcagtaatcgcaaacgccgccatcatgccgactcgcgcgatatggcggcgtttgctttcttgaaacgacgggtcttgcgcgtctaaagtttcatgcgggttcggcaccagacggtcaatcagcgcaatgccgcccatcccggccaaaaatgccatggtcgccgccgcaaacgcgtggtctttatcataaatttcagcgaacgcctcgctggacttactgaaaatctccgtcagggaaacatataccatcgcaccgccggcaaacgccaaaccaaacgacaacacacgcggattgggcgttttggaaaacatcaccaagccactgcctaatacggtaaacaaaccggcagccaatgtgatggaaaaggcaacggccaaattggacatcgaaaaatcgggcatgagaaaacctgcgctaaaagctgggacaggttcagactaacactttttaatgtatatgataatagttattatttattttattgattggatacacggattttgaaacaaaaggccgtctgaaaaatgattttcagacggcctttaaatttgaaatgccgctaaaccttagtgctttccagcttaagcctgataacgcgacaggctcaaatcgtcgctgcggatttcggtgtctttgccgctcacgatatcggcggttaattttgccgaacccagcgacatggtccagcctaaagtaccgtggccggtattcagaaacaggttgtcaaagcgggtgcgaccgattaacggcgtgctgtcgggcgtcatcggtctgaggccgctccagaacgatgcttggctcaaatcgccgccttccgggaacaagtcgttgacgaccaaagccaaggtttcgcggcgtttttcgggcagtttgatttcgtagcccgacaattccgccataccgccgacgcggattctgttgtcaaagcgcgtgatggcgactttgtagctttcatctaaaacggtggacaccggtgcgccgtctgaattggtgaccggcagggtcaaggaatagcctttgacgggataaatgggcagattgagatccaactgcgccaaaaccgtcctgctgaagcaaccgagcgcgcagacaacggcatctgcttcaaaccgccctgtttcggtttcaacggttttgatgcgcagcccgttgtggtcgatgcggctgatgttttggttgaaatgaaaccgtacgcccttttcctgacacaatttgtataggttttcagtgaagaggcggcagtcgccggtcgcatctgcaggcaggtgcaggccgccggcaattttggcggtaacgcgtgccagcgcaggctcaaattctgcacattcttcgggtttcagacggcggtacggcacgccgtagcgttccaaaacggcaatgtcttgttttgccgcttcgacttctttggtttggcggaaaatctgcaacgtcccttttttgcgtccctcaaaattcatgccggtttgcgcttcaaaacggcggaacatttcacggctgtattcggaaatcctgaccatgcgctctttattggtttgatagtgcgctgccgtgcagttttgcagcatttgccacagccattcgatttgatacaggctgccgtcggggcgaaacagcaaaggcggatggcttttaaacagccatttcagcgctttggtcgggataccgggtgcagcccaaggcgtggtatagccgtaagaaagctggcctgcgttggcaaaactggtttccatcgccacaccctcggcgcggtcgatgaccgttacttcatgtccggcctctgccagataccacgcggaagacacgccggcaacacccgcacctaaaacaagcactttcatgtttctccctccggctttttcaaaacagacttaatatgccgtgccgtctgaatattcggattcagacggcctcggatattaatgcggcaattcgccgtttgtgattttttgtttgaagtcgcgcgtttcattgacgatgactttcgccatcaataaaagtgcaatcaggttgggcaatgccatcaagccgttgaatgtgtccgaagccagccacaccaaatcaaggctcaacacggtacccagcataacggaagaaacataacccacgcggtacaaaccggcaaatttctcgccgaaaacatacaccgcgcatttttcgccgtaatagcaccagcccaaaatggttgagtaggcaaagaaaatcaggccgatggtaacaatccagccgccgatgccgggcagcattttttggaatgtgacggttgtcagtgccgcgccgctcacttcaggtttgacaaactcgccgcccgcgccgagcagtcccattaccaacacgatgccggtaatcgagcaaacgacgatggtatctaaaagggtacc

SEQ ID NO: 19 - DNA, 49914 bp, Neisseria meningitidis
ccgcaatgccaaacgtgcatcatcaacgatgtgtgcgaatatcccgccaaagcctgactgccgccgcctgtcaaaatgaaacgcttgaaagttcggacggacgttgtagaatttcaacgtataccgtctgaagccgacaaaatgcgcttcagacggcattaaagccggtaccggcatccgacaaaggacaaaacgtgttcaaaaaataccaatacctcgctttggcagcactgtgtgccgcctcgctggcaggctgcgacaaggcaggcagctttttcggtgcggacaaaaaagaagcatccttcgtagaacgcatcgaacacaccaaagacgacggcagcgtcagtatgctgctgcccgactttgcccaactggttcaaagtgaaggtccggcagtcgtcaatattcaggcagcccccgccccgcgcacccaaaacggcagcggcaatgccgaaaacgattccgacccgattgccgacaacgacccgttctacgaatttttcaaacgcctcgtcccgaatatgcccgaaatcccccaagaagaagcagatgacggcggattgaacttcggttcgggcttcatcatcagcaaagacggctacatcctgaccaatacccacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcaggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataacacacataatttaaccaaaatattttttaaatgataaaatgcccgtcaataccgattaacgggcattttacaaaaatcagttggttgattttaaacaaatattttttacgacaaaaaatatttccgcccattttgccaacaaaacccaaaccggaggcggacagatacgctcccatccggacgcttaacacccccataaccatgcagctgatcgactattcacattcatttttctcggttgtgccaccctttttggcactggcacttgccgtcattacccgccgcgtactgctgtctttaggcatcggtattctggtcggcgttgcctttttggtcggcggcaaccccgtcgacggtctgacacacctgaaagacatggtcgtcggcttggcttggtcagacggcgattggtcgctgggcaaaccaaaaatcttggttttcctgatacttttgggtatttttacttccctgctgacctactccggcagcaatcaggcgtttgccgactgggcaaaacggcacattaaaaaccggcgcggcgcgaaaatgctgaccgcctgcctcgtgttcgtaacctttatcgacgactatttccacagtctcgccgtcggtgcgattgcccgccccgttaccgacaagtttaaagtttcccgcaccaaactcgcctacatcctcgactccactgccgctcctatgtgcgtgctgatgcccgtttcaagctggggcgcgtcgattatcgccacgcttgccggactgctcgttacctacaaaatcaccgaatacacgccgatggggacgtttgtcgccatgagcctgatgaactattacgcactgtttgccctgattatggtgttcgtcgtcgcatggttttccttcgacatcggctcgatggcacgtttcgaacaagccgcgttgaacgaagcccacgatgaaactgccgtttcagacgctaccaaaggtcgtgtttacgcactgattattcccgttttggccttaatcgcctcaacggtttccgccatgatctacaccggcgcgcaggcaagcgaaaccttcagcattttgggggcatttgaaaacacggacgtaaacacttcgctggtattcggcggcacttgcggcgtccttgccgtcgttctctgcacgctcggcacgattaaaaccgccgactatcccaaagccgtttggcagggtgcgaaatctatgttcggcgcaatcgccattttaatcctcgcttggctcatcagtacggttgtcggcgaaatgcacaccggcgattacctctccacactggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgctcgcccatttccgacacgaccatcctgtcgtccaccggcgcgcgctgcaaccacatcgaccacgttacctcgcaactgccttacgccttaaccgttgccgccgccgccgcatcgggctacctcgcattgggtctgacaaaatccgcgctgttgggctttggcacgacaggcattgtattggcggtgctgatttttctgttgaaagataaaaaacgcgccaacgcctgacccctttccctgttcagacggcatatgccgtctgaagctttttggagcaaaccgcaatgaccgtcccccatattccgcgcggccccgtcatggcagacattgccgccttccgcctgaccgaagaggaaaagcaacgcctgctcgatcccgccgtaggcggcatcatcctcttccgccgcaacttccaaaacatcgaacaactcaaaacactcaccgccgaaatcaaagccctgcgcacacccgaactcattatcgccgtcgatcacgaaggcggcagggtgcaacgtttcatcgaaggcttcacccgcctgcccgcaatgagtacgctcggcgagatttgggacaaagacggcgcgtccgccgccgaaaccgccgccggacaagtcggccgggttttggcaaccgagctttccgcctgcggcatcgatttgtccttcacgcccgtcttagatttggactggggaaactgccccgtcatcggcaaccgcagtttccaccgcaatcccgaagcggtcgcccgcctcgccctcgcccttcaaaaaggtttgacaaaaggcggtatgaaatcctgcggcaaacattttcccggacacggatttgtcgaaggagacagccatctggtcttgccggaagactggcgcagcctgtccgaactcgaaaccgccgacctcgcccccttccgcattatgagccgcgaaggtatggcggcggttatgcccgcccacgtcgtttatccacaagtggacacaaagcccgcagggttttccgaaatctggctcaaacaaattttgcgccgcgacatcgggttcaaaggcgtgattttctcggacgatttgactatggagggcgcgtgcggggcaggcggcatcaaagaacgcgcccgcatttcctttgaggcaggttgcgacatcgtcctcgtctgcaaccgtcccgaccttgtggatgaactgcgcgaagatttccgcattcctgacaatcccactttggcgcaacgttggcaatatatggccaacacgctcggcagtgccgccgcgcaagccgtgatgcagacggcggatttccaagcggcgcaagcctttgttgccggccttgcctcgccgcaggacacggcgggcggcgtgaaagtcggcgaagccttttaaaccggctgcgtttcaacaatctgccgatttcatcaaccgtttgtcagggaaaggcaatgattttttcggtcaggtagaaagttatcttattgaattacttaaagataatgatgattatcaacactgtattcaaacacaacgttttaaatccgcccgacacgcggcaaaaaggcaaaacggtataggcacgccgcactttttgcgctataatcacgccttacttaattcggaatgtagcgcagcccggtagcgcacttcgttcgggacgaagggggcggaggttcgaatcctctcattccgaccatattcaaaccgcctcggcatccattgccgaggcggtttttccttttggcggcaacagaaaaatgccgtctgaaacagaatgctgtttcagacggcatttcgttttccctaaccctgccatttgcgcgcactggcacagagtatcggcaaggttcaaaagaccatcggaatttaggaagccgagcttgtacccaacggcagcatcttattcagtaaggctccgtcctgattgggcggtggaaatgccggcatttccacgcagaagcggcacactttccccgtatgtcaaacatcggtaaaaccgtacgccgtccctttgagttacactgcttaaactactctattcccgcccatttgtgcgtctgcacgctcaactgccaatgcacggatgcgtcggggcgactgtttaaaataccgatttggcggatggtgtcgtagatgttcatcgcaccgtcttgctcacagggcgaaaggtagtaatgatgtgcgcggattttgcgttccatgttttcgcagaacgcaaggacatcaccatcggcaacaatccgcacttcgtcggctgtttcgatacagctattttcatatttggcggcgtagcaggctttggggctggtggcgacgtagtcgatttgcggcggcgcgggattgagtccgttggtttcgagacagaggaaatagccttccgccttgagcgtgtccagcagcatatcgagatgcggctgtatggtcggctcgccgccggtgatgatgatgttgcgggcggcgtaggttttcagacggcctaagatatcggacaagcccatcataccgaatgtcaaataatcggtatcacaccagccgcacgccagattgcatttgcccaagcggacgaaaacggcgggcatgcccgtgttccagccttcgccttgcaggctctcgaaaatttcgacgatacggtattgcggattttcgggggcaacattgatttttttcataccgccaacaccgctgccgccgccagcatcgcgggcagtccttgtttgacgagtatgcctttgttgccggacgaaaacgcgccccacgcggcggcaatcaatacgaaaccgagaaacagagtcgtcgcgccgtaaacggcgttgtccggcgcggcaaaccgcgaccacaccagcccgatgccgagaaagccgttatacagcccttgattactgaacaaggtctgcacttgcttttgttccataaattcataaggcagcttgaatatttccgccgctttttcgctgggaatctgtgtcatttcaagccaggcgatgtagaaatgttcgacggcgacgaagaggactaggaggatgaagaggagtttcatgggtattccttttaatgggtgtatttgatatggaaggtcgtctgaaaaaacggggaatccgtacaggagaaaaaaccgttttacggtaaattcaaataaggacgctctaaaccgtcctttccgcgcaggcgggaatccagagagttggaattgctgcaatttttaaatattcctgataaatcaaggtctggattcccgcctgcgcgggaatgacgcggttgggcatgtcttattggaatttactatatcgatacgttcaagatattccctactccccttcatactccgcacacgatgtcggcgtttcccacaatttcacgcggcacacgttcagccccgcgtttttcagacggccgtacatttcgaccgccatattttcggcagtggtgcggcagggcaggcgcagggttttcatgttccagccctccaaaagcgcggcgatttggcattcgcggctgttgccgccgtggtagatgaaggcgtggtcgaaggggtcggtaatgtgttgtttgacaatggctttcaagtcggtaaagtccatcaccataccgtctttcgcgccgcctttgataatgccgtctgaaacggtgatttcgagtttgtaggtatgtccgtgcaggttttggcatttgccgtcatgcccgtcgagcatatgcgaggagtcgaaggtgaagattttggtgattttcatgggttctcaaatgggcaaatagccttgaaagccgatttcggcgggtttgccgtgcggattcggggtcaggcggatatggaaattgccgatgcggtcgagcgcaagcaggttgtccacgtcttttaagttgtctttatgctgctgaacatagctgtcggtcaacagggtttgcagggctttttgtttggcttcggcaggcgtggcggcggcgaacagcccgaaagcgtgtgcctcggcaagctgacccgcgcgataaccgccgacattggcgaaatacaggcgcggggcgtgttcagacggcattttcgttttgggcgtttcggatacggcgatgtcgtaaccgtccgcccattcgacaatctgccagccgtcgatgtggattttgtccgcatcgccgaaccacgcggctttgagcgcggggacggcctcgcggtagttgtcgcacacggcaaattggatgtcgtgcacttcgatattcgacctgccggcattgccgccgaggtaaaacatatggagcttgggcatatcgtattccttatggtttgcgcgtgttcagacggcctttttactttccagatattccgccagcccgcgttcgcgcaagatacagctcgggcattcgcggcagccgccgacgatgccgttatagcaggtgtgggtttgctcgcggatatagtccagcacgcccatttcgtccgccaacgcccacgtttgcgccttggtcagatacatcagcggcgtgtggatttgaaaatcatagtccatcgccaaattaagggtaacgttcatcgatttgacaaacacgtcgcggcagtcgggatagccggagaagtcggtttcgcacacgcccgcgatgatgtgccgtatcccctgccctttggcgtaaatcgcggcatagagcaggaaaagcgcgttgcggccgtctacaaaggtattcggaacgccgttttcggcagtttcgatggcggcggtgtcgtccatcagggcattgtgcgtaatctgccgcatcaggctcaagtcgagtacggtttgtttgacgcccaaatcctgcgcaatccagcgggcacgttccagctcgacggcatggcgttgcccgtattggaaagtaatggcttggacgttttcgcgcccgtaggtttggattgcctgaatcaggcaggtggtcgaatcctgaccgcccgaaaagatgaccaaggcttgttggtttgacatatcgaatcctagttttggtaacgcgggaggtttgcgaaccgcgaagttggacagtaaagatgcggattatacaggcaaacgtgttcagacggcatctgaacgccatgccgtctgaacacgcggcttatgccgacttgacggcgagttccgccaagcgtttgctttgtgcgaaggcgatattgttttcttcggcggtcaggacgggagccgctgtcgggaatatcttttttgacggcttcgcagacggcggagactttggggacggtgcgcaatacggcttcgcaaccttcaacgctgtcgatgccgcgagcgattcggagtgcgggattgcgggtgctgccgttttggaaatagtagaggacgaggattttgagggggatttgggttcatgggcggattccgttaaaatggttcggtcttcagacggcataacagttgttccgatgccgtctgaaacagccgcagttcaggcatttgttcctgacggcaaaattggctataacatcgggcatcaatgcccaacttactgaccgggcaagaaattatgacctttttacaacgtttgcaaggtttggcagacaataaaatctgtgcgtttgcatggttcgtcgtccgccgctttgatgaagaacgcgtaccgcaggcggcggcaagcatgacgtttacgacgctgctggcactcgtccccgtgctgaccgtgatggtggcggtcgcttcgattttccccgtgttcgaccgctggtcggattcgttcgtctccttcgtcaaccaaaccattgtgccgcagggcgcggacatggtgttcgactatatcaatgcgttccgcgagcaggcgaaccggctgacggcaatcggcagcgtgatgctggtcgttacctcgctgatgctgattcggacgatagacaatacgttcaaccgcatctggcgggtcaattcccagcgtccgtggatgatgcagtttctcgtctattgggctttactgacgttcgggccgctgtctttgggcgtgggcatttcctttatggtcggctcggtacaggatgccgcgcttgcctcaggtgcgccgcagtggtcgggcgcgttgcgaacggcggcgacgctgaccttcatgacgcttttgctgtgggggctgtaccgcttcgtgccaaaccgcttcgttcccgcgcggcaggcgtttgtcggggctttggcaacagcgttttgtctggaaaccgcgcgctccctcttcacttggtatatgggcaatttcgacggctaccgctcgatttacggcgcgtttgccgccgtgccgttttttctgttgtggctgaacctgttgtggacgctggtcttgggcggcgcggtgctgacttcttcactctcctactggcagggagaagcgttccgcaggggcttcgactcgcgcggacggtttgacgacgtgttgaaaatcctgctgcttctggatgcggcgcaaaaagaaggcaaagccttgcctgttcaggagttcagacggcatatcaatatgggctacgacgagttgggcgagcttttggaaaagctggcgcggcacggctacatctattccggcagacagggttgggtgttgaaaacgggggcggattcgattgagttgaacgaactcttcaagctcttcgtttaccgtccgttgcctgtggaaagggatcatgtgaaccaagctgtcgatgcggtaatgacaccgtgtttgcagactttgaacatgacgctggcagagtttgacgctcaggcgaaaaaacggcagtagtcttgagtatttttgaaactgtatttttatcctaaagacattttcctatctgctgattccaccgtttcctttctgtgtgccgccataatttttatgatagacaagccattcaagtttgcattgactgctttttcattggcaatatccaaatggctggtcgctgcatctaaaaataggattttcggttcgcaatattaaggcccgcgccaatacgatgcgttgtttttgtccgcctgacagtgcgctgcccatatcgccgatcaaggtttcatagcccataggcatggcggagatttcttcgtgaatcatagcaaggcaggcgcaatgttcgatttttcctctatccggttccgtatcgaaaaaacaaggggctgtactagattagccctaaatcccacaccaatcccgcaggattttaagctgttgagacggtgtgccgaagttaaatcgaaattcgcattctttcaagaacagcgggaaagatttacgatcgattccgttgtattttcgcaagacgcgtttagtctagagtctgtatattacatttatttttagggtctgctagccaatttcttgttcccttcattattttatcttctgaaagaaaattatttttttccatgctattaatattaatgatatgatttttatttaaaataatttttccatataaaatttccggtttgtaatagcaagagtctgaagcaaatccttgcccgtcaatataagaaaaataaatgttatcatcctccttataatattctaaaaccaatccggatattattttatcaaaattcccttcatttccatctttcatgactaaaatataattagcaggccaacctttatcgtaaacatattcaaactgatagttcccgaaactctcgatatccgaactaaaaaagaagaaaagcaaattaatagccaatacaaaaacaaataagaacaaaaatagcaaaattttcaacttagttaacaatatttacctctcctttaaattcaatcctgaaaggtaccccttaccctgggctaccaattatagtttccatatttctaaatattgtttttacattacttttttctccccccaaaggaatgcattttaaaatcatgcttttcaggtgctaatcgatacttaccattaacatctttaatcacagatatatttccatgtatagcccaacgtgaaaaatctgagtattatatacagttataccttactgaaacaaagctagctgtacatatctgtaccatatttttactaaaaacaaaaaatatttataattattaaggataagataaaaacccccaacgccagattaattcttaataatttcaaataaaaaatatttgagattttttattttccaaataatatattgaaatatttaaagttaaggtagcttgatttaattagaaaatcaaaaaaaccattaattaatttttcttctttaaatattttatatgatattataaaattaaataacattgcgaaaacatatgaaatcatcaaaataccaaatatatagtgggaatgcattattatttagctccttcttttggctttgacaaattgacagtccattgatatccaatgcttgcatttgcaattgctgacgcacctgcccctgttttccctgttagtatcaatggttcttttcttgcaagatgtgcacctgcacaaccacctaatactaaaccaccacctattgtaaatccttcctgttgtatctctaatgataacattttcttctcgtgccgcccttaatacagattgtggaattggattgacctgagcaggaacttctaaaataagttttcctgtaagttttcttcctcttagcggagcaggtgtacttggaacattggaaatgacaaagtgagtacgcaaaccacctgaaggcgatgtgtttgaacctgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaacctgttgaaggccgccaacaggctaagtgcgcccgcgccgcctaaaaggcagcccggatgcctgattatcgggtatccggggaggattaaggggatatttgggtaaaattaggaggtatttggtacgaaaacagccgaaatcctgtgtttgggtttcggatgtcggggaagggcttttttgcaaaggtctcaactcatgttattgcaaagatctcatgccttgttttgccagcaggttgagttcttctccggcaatcagcgtggtaaagcctcgccacaacacagatctatgtactatggaagggcttcaatttatagctttcgaaaatctttcagctttaagacggcctaaagttgtaatctataaaacaggagctcagagttttacggctcactctcgcttcgcgttaccaaataccagcttatcggttttgaacgtatagtaatctatccaatcctgcagatattcatacggataagacaagtcatactgtttcataaaatcgaagatgtcttgatattcgtctgccggcagcggatcgtaaacagtcaaatccctcggcgcgatttcgtggtctatgcccaaatcgaaaccgtgcatggatgcgattttggcgtaggtaacgatttgcggctgcaggtagaaatcgaaataggacaatgtttctttggcagccatacgcgcggtttttttatcaaaaagcggctctaaggcggccttcatcgcctcggcatcctgttcggcgaaagcgaggaagaagcggtaatcgtacaaccgcttttgcagccatttgctaggggtgggatgcgccaagactttctcgctacgttgtttcaaccgatcaagctgcttaccctccaccatcagcagagtattgtaaatcatatgacggttgaggtcgtatcggtttacgaaggcttctgtatcgttggcgatgttgtcgatattgcgcaccaaaaactcgcgcagctgcgggctgtcgctcatcagcatcagaaacatcggatcttgaatgttgagcatgtcgcagggaaagaagaagggttcggggtcttcatcatctacactctgcaaaatacccaactttcctgcaacataagcatattgcttgaatttcttaagatcatgttcaaatagataggcatgggaagccgcagcttcagtgtacattaaaatgtatttcatcgctgcaagcggcacgccttttttttcatctacataatctatagattcggggcaaccgctattgaaattagcagtattgcctatgattacattagtaatatgttcataccatttttgggtggtcatcatattgtgccccattgttatctccttatattggttttagaaggaactttgacagaaagaataacggccttacctgtttgacgatcaacgcctgctattgccgtttttaatttgccgttctgatttgcttttaagacaactgccttagcaggactaccatcaggtaaactttttacaacttgtttaatccattcacgactcatctgcgtatatccacccgcaccattcggattcagctgtaccgtaccgttcctaatctgcttactttctacaatcaaaacaacactaccatcggcagcctgccatacatgatcaaaaccgttatttccgccgtatttgccgcccgaaagcactctgaagccattttgtttagctaaagagtcaaataactgctcggtcattttacctgtcgtgtccttccttcgccaatagctttcagcaattgtttgtcagttgctgcagtaacccttaattcagtttgaccgattttgattttggttttactgacatagccctgtgcagtggcaacggttgctgccttgtccaaggcttttttcatgccttgtaaattttttgccgctttcgctactttataggcctgtatcgattcaccgatacccggaaccacacccagcaaagcaaacaggtgatcggcagcggtctgtgcttgtacaaaactctgtatatcaccgataattggaataaatcctgtctgaaaaagctgtttttcagacgggatttattccaaacattggtattttatcccgcccagtattcgctaccgtcttcgggatctatccatacggcgtaggcaggagcctcgaccgtaagccacattccaatatcaaatggggcatagccgggaagtggattgggttcgatttcatattcaggccatacttccctaaatatttgttcccattcttcgggcgtatgcccgataatttgcccgtcgcgttgcagtttcagatgacctctgcgcagcagctctttgaaaagaataaagaacgcttcagttttttcctcaaaatcgctggaaaagtctttgatggttgaccacaaacaactcaaaggaagctcatagttgatagtgaactctacatcctcttctaaacgatcttgataccgtttatgaacatcgtgattattcaattttctcatttgaattttatttccctataacctattcttgcttacttaattagaatcagcgcaaagattttcagggtatccccatactaaaataaatttattaatttcagggtatatattgattgatatagactctccttttctacatagaaaaccatgtccatagccgtcaagtggtaaataattatcttttttcaggtcatttatgaaatttaaaaaagtagtattactatattctgaaaaaataaatttatattttgtatatcctcctcgcatgtatttatctttactctctaagcgaaatttttctttttgggcatatagcaagatatttgatatagatttcttttctaattcagcatattgccttatttgataatagtcataaaatgtcccaattattagtatgactaacacccaactcattaattcaaatgttttttttagaaaactaatcatatatttcatactaactcctatttttttatgtttgcactaataaatttatcaatatcttttatgttacctatgtatattgttttttctactcctgcagcaacaccacttcccaaaccgatttccccaataatttttgaatctttaaaaggagatttagatttagatattgttgaacttaccgaaaagcaggctcttgtcagacaaagactaccaccaacactctcacctaccaaagtctgggaaatcatttctgcataggctttattttgattactatttctgaaatcattcatagatgcttcttttaaataatcattaggggaaacatttaaaacccaaccgacagataccccacttatatttgattttgttgattttacagtactccatattttacctacagagaaatatacattgccatttctagtgttaataattaattttccattaaccatacgattcccgaatttattaggtaatttcatttctcctgaaacacttacaaagtgtggcaagcccagtggtcgataagactcacaaaagctttctgctcctcctgcactcatacataaagcataatttccactcaacaaacgatcctgtatatcatttaaagaattattctctaccgccacagcagccgcattcgccgccgtactcacatcccccttactcaacgccgcaaccgcccctgctgccagcttcgccttagcaatgatttttgccctgtccttcacattcaggctgccagggtctctgccgtccagtagggtttcgccaaggatttcaccgaccgccgcaccgatcgcaccatcttgacacttgcccttattcgccgccgctgccgcacagcccgctatggcatgggcaatcttatgggcaatgtagtgctgatccaactgtttgattttacttgctgcctctccatgcgcagtattcaccaaagccgcaaggatattcgcttccagattgtctttcaggctgccgccgttgacagcggtattaatcagtgcggcactgcccgcattggccaggttgacggtcaggttgttgatccactgcttatcgctgacattgttcagtgccgaagcaccgattttgtcggctacgcctgcggtagcgacggcaaccatcagatttttcaccgtgctgcttctgcccagctctttcagggtgttaccgatattgcctttgttgttgatgaacgatacggaagcctggctggccaaagaggcaaatgctgcatcggttgcggcggcggccgcaccgtttaatcccaatacggctccggttcctgcgcctgaggtgaccacggtaacggccagtgcgataattgcggctccggctccggttaggccttcctgtttatagtcccatttgtcgtaagcgagctgtacttggttccagttcacgtccttgaccgtctgaagctgtttcagataggcatattcgggctgtttggccagcttttcgatttcggttttgaggttgcctttggggatgtcggcgatatagccgccgggagcggtcagcttaggcagtgccggcccttcaaagctcggtagcttcagcgtttcaaccgtgctgccgcttccggcctgcttttgccatacggtcgagttggattccagcttttcttcggtttggatgcggttaacgatgccttttaggataattttcgcatcggctcgggctttttcacccacccctgcctgtatgtcggctccggaaagggtggttttgaattcggtgccttcgagtacggtatcccagccggaacgggttttggctgtttgggcgataacgcgtacgggcagtttggtttcgttcagctcgtttttgctgtaattgcttttacccactttgatgccgatgaaacgggtacttttctgaacattcaattggtgttggtgaatgccttcggctgccagcagttgcattgaggccgtctgaaaaacggatattcagacggcctattgctactttaaataatatttgggtttaaaatatcatcgtatttcccaaattcggggaacagaaaatcaattatttaaatttttcatcctcataatatgggtgatcaaaaagctctccttcccacatatttatttcttctatgcctttatctttcataaactcatgataatcataaaaatcttttccatattgtccgtaaaaaattttcatatccccaagccacatagcataacattcatcgcataaaatgacctccccagagaaatatttaggctttgcatgataaaggtagccttgctcacatcttgggcaaattttaatttctttatccataagagattcctttcttaattatttctgaggatatgcagaaatgattttatttgttcctttttgcacaacaatccgcacttttgtttctccttttgttccaataggtttcttcatatctacaagatatacggatgaatcatttggcaaaggatttcctttcattctccaagcttcatcaaccaaaggcaaaacttctttacgggacacattaaaaacagaatgaacaggtttgtttggatttggaattgtatgggctaaaacatgtttaatcctattaccatgcttagcatctaacccataatctaaccccgccggtgttgtccaaaccttattaaccttatcataagtaagcttgattccggtctgcttctgaatttcctgtatggctttagccgtatcaactgcttcgtctcccgccttcagaacataagccccgcctcggctgattttagtcgcacctgccggaacaaagggaacggcagctgcggcggcatccacaccaaaatcaatcgccgcttctcgagccatctgcttatcgccaatagatttggcgtaaatccatttaccgccgtcccatacgaggttgccaatatcccaaataatatctaatgcattatttttaacagctgtttcggaagcatttgccgccacatcaacattgcctcctgtaacacctacagtcgctccggctaccaattttgcatacgcagtaatattcgctttagctttttcaatttcagaagcagtcataccgctgaaatcggtattcttaaccaaagcctccccgacaatctcccccacgaccgcaccaatcgcgccgtcctgacacttgcccttattcgccgccgctgccgcacagcccgctatggcatgggcaatcttgtgggtggtatatcgctgccagccctctctgttgataatcttgcgtatgattacgccgtttgatggctaatcgtacctacgcaggcttaaaatttccatcaatccatatcatttgagttttcatcttcataatatggatgatcaaacaaatctccttcccaaatacattcactcgttataccttgggattccatgaaaggaacataagaataaaaatctttttcatattctccataaaatatattcatacctttgagccatactgcatcgcattcatcacacagaataatttcatcatgaagatatttaggtttcgaatggtagagatagccttgttgacaagcaggacacattttcattctcttattcatgattactccatataatcgatttatttttgtgggtaagcagtagtgatttgattgctgcctttagtctgtacaacaatacgtatatagcaacctgataatttcctggtttttatcagctttatcctcagattccaaacccaataataaaagccgtctgaaattttttcagacggccttaaaactcaattaaataatgtccggatttaacaccaaatcatattcgccaaactttggaaatagaattaccttatctttttgggaatataattctgttttttcatatcgctcattattaataaaatcctctttcaaaacatagcaatcatccgtattttcattgaagaaataagtatatccttctgctaagtcatgagattccaaagttatataatctctccatacagccatagaaagaaaataataattcgaattggaatatttttgaaattgatgggttaaataatcccttccaaatttatcgaaaaaatgtaccgaaaaaaaacctacttcctctcgcaaggtaattacatattcaggttgtgtcgccgaacctattacggcagtatataactcccctttaagatgtttttcctcagcttgtttctcagaaaaaggcttatgaagtttcttataaccataagaccactgctcacaataaaaaatatctttcttcatttgtaaatccttcctgttgtatctctaatgataacattttcttcttgtgccgcccttaatacagattgtggaattggattgacctgagcaggaacttctaaaataagttttccttcaagctttcttcctcttatcgtagtaggtgtacttggaacattggaaatgacagcaccagggctatattttctaacagcctccttgatataaccaatccccgtactttcttggatttgagaaaattgggtaaattttcttgaaataatttcctctgtcgcaggattatacgaatctaccctaaaataccccgtcgccgatttaggattggctacataaagctcattataagggtattttgatgacatgatacggttaaattcattgccgttgtttatcctgattctataaattgggtcaacagcaaagcctctggattcccttaattgattataatattgcctgtatgtttgtacatcatgtcttgtccacggctctctaggattcctcataatagcaatcccgttaaatttcggatccagccttcggatttgattggtaatggcctggatttcaagaatggcatattcatgttccaattcttgtcgcgaagtccaacgtatatttaccctcctgcgagctaaaagactattattctccactgccacagtagccgcattcgccgccgtattcacatcccctttaaccaatgccactgcgctgcctgcgataatctgcgagtaggctatgactttttggcgttcttggggtgacagtttgcctacatcgcgtccgtccaacagggtttctcccaccatctcgccgactgccgcgccgattgcgccgtcccgacatttgcctttatttgctaccgccgatgcacagcctgctacggcatgggctatcttgtgggcaatgtagtcttcgctgagattaaatttgattttgctcgctacttctccgtgtacggtactgactatcgcacccagtgcggcatcgcccaagttgtctttcaggctgccgccgttgatggcggtatggacacttgcggcagcggtgctgttgatcaggttagcggtcagtttgcctgctgcgggactgtgaaaatgtttgctgacggcttcggctgcttgggtgttcagcccgcttatgccctgcagtacgcctgcggttacggcggcggtggcggcctgtctgacggtgctgcttttgcccagttctttcagggtatggtttatgtctcctttgttgttgatgagggaaactgcggcttggctggcgagactggccagtgcggctttgcctgcggctgtggtgatagctgcagctgatgtgcctgctgctactccggttgtggctgccgttcctgctgctactccagttccggctgccgttcctgctgcggctcctcccgctcctgcgcctgccgcgcccgccgttccggcggctgccggggcggacagtgcgccgtaggtcaatacggttacgacgataacgacgacagctgctgctgcgggtgtcatgccctcctgtttgtagtcccatttatcgtaagcaagctgcacctgattccagttgatgtttttcgcaacttgaagttgtttcaaataagcatactcgggctgcttggtgagggtttcgatttgggttttcagattgcctttcggaatatcgacaatgtaaccgccgggtgcggacagtacgggcgcaacgggaccggtgaaactcggcaattgcaaggtttcgatgttactgccccgtcctgcctgtttttgccatagagtagatttgctgctgctcacggtttctgtgtggatgctgcttttgatcccttcgaggataatcttggcatcggcccgtgcctgctcgcctacgcctgcgcgtatggttgcgccacccagtgtggtttcaaactgtgtgccttgcagtttggtatcccaacctgattgcagattggcagattctgcaactacccttgagggcagcgcggttttcatgacttgggtggtggtgtcgtgtgctttgctgtagctgatgccgagaaatctgcgccttttttggctgtcaagtttgtcgtagttgagctcttctacggcatagagtgtcaatttccgcccggcttcgatgttaatgctgcctttgggggcatcgaatgcggtggcgtaggcgtcgatgctgccaccagatttgatgtcgatgccttgggatgcgctgagggttactgcgtcgggcttggcgtttttgtgttctttgacttcggtaatgtgtttgcggttgtaccatttgccagttttgtagctgcggcgttcaaaggtatagagttcgctctgtctcgcatagtaatattggtcaccgtaagattgaattttgattttgccgttttccgaactgatatccgtggtgctgagcaggatgcgactgttctcattggcatacggtgcgctaatgctcacaccggttttacccgaaagttctgcagcaagcgtagggggtgtcttcagcacgcacgcgtctgggcagtatatagggaatctgaatatttacttgcataacaaatgccgtctgaaaaattgtgagcttttcagacggcattgagccgtaaatcatggaacgcgtgcgtgctgaagcacacaccttacgcatggattttaggtttcatgcaggctacagtttgtttgagaatatgttttttgtatttctttacactttttttgatattcagggtgagctattaagaaatcagatattgcaatattaaagtaatgatatgctaaattaataggtataattaattcttcaggattgaaatcatctccaactgaaaaataaatagaaggagctttatcaatatactcaaatccatttacctcttcataatctccaatccatctggtagcatctattttttcatattgagcacctattactccaaaatgtccggtagttgtaatatttttaaaacactctaaaagcgtatctttagtttcaaattggtaaattgtttcaaaaaaaatcgaaataacaaaatggttgttatttatagattttttatttaagtttagaaaaatattatttttcataatttttcctttaaattattctgggtgaatgtttgtaattcttcctgtatttacatcaaaatatgatctaaatttgattccgtcaaaggtttctgagaattgaatgacattttttctttccgatattgatttagttctttcattttgagcaattttagaggcttttgaatatccttgtgaagcagcattttgagccatttgaagtattttatcatcagaaaattttttaggattataaacagtttttatacttgaaatttccttaaatccaccatcaggtttacctgtcctgtctagtgtaggaatctcatatttaattcgggtaatgccttcaatatcagtttgggtttcagattttacgcgtcctcctcgtgaatttagttctgccataaaattggtgcggttatgggctcctttaatgccctgtttttgactaaaaccatcagcatttgccagatgtctttttaggtttgtatcgaaactgatgccttccgggtatttgacattagtaataggtgtattttgttttacaaaccctcttggtattggaatgaatctaggattaactcctgaaataagtgtataaccttggtcggacatccattcggataaaggctttgtattgcccgattgaagccaagatttagcagcagtattcaaatgataagactgtaaagccaaatctgcttgggtgtaagatttgctgaataatttataccattcatcatctttaccaattagacctgcttcccaagatgaatgaaggcttctactatcgatcaaatgttgttttctgattgttctacattcagtactacgggatatatccgtacatattgcaatcgaagcagcaagtcttttatcagcaacattttgatacttttttacagtattttttctgcacagttgaggattattctgtttggcgcatgcagtcatttcgttatcaaattctctaccctctttgtcgctaagctgattatttttcaccgctacctcagccgcattcgccgccgcatttacatcgccgccgaccacaccgcttaccgtaccggcaaccagtttgctgtatgccaaaatctgttcgcgttctttagctgtcaaagtgtcaggatttttgccgtttgtcaaagcctccccgactatctcgcccacagccgcacctatcgcaccatcctgacacttgcccttattcgccgccgcagccgcacagcccgctatggcatgggcaatcttgtgggtaatgtagtgctgatccaactgtttgattttactggctgcttctccatgcgcagtattcaccaaagccgcaaggatattcgcttccagattgtctttcaggctgccgccgttgacagcggtattaatcagtgcggcactgcccgcattggccaggttgacggtcaggttgttgatccactgcttatcgctgacattgttcagtgccgaagcaccgattttgtcggctacgcctgcggtagcgacggcaaccatcagatttttcaccgtgctgcttctgcccagctctttcagggtgttaccgatattgcctttgttgttgatgagcgatacggaagcctggctggccagcgaggcgaatgcggcatcggttgccgctgcggccgcgccgtttaagcccagtgcggctccggctcccgcgcccgcagtaaccacggtaacagccagcgcaataatcgctgctccggctccggttaagccttcctgtttatagtcccatttgtcgtacgccagttgtacctggttccagttgacgtctttggtgacttggagctgtttcaaatagcaagcgtagggggtgtcttcagcacgcacgcatctgggcagtatatagggaatctgaatatttacttgcataacaaatgccgtctgaaaaattgtgagcttttcagacggcattgagccgtaaatcatggaacgcgtgcgtgctgaagcacacaccttacgcatggattttaggtttcatgcaggctacagcttgctgctattcatcaaattgcggccattgaaagtctgttgttttactttcacctctcaacagtctaatcatatcgcttttgagaaactcaaaaaaatttttaatattaccaacatagagcatagcttcacatagtgaactacatgcagatttaatgtcttcattgtcaatagcatattgatattccttcatatgctgaaaaaaagaatcaaagtcttcttctaattcatcattccaatcagatgaatagttagaaagccattgtaagtcaagaggatcttcactattcaatttttcagttgtggctttctcataaagatcaaatccttgtttaattcctaactctcttaaactttcttttactacattaaaatttttcatctgaatcaccttatttaagattcaattttcgcccttgccctgctaatgtcttagcttaattttgagcgagttttaggtttcatgcagactacagcttactcagcacacacgagtctaaacagtatacagggaatctaaatatttactttcataacaaatgccgtctgaaaaaattgagcttttcagacggcatatggccgtaaatcatggaacgcgtatactgaagcccacaccttatgcatgggttttagatttcatgcaggctacaacttgctttctattcatcaagagatggccatgaaaaactattctttttatactcagcactcaataatgttgatatatcagtttttattgaatcaaatataagagatagattacctgcgtaaatcatagccataaataaagaattactggcaattttgaaatttttatcgtttagggctaattggcatacttccatataatctaaaaagttttttaaatcctccttaaattcattatcccaattcccgtctgaagtataatctttaatccatttcatattagctgtttcatgattaacttcttctgatacttttggatctgtcaaatcaaacccttgataaagccccacattaatcaagattttttttatatcattcaatgtttccataaaatttcctattttaagtttaatttacgaccttttgctgccccagttttcatttggttaagcgaaccatccatatttagaacaaacttaaagttcccatttttatcaaaaacctctaaatgatttttatgttggccatctaaataaaacctatcaccggtttttaataacccttggtttctttttaccaagaagacagactgcccttgctgcgtcggaagcgttgtcttttctgaaatttgagccagctgttttccaaaaggattatttttcatgtatgtactcatattcggtacagcacctttattagggatataaggacgatttttttctaaaacttccttgaccttttgtgccgcttcccctttattagcgcgattcagctctgttccgacgacaatatcaataacggctttggcatcgttccaatccaatgtttcgtcgaataaggtggtcaggttgtcggctaaattataaccttcgtctttcaacgtctgttttaaatctctaacgttgattttcccgttttttaatccttttctggctaccttataaaccacttttgcagcagttacaacagctttaaccgcattattttctaccgcgttttgtgcggtttgtgcagcagtattgacatctcctcccgttacgcctgcaactgtacctgccgcaagtttggcataggcggtaattttcttaacttccagatctaattgttccggggtcatatcgctaaaatcggtatttttaaccaaagcctccccgacaatctcacccacagccgcaccgatcgcgccgtcctgacatttgcccttattcgccgctgcagccgcacagcccgctacggcatgagcgattttgtgggcgacatagtgctgatccagtcctttgatcttactcgccgcctccccatgcgcggtattcaccaatgccgccaggatatttgcctccagattgtctttcaggctgccgccgttaacagcggtgttgatcagcgcggcactgcccgcattggccaggttaacgttgaggttgtttacccaaggggtttcgctccaagtggcaagggaagaggcaccgagtttgttggatacgcctgccgttgccgccgctacaaccagattttttaccgtgcggcttctgcccagttccttcagggttttgccgacatcgcctttattgttgatgagcgatacggaagcctgagaagcgagtgaggcaaaggcggcatcggccgctgctgcggctgcgccgtttaagcctagtgcggctccgactcccgcgcccgcagtaaccacggtaacagccagcgcgataatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcagattgcctttggggatgtcgacaatgtagccgccgggagcagagagcttgggcacaacggggtcggtgaagctcggcaggagccgcggagcttcaaacaaggggggcttaacactcccgcgtctgtacagcatacagggaatctgaatatttacttgcataacaaatgccgtctgaaaaattgtgagcttttcagacggcattgagccgtaaatcatggaacgcatgcgtgctggcgcacacacgctacacgtggattttagggttcatgcaggctacggcttgtttatttaaattcatcacgtttcattggaatggttaaaggggtttttaataaaaattgtgaattatcgttataaaaagcacatccacattgagtacagagatacaccgtttcatgcgtattttgttcttctaatttttgcatttcaccccattcgcagtaaggacagactctttcaatatgttcaataaataaatattctaaaatatctctaatatattgtacaaagtattgaaatttaaaatttcctgatgatattttacgataaatattgtttttgagataaataatttcctctctattcaatatagatttttcaaccggatagtcatcgggattcatttcgatatatttactaaagtcataacctaaaattttaaatttatcaatgacaatatcgtttgataaccatgaaatcaaaactttcaataaatcaaatgaggtagagttatgatttaaatggcttaaagcatcatttaattctaaaatatattttttttcaaagttactcatatttagttagtttccttttactgggtatgtagtaatcaaatttcctgacttatctgtaaatactttaattgtagttgtgggttgtccaccttctttaatagaagtagtaccaataacttttcctacatcgacagtccgcatatattggccatcaggagtcatcgatacgggagaagaaactactttattactttgaagtataaccttcaattcatttggggagatggtaaaaactgaacggttattcgcaataggcctatggaagtgcccctcaagaacatgctcaaagccagcagataccggttgtcccgtttgtctcattggtgtatatcgagtagtactattcgctatattaattcgtgtatttacagcacctatattttttgattcttgtagtaagccatcaagttctttaactgtctgggttggtatagcctgcttggccgccttcgctttcgacaacgcccccacaggcgcttcccaagcgttgcctaccgttaccgcacccgtggcgattcccgcgcccgcttcggcagcctgagtgaccatgacagtacaaccagaaggattagccatgcaggtgctgatagctaatttacccgctgtaccgatcagcggagctgtccaacctgcagcataaaccccatagctggtaatcacaatcgggcctgtgatgccattacggatattgcttatccaaatggcagcatccttatcctgcggattagtcatcgcacctgctgcatgtgcaggcataataccttggataattttttccagtgcggttttgtcgggcttctgcggttgatgctttttcgcattggtaggggtactgtcaaaattcaaagcattattcactaccgccacctcagccgcattcgccgcagtattcacatcgccgccgttgagtgccgccacgctgccggcaataatcttcgagtaactgataaccttatgcttttccgcatcgctgagtgtagcagggtttctgccgccaagcatggagtcggctacgatttccccaactgctgcgccaattgccccgtctttacattttccttgtaccaatccgctaacacacccagccaaagcgtgggcgaactgtttggcaacataatcgtcgctgaaggttgttttgattttgctggcggcttctccttggaagctattaaccaatgctcctaatgcggcattgcctaagttgtctttcaggctgccgccgttgacggcggtattgataccagctgagatacctgcattactgagattggtagccagtctgcctccaaggttggcaatagtttgattgcccgtactgctgaacagttcggttcttaccttgctgttcaattgggcaatatctgcgcccatctgatttaatgcacccgccgtcagggcagaagtgacaatctgcttgaccgtatcactggtgccgagatctttcaacgctttgccgacatcacctttattattgatgatggatacagctgcttggctatacaaggaggctaaagcagcggtttgcatggcagtcgctgtagaaacggtagtagctgctgctgtcgttgtggcggctgttccggcagctgcggctgtactacttcctgaagcggctacaccgcccgctgcggttgcgccgtatccataagtcagtgcggttacgattatggtaacaatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcaaattgcctttcggaatgtcgacgatatagccaccgggggcggtcagtttgggcggagtagggctttcgaagctgggcagtttcagcgtttcgatagtgctgccgcgtccggcctgtttctgccatacggttgagttggtttctaatttttcttccgactggatacggttcacaatgcctttgaggataattttcgcatcggcacgggctttttcgcctacacctgcctgaatgtccgcaccggccagcgtggttttgaattcggtaccttcgagcacggtatcccagcctgaacgggtggctgcagtttgggcgacgacgcggacaggcaatttggtttcgttcagttcgtttttactgtaattgctcttgcctaccttgatgccgataaagcggcggcttttttggacatccaactcgtgcttgtggatgccttcttctgccagcagttgcagctcttcacccgcaaccagggtaactttacctgcaggggcattgaagcgggtggtattagcttcgatgttgccgcctgcctgaagcgttatgccgttggcggtcagctcgacgggggctggcataatcaggtggtcgcgggtgctggtaaacttggtttttctgatgattttgccgcttttacctttggtttttaagaaggtataggcatcgttttgtccagcctccagtacaatatcactatgggctttgatgtctatgctgcctgagggagctttgatttcggatgcaccgataataatacgtgcatcatcgagtgccgcagctgcatgaatacttacccctgtacgtccggtcaaacgtgaaggcttgttcagagcagctttgtcgtagtgactcttgtaggtgggcttgccaatttcatattggtcggttatgccgtcaatcagaatagcagccgcctctgaatctgctgcctttggcaatacgcctgcggcgtgaaggttcagttttttggaagcggtaatatcggaaccgctgatttcgatgccttgtgcggaaatcaagtcaatattttgtgcagaaagcttggcttgcaggtattctttgcctttgggttttttacctttaacttccttgttgatggcttgaatatagaaagcgagacggtcgcgttcttcttgcagggttggaatcagcttgcttttaggcgagctttttttcaactgcgcaatctgctgttccaattctttggatttttggttgagttcagccgctttttgtgtaggaaaataattgctgaatgagttgtttacggcttcgatattcaacttgcctttggtggtggcgacaaccaagtttttaccggctgtaattttagaacctcttaaatctgtttctcctgtaaccagacggatattgccttttgcttccaatgaggaaacttgagcactaggcgcacctgcatttcctccttttgcagacaacagcaattttccgcctgttttgatgctcaggtcggtatgcgcactgatgcggttggcaggttcgatggttaatgtgccgctacctgcttcaatattcagccgtccggccaatggttttaattcggcattatcttccaaagttttggtcgaaacggtactccaattgatgttgccgcgcttgactagggcggtaccggcagtaaggttgattgcacccgctctcagcgtggtgttgtcggcaatttgggaatagcgcgcattgagtgccaatacaccgttagccaccagcttgttggcagaaggcagtttgtcgttttgccaaatctggctgccggtaatgcttagatgacggtgtgcgtaggcatctacttggttgagcgttacccgctcgtgttgtgcattaagatgcgtattatgggtagactccagcttggtattttctatgctcaatgcccggtcggaatgaatgttcaatgccccgcttttggcatggacgttaaggttttttaagtcggcattaccaccgttgtttttgatgctgatgtgttttccgttgattgaattgcgttgttttccgtcaccaagctgaataccgttgccggcaaccaacgtaatatctcctgaagatgaagtgatattggtattgtctgctttcagacggcctttaccaaccgatcctgcattgacatcggccttggctgtcagggtattgtgaccggtaaagtcggcattaccgttggccaataaggatacatgaccgtctgcagaaacagcatgaaggccgtctgaaacgatattgccctgcaatgcggtggtttcgagagccttggctgcgttcagcttggtattgcgaagctgaatattgcctttggctgcctgaatgtgcagattacccgagttggtacgcagattggtattggtaacattcagcgagcctgcctccacacccatgtcttttgaggcagtgagggttttactggtgccggtaatatgggcagcgttatccgatttcaaatggatgctggcggcagacaaatctttatcaacattcaaattcagatctttacctgtatgaacatacagattgccgggagtattcagattggtagttttggcagtaatgttatcgtctgccagtaaagcaagctgcttgccgcccttgatactgcctccgtttaagcggatatcggaggtaactgttgaagcttccaaagaaagcggtttgcctgcttcgatgtgtgcggtgtctttggcatctattacggcggaactgctgatggtgccgttggataatacggtaacatctgccccggtaatgcgtgtgttattgcctaattcggcgttgcctttgctggaactgtatacggtagtgccagtctgaatactggcctccttgatgacggtacggccgtcggccgacagagtagccgggcctttggcattgttcacattagttttgctctcaatcaccaaattatgaccagcatttaataccgtggtagctgggcgactgccgttattctgcaccacggctccgttacgcaagctgatatcttctcccgtctcaataaccaataagcctttgctctcgatccgaccaccattggagataaatgtgcctgccgctcctttttcggtggtttcgatggagagataagtcggtgaagcttcggtgccgtcggcagtggtggcgatgcggccgctgttttcaatgcggcctgacgaagtcacaatcaattgcttggccgcttcgagtgtgccggcatttttgacgcctacgcctttttcattggcaatcagtgtgatgctgtcggcgtacataccgcccagtgcggcagtatcaagggcaatagtcggtttcgtacccgctgccgtacctgcactgatttcgccgctggcgtaatctactttctgaggaccggtagaaaccgccaggtttttaccctgtaatttcccctgcaaagcaactgcacgagcaagtaccccggtgtagtcggctccgcctttatcattccaacctgctgctcctacggtcaatgtgccttgacgcacatcaaatcctgtcagtgcaccgtctttgccgatttggggcgcaccggtagttaagatgccccgaccgacatttttaaagccgccgccattaacggtaatgccgttggggttggcaataatcacgtcggccttttgaccgcctacggtaacgatgccgttgagtttgctagccgtaccgcgtacctcgttcaaaatcaattgcgcactgcctttgaccacaaacggattattgttacggtcgttgtttaacactgcccctttgttgtcaacatcaaactgcgtatagcggttgtggctcaatccgcgtccattcggagtttggatattcaccaagggggcaccagtgttggttttaaggataacgacctgctggtttttaggtgctgatttgtcggtggtaatttgggcatgggcaggcaataccatactcagggaaaccaaagagcagaccaaagttttaagggtggttttgagtttgccgcaaaggtcgcctgaagttttcagtgaaacagaaaccgaactgcctgcctgtttacctttgccctggctgttggcagtttcggctactgcaaccatggtgctgtgctttttactaaagataatgcgatgtaaacctttattcatgtctattccattttgaagatgaacgtactgcgcgccaagtacgtaggtaaagtttgacggtctgaggataaggaaagaccgtctaaatatcagtaaaaaattcagaggttagaaactgtaattcaagttgaagccgtaaacggtgttggtcgtctgaaagcctttgggtttatgaagcggcttgccggcaaacagatcataagcaaacataccgcctactttatgccctcctctgaagccgaccactgcacccatcagctgcttgcccgatacatattgtgcactttcgccagatacgcggccatagtccgcaccgagatagaactgatggttcggatgaaaataccaagttaaagtattctgccagtagaaacctcgctctccgaaaagactctgctccccatcaaatccgcgaacggtgtagcggctgccgattgacaatttatcttgggcaaccaacggcgttttgttccattgagcttgaatggcggttgcgtagaaaaactgctgtttgcctaaaataaatggggcggctgcgtccaaactggcagtaatgattttcatacgagatgtacctggaagaatatcgccgccgttttcttccggtgcaggcatactttggcgcatgccggtcccgcgtttgtaagacaacttgccgtcaagctgccaacggttgaggtaagcacggtggcgcaattcggcttcccagcctgcagagcggcggcgttgtacttcgatttcggcatcgtcgatgtatttataggtttggcgtgtccataatttcattccgactgaagttttatgaagtctgttacgccaaagcatgcgctcggcggccaggctgctctgatattgtttgccgttgtaatcgtaattgacggaatagccttcggttgcttcgtggtaacgatgtccattgtgattaaaagaaaacagccatttttttacgggcaccgaataatgcacgctgtaacttctggatccgctttcagtttccgtaccggtggcatcagtcaagtccgttttgtgcgccaaaccgcgtccatatgaaacataaaacaaatcgcttaagcccaaagggttatcgaacgataaagcgacatttccttgatatttgccggtcgttttgccgcccgcatcatctataccgatactgaaccgtatgggtttattctgctgccatttgatctgtaaatcgcttttgccttcttcttcggacggtataatctgaatatctgttttaacactcggcaaacgacgcaggttttccaagccctgctctacatcgcgaagattgagaattttgttcctatataagggaaatttgttattgaatgcactaatactgccctcggcagacttcccatcccgtttttcttcatagcggatatcccctatttcgcctgctgatacccgtaatttcagaattcccgaatccatattctgtggttggataatagcttgggaagtgaggtagccacgcacgatcagtatctgttgcgcggctttttgtagcctgctcaaattattggaacctaaacacatcccagttttaaaagctgtttctttcatgagcacagaaggaagaaaagaaaatttgcgcaccgtcttatcatctaaactaatgtaatttacccgagtacacggtgtttcatcttcactcaggacataattgttcttctccaatggttgctcgaaacggacatttgcatcagttaacaattcagcatctatgtgctgctgacgctgcatggaacggataagttctgcatcgttaataatttccataccaaccgtaatacggcgtataaggctttgaaagatgcctgtaacaacctttttgaacgccaattcagttttatcgaaaaaacaccaaaaggggaaaaggtagtacggacaaggtgggtatctcaagtcgcctatattgaacaacaggcaacggtagagttagtttttgcaccaaatgttgcccctttgattacgatgctagaaaaaaacttcacaagctacgagcttgatcaggtctcatcgttgagcagtaaatacgcggtgcggctctacgaaattattatttcatggcgtgcagccggtaagacaccgatgttcagtacaatggagttgcgcgaacgtttgggtatgatgcctgacgagtatcaaaaaatggagctattcaaacgtaaggttttggatttcgccgtcaagcagatcaatgataaaacggatatttccattacctacgagcagcataaagaaggacgaaaaattgtaggttttacattctcaatcctacataaaatagggtcgaaagacatccctcttgaaaatcaatcggaactttttgccggaatgactgatttggaagccggaacgatacgggtcagggcggaagcatatatcgcttcgctcattgcaaaaggtcagaacgtgactaaagcccataggctgaatattctgaaaaaagccgtagaggaacgttggggatttgaagatgtggctaaagataatggggccaaaaatcctgaaaacaaaaatgcaaaagtcgttttaaacgaatgggaaaagatttctaatggcacacgttttaaggacaaggatggaacaatttgggttaaagattcaggtatgcttaggactgaagggacaaacaggtggatagccgattctcagattgccaaattatttcctatgttaactgtgatggttgaggaaggtatttaacccggcaactcgcgtattctacctgttttgcggtacggaaaccaattgaacctgctttacgctacaatagaagattgcaattttgtcggatgtaccatgaacgattacacagccatgccgtctgaagacggaggaatcggctcattatcgcttccgccgcactcaatggaggcggaacaatccgttttgggcgggttgatgctggaaaatccggcttgggacaggattgccgatgtggtttcgggagaggatttctaccgccacgaacaccgcctgattttccgatccattgccaaactgatcaatgagagccgtcctgccgatgtcatcacggttcaggaagatttgcagcggaacgaagagctggaagcggcggggggattcgaatatctgattacgctggcgcaaaatactccgtctgccgccaacatccggcgccatgccgaaatcgtgcgcgagcgttccattatgcgccaactcgccgaagtgggaacggaaattgcccgcagcgccatacccaaaatatcggcagcggaacgggcggtagcttggagtacgaaaaattcaagcagtttcttttgaactctattgtttaatttacaattggttatctttattttcgtagcctggcataactgttaatctacgtcagcccctaaaaattaatctaatttacgattataaaaatattattaagaaagcccttactatgaaccgcaccctgtacaaagttgtatttaacaaacatcgaaactgcatgatagccgttgctgaaaatgccaaacgcgagggcaaaaacacagccgacacccaagctgtaggtattttgccaaatgatattgcgggctttgcgggttttatccattctatctctgttatctcattctccctttcattactgctcggttctgcccttatcctgacttcttcttctgctactgcccaaggtatcgttgccgacaaatccgcacctgcacagcaacagcctaccatcctgcaaacaggtaacggcataccgcaagtcaatattcaaacccctacttcggcaggggtttctgttaatcaatacgcccagtttgatgtgggtaatcgcggggcgattttaaacaacagtcgcagcaacacccaaacacagctaggcggttggattcaaggcaatccttggttggcaaggggcgaagcacgtgtggttgtaaaccaaatcaacagcagccattcttcacaactgaatggctatattgaagtgggcggacgacgtgcagaagtcgttattgccaatccggcagggattgcagtcaatggtggtggttttatcaatgcttcccgtgccactttgacgacagcccaaccgcaatatcaagcaggagaccttagcggctttaagataaggcaaggcaatgttgtaatcgccggacacggtttggatgcacgtgataccgattacacacgtattctcagttatcattccaaaattgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaatcaagggcaatggtttgcctcagccggcaatgtggcagtgaatgctgagggtaaactggtcaacacgggcatgattgcagcgacgggagaaaatcatgcggtttcacttcatgcccgcaatgttcataatagcggtacggttgcctcacaggatgatgccaatattcacagccagacgctggacaattcaggtacggtcttatcctcaggtcgattgactgttcgtaatttaggccgtctgaaaaaccaaaacaacggtacgatccaggctgcccgcttagatatgtcaacaggtggtttggataacacaggtaatattactcaaacaggttcacaagcattggatttggtatctgccggcaaattcgataacagtggcaagattggtgtaagtgacgttccacagaccggtttgaatcccaatccatcagtcataccacagattccgagtactgcaacaggttcaggcagcagcactgtctcggtatctaagcctggttcaaacaatcccgtttcacctacagcacctgcaaaaaactacgccgtaggacgcattcaaacaacaggagcatttgacaatgcaggatcaattaatgcgggtgggcaaattgacattgccgcccaaaacggtttgggaaattcgggtagtctgaatgcggctaaactacgagtatcaggcgattcatttaacaatacggtaaaaggcaaactccaggcacacgatctggctgttaacactcaaactgctaaaaacagcggtcacttattaactcaaaccggcaagattgataaccgtgaactgcataatgccggagaaattgccgccaacaatctgacactcattcattcgggccgcttgagcaatgataaaaaaggcaatattcgagctgcacatttacagcttgataccgccggtttacataatgcaggtaacattcttgccgatagtggaaccgttaccaccaagaataatcttcgcaatacaggaaaagtttctgttgcacgactgaataccgaaggtcagactctagataatacgcgcggacgtatagaggctgaaacggttaacatccaaagtcagcaactgactaaccaaagcggccatattactgctaccgaacaactgactatcaatagtcgaaatgtagacaaccaaaacggcaaactcctatctgcaaaccaagcacaattagctgtttcagacggcctatacaaccaacatggtgaaattgccaccaaccggcagttgtctattcacgataaaaatcaaaacactttggcgttaaacaatgcggatggcacgattcaatctgccggtaatgtatcgctacaagccaaatcactcgccaacaatggcacattaacagccggtaacaaactggatattgctttgacggacgatttcgtcgtagagcgcgacctcactgcaggcaaacaattaaatctaagcataaaaggccgtctgaaaaatacccataccctacaagcaggccatacgctcaaactcaatgccggcaatatagataaccaagttacaggcaaaattattggtggagaacaaacggacatcacatccgaacagcatgttgacaacaggggcttgatcaacagcgacggtttgacccacatcggtgcaggtcaaaccctgaccaacaccgggacaggcaaaatctatggcaaccatattgccctggacgcgcaaatactgcttaaccgggaagaaacgacggaaggcagtaccaaagcgggggcaatagctgcaaggaaacgtttggatattggagcgaaagagattcataaccaagaaggtgccctactatccagcgaaggtatttttgccgtaggtaatcgactggatgaacaacatcatgcggcaggcatggccgatacctttgttaatggcagtgccggtttggaagtacaaggtgatgcattgatgtccgttcggaatatgcagaatatcaataatcactttaaaacagagacatacttagccaaagcggaaaagcaagtccgcgactacaccgtactggggcaaaatacctactatcaggcgggaaaagacggtttattcgacaactcgcaaggacaaaaagaccaaactactgctacgttccatttaaaaaatggttctcgtattgaggccaaccaatggcatgtccgagactaccacatcgagacttataaagaacgcatcatcgaaaaccggccggcacacattactgtgggcggtgatttgactgcctcaggtcaaaattggctgaacaaagacagccggattgtagtaggcgggcgtattatcactgatgatttaaaccagaaagaaattaccaatcaaagtacaacaggcaaaggtcgcacagatgctgtcggcacacagtgggattcagttacaaaaaaaggatggtacagcggtagaaaaagacaacgccgtactgaaagaaaccatactccttaccatgatacccaactatttacccacgacttcgacacgcctgtatccgtcatccaacagaatgccgcctccccttcctttcaacccgccgcatctgcaatcaaactgattgacggagtatccacggcagccgtcaatggtcagcgcatccataccggtaatgtggtctcgttaaataacgctactgttactctgcctaacagcagcctctataccacccatcctgacaataaaggctggttggttgaaaccgatcctcaatttgcagactaccgccgctggttgggcagcgactacatgttgcaacaactgcaattggacaccaatcatctacacaaacggcttggcgacggctactacgaacaaaaacttgttaatgaacaaatccatcagttaacaggctaccgccgactcgacggctacaggagtgatgaagaacaattcaaagctctgatggacaacggccttactgctgccaaaacattcggtctcaccccaggtatcgccttgagtgcagagcaagttgcccgcttaacttcagatatcgtttggatggaaaatcaaaccgtcaccctgtctgacggttcgactcaaaccgtactggttcctaaagtctatgccctggcgcgcaaaggtgatctcaatacctccggtggcctgattagtgccgaacaagtcttacttaaactgcaaaacggcaacctgactaacagcggtaccattgcggggcgacaggccgtactcatccaggcacggaatattaacagcaacggtaacattcaagccgaccaaatcggcttaaaagctgaaaaaagtatcaatatcgacggcgggcaggtacaagcaggcagactgctgactgcccaagcgcaaaatatcaaccttaacggtacaacccaaacttccggtaatgaacgtaacggcaataccgccatcgatcgtatggccggcattaacgtggtcggaagccatactgaacaagtagataacagaacttcagacggcatcctatccctgcatgccagcaacgatatcaacctcaatgcggccaccgtctctaaccaagttaaagacggcactacccaaattaccgccggcaataatctcaacctcggcaccatccgtaccgaacatcgcgaagcctatggtacattagatgacgagaaccatcgccatgtccgccaaagtaccgaagtcggcagcagtatccgcacgcaaaacggcgcactgcttagagccggtaacgacttaaaaatccgccaaggcgaactggaggccgaagaaggcaaaaccgtccttgccgcaggacgtgatgtcactatcagcgaaggacgccaaataaccgaactggatacctcggtaagcggaaaaagcaaaggcatcctttccagtaccaaaacacacgaccgctaccgcttcagtcatgatgaagcagtcggcagcaacatcggcggcggcaaaatgattgttgcagccgggcaggatatcaatgtacgcggcagcaaccttatttctgataagggcattgttttaaaagcaggacacgacatcgatatttctactgcccataatcgctataccggcaatgaataccacgagagcaaaaaatcaggcgtcatgggtactggcggattgggctttactatcggtaaccggaaaactaccgatgacactgatcgtaccaatattgtccatacaggcagcattataggcagcctgaatggagacaccgttacagttgcaggaaaccgctaccgacaaaccggcagtaccgtctccagccccgaggggcgcaataccgtcacagccaaaagcatagatgtagagttcgcaaacaaccggtatgccactgactacgcccatacccaggaacaaaaaggccttaccgtcgccctcaatgtcccggttgtccaagctgcacaaaacttcatacaagcagcccaaaatgtgggcaaaagtaaaaataaacgcgttaatgccatggctgcagccaatgctgcatggcagagttatcaagcaacccaacaaatgcaacaatttgctccaagcagcagtgcgggacaaggtcaaaacaacaatcaaagccccagtatcagtgtgtccattacctacggcgaacagaaaagtcgtaacgagcaaaaaagacattacaccgaagcggcagcaagtcaaattatcggcaaagggcaaaccacacttgcggcaacaggaagtggggagcagtccaatatcaatattacaggttccgatgtcatcggccatgcaggtactgccctcattgccgacaaccatatcagactccaatctgccaaacaggacggcagcgagcaaagcaaaaacaaaagcagtggttggaatgcaggcgtagccgtcaaaataggcaacggcatcaggtttggaattaccgccggaggaaatatcggtaaaggtaaagagcaagggggaagtactacccaccgccacacccatgtcggcagcacaaccggcaaaactaccatccgaagcggcggggataccaccctcaaaggtgtgcagctcatcggcaaaggcatacaggcagatacgcgcaacctgcatatagaaagtgttcaagatactgaaacctatcagagcaaacagcaaaacggcaatgtccaagttactgtcggttacggattcagtgcaagcggcagttaccgccaaagcaaagtcaaagcagaccatgcctccgtaaccgggcaaagcggtatttatgccggagaagacggctatcaaatcaaagtcagagacaacacagacctcaagggcggtatcatcacgtctagccaaagcgcagaagataagggcaaaaacctttttcagacggccacccttactgccagcgacattcaaaaccacagccgctacgaaggcagaagcttcggcataggcggcagtttcgacctgaacggcggctgggacggcacggttaccgacaaacaaggcaggcctaccgacaggataagcccggcagccggctacggcagcgacggagacagcaaaaacagcaccacccgcagcggcgtcaacacccacaacatacacatcaccgacgaagcgggacaacttgcccgaacaggcaggactgcaaaagaaaccgaagcgcgtatctacaccggcatcgacaccgaaactgcggatcaacactcaggccatctgaaaaacagcttcgacaaagacgcggtcgccaaagagatcaacctgcaaagggaagtaacgaaggagttcggcagaaacgccgcccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggcaggcggactgacgaccggcagcctcggcggcatactggccggcggcggcacttcccttgccgcaccgtatttggacaaagcggcggaaaacctcggtccggcgggcaaagcggcggtcaacgcactgggcggtgcggccatcggctatgcaactggtggtagtggtggtgctgtggtgggtgcgaatgtagattggaacaataggcagctgcatccgaaagaaatggcgttggccgacaaatatgccgaagccctcaagcgcgaagttgaaaaacgcgaaggcagaaaaatcagcagccaagaagcggcaatgagaatccgcaggcagatactgcgttgggtggacaaaggttcccaagacggctataccgaccaaagcgtcatatcccttatcggaatgaaaggcgaagacaaagccttgggttatacttgggactaccgcgactacggcgcaagaaatccgcaaacctacaacgatccgaagctgtttgaggaataccgccgacaggacaaacccgaataccgcaacctgacctggctgcacagcgggacgaaagacaccaaaatcaggcagggagagcggaaaaacgaagagtttgcactgaacgttgccgaaggactgacgagccttgtcaaccccaatccgaggataaaagtcccgattcttgcaggcatccgcaacctgaaaaacatcaagccgacagttaccggcagcgatcccttattggcgggtgcggggaatatccgtatccctgcaaacggcaatgttgcgaagggggacaggattccggatacggcattggctagcaagggaatcaaacataaaaatcgtaaagatcaactggaaaaaaataaaaaatctggtgaggattttgagatggaaatttatcagaagaaagttaaacaaggctttaaaccgcaaagacagattacagttaaaacaaaaagtggtgtaaaaacyaggcttgatattatttcgaaagaaggtggtcttgatgtttgtacagagtgtaaggcttcaataactgcgccacttactaaaaatcagaaaaaagcttttcctgaaattgaaagaacgggagcaacagtggtcggtaagggaaaaccgggctatccaaaggggaccaaaattgaacctactaaagttataattgaaaggaaaagataatgtctattttggaagagaatgtaattgattcagcctctattgaaaacggaatactcatattaactatttctgatcacttaaaatgggataacgagcatttgtttttgttgcaagaaaaaataaattcatatattcaatatattgaatcaggtcaaatttttgaagattttggagaaagtagctatgagactattgaaatacagcttatatataaatataaaccaaatgaaaattatagaaaatttttatatcgcctagaaggtgctttattaaaacttaaattacggttttcccatggaactatctcatatttttatagttgaaaagtaaatactctctttatcacttcgagcccaggcaagccataacttatataaaccctgaaatcaaaagaagcaactcgtaacacgcggcgtcatatcctttaagtcatacttatactgaaatatataagcctgaggaatttacgctatggttaagaaagtaaatatattgaatattgcagaaaattttttatgagagtgaaaaataaaatttagatatagtcgttatctgtctgccgatggaacaaaatggataagacatggtttgttctatgcatcttacgaaaatggtaatattgtttaggcaaaaaaattatggcaattttttattttagttcaaaaaaaatagaaagaaatattatctcatcaaatctgaatcgaaaacaagttcgtgcaatatttagttctgatgtacaagaaatttataagtcatcatactctcgggttcctatggatgtttttcccgaattgaatatccattgtttttatgatgataaaaatcagcttgaagcgatagagatatttgaaccaaataagttttttttagaagatatttcttttaattggcttggaaaaattaatgatgaaataataagctatctttataagagtggaattaatgattttgaaattgatgatttgggtattaggcttcttaatattcctgtttcaactataatcaattcaataggtaaagtagaatgttgttatttagatttttcaaatagagacacgaaattttatgtaaaacaagtgtaggtttgaggtcaagacccaatctacgcttactccggtatcagcgtctccatcatctacgacgaacaaaaaatccgccatctgaccaagtaaacgcctaccttgccgaaaaccaaagccgcggccacacctggaaaaaagacggcatagcaagccgtagctcatgtgaaacctaaactcaatacgtaggatgtgcggaacgcacatatgtagttttcaaggtttgagccaggaggctgtctgaaacaacaaatacgtttcagacagcctttctttcaacaagccaccacagcaatcagacaaaagcaacccaccgccacacccatgtcggcagcacaaccggtaaaactaccattcgaagcggcggggataccaccctcaaaggtgcgcagctcatcggcaaaggcatacaggcagatacgcgcaacctgcatatagaaagtgttcaagatactgaaacctatcaaagcaaacaacaaaacgccagtgcacaagtgaccgtaggttatggcttcagtgccagtggcgattacagccaaagcaaaatccgagccgaccatgcttcggtaaccgagcaaagcggtatttatgccggagaagacggctatcaaatcaaagtcagagacaacacagacctcaagggcggtatcatcacgtctagccaaagcgcagaagataagggcaaaaacctttttcagacggccaccctcacccatagcgacattcaaaaccacagccgctacgaaggcaaaagcttcggcataggcggcagtttcgacctgaacggcggctgggacggcacggttaccgacaaacaaggcagacctaccgacaggataagcctggcagccggctacggcagcgacagcgacagtcaaagcagcatcacgaaaagcggcatcaacacccgcaacatacacatcaccgacgaagcgggacaacttgcccgaacaggcaggactgcaaaagaaaccgaagcgcgtatctacaccggcatcgacaccgaaactgcggatcaacactcaggccgtctgaaaaacagcttcgacaaagacgcggtcgccaaagagatcaacctgcaaagggaagtaacgaaggagttcggcagaaacgccacccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggggcggcaatcggctatgcggcgggcgggaatgtcggtacggcggcagtaggggcgaatgtcgattggaacaataggcagctgcatccgaaagaaacacaaatccttaacaaactgtcaaaaggcaaatcggctgaagaacagtaccgcctaaaagccgctgcatgtgcattaacccggtgcgcggaaggcgtacctgacttcgaccctctttataaaggactaaaaaacctccaagatgccggtaaacagtttgtagcggaacaaaacgtattgatgcggacggatgcatttaaatatggaacatggaacagcctgaatgatatacgcagcagttacgaccgtgctgccaccaaaattaagggtgcgggcaatatgggattgggtgcaacgacttttgtcggttcgggtgctataggcggaggtctgtgcagtaccgggattggctgtgcggccggtggacttattgcaacggcaggtatgaccggtggttatacacaggcctcagaaggaagccggcaattgtttggcacttaccagtccgattttggtaaaaaagttgtcctatctttgggtacaccaatagaatacgaatcgccgttagtatctgatgcgaaaaatctagccgtatggggattggaaacgctgattacgcgcaaattgggaaacttggcaacgggtgtgaaaacttccttgactccgaaaactgctgacgtacagcgaaatatcctgtcccaatccgaagtcggtatcaagtggggcaaggggattgaaggacagggaatgccttgggaggattatgtcggtaagggcttgtctgccaatgcaaggttacctaaaaattttaaaacatttgattattttgatcgtggtacaggcacggcaatcagtgccaaaactctggatacgcaaactacggcacgcctgtccaaacccgaacagctttacagtaccatgaaagggtacatcgataagacggcaaatttcaaaagttatgaattatcagaagtaccgttaagggcagacatgatcaaacagcgcgaaatccatctggccatacccgcacaaactaataaggagcaaagattgcagttgcaacgtgtggtagagtatggcaaaagtcaaaacattacagtcaaaattacggagatcgaataaatgactttcaatcaagaacaagattattgggctggctataaggcaaatgaaagagccttgattattcaaacatggtcaggatttgggcgatatgctccagaccacctatatcccccccatatcctgccattggataccgacaatgaaactttaggcacaacggtcttgcaagcattggcaaacagcaggactttcgtttatgacagtccagaagaccaagatttttttgataccgaaaaaattcggcaacgctatgaggattgggttgccaagctatgcgggaacttgggctataaaaccagacgcgccctatttaaaaacatgatgagcgtagatatttggctgcacaacggctgcctgaaaatcagcccgagccgccatgtcaagctggaagcgtgggatgccattgatgcagacgatgtaattttatcattggataacagccctgaagaaatcggagcaggtttaaagttggcattgagccgctgccgataatattacaaaaggtcgtctgaaagccggaaacttttttcattagataataaattaagcacgcatgcggttctcaaggtctaagccaagaggccgtctaaaaacagaaaaaccgtttcagacggccttatatattgcgtccctaagaagggacgattaacaaaaattaacgtcctttactttctacaagtaacagggcttttttttgcccgtttttgaggattcgcaccatggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagacttttttcaacggcgaat

SEQ ID NO: 20 - DNA, 16526 bp, Neisseria meningitidis
tgttaactgtttaatcctaacgtcaaatatgccgtctgaaaagccgaagccgcgcacaaasgcaaaaacggcacggataaaccgtgccgcagcaaccggggcgtgttcagactttgcggtagggattttccaaaccttcaatcagcgcgagcaggtaatcgcgcaactgacgttcgccgcaacccatcagcagcgcgtcttcaaacgcgtcttgtgccgtctgatacagctcggccatattttcggacatcactttgaccttttcggtacaggacacgatctgtccgtcatcgtcgtaccatttgggcatttcgggcatactcattgcgtattccttgggaaatcagttcagaaagcgggacgggtcgtttttcttgacccggcgggcgaacgcgtatttgccgctccaatatttgtggctcaggctggtgatttcgatatttttccccgtgcgcggcgcgtggatgaagcggttgttgccgatataaagtccgacatgggaaatgcggctgccgccgagcgtgcggaaaaacaccatatctccgggctgcaattcgcttcgggcaaccggcgtacccatccgtgcctgttctgccgacgtgcgcggcaggttgatgcccatggcgcgtttgaagatgtgctgcatgaagccgctgcagtcaaaaccggtagaaaccgatgtgccgccgtagcggtaggcaatacccaaaagtcccatcgcgttgccgatgagttcgtcggcattgcccgcccgccgggcgggggctcggttgacgggtaaaacgggctgttcgttaagccccatcgcgttgccgatgagttcgtcggcattgcccgcccgccgggcggggactcggttgacgggtaaaacgggctgttcgttaagccccatcgcgctgccgatgagttcgtcggcattgcccgcccgccgggcgggggctcggttgatgggtaaaacgggctgttcgtcttcggcaaactgtctgagaatctgctcgcggctgctgagcargttggtcaactcgtcggcaagggcggggcggacggcaaacatcagccacaaaaccgcccaaactgccggtttgaaaaaagaatccatatcggtgtttccgcgcaggaggcatcgtgccgccgtgcgatgttatgctgtatcagtcgaaaatatcttgttgattgtatataaaaaaacggctgtttggcaaaaaacggcttgttagattgagttaatatgttgatttttatataatttattgataatttgggaagcgcatccgccgtccgtcttgttttcgcgccgaccgcaaccatatagccgccatccgaacaatcagtcagagaaaatcatgaatcaaaccgccatcaaccgcgccgatgtgcgtacccgctttatcttcgacgatatgcccgtgcgcgggctgcacgtccgtctggaaaacgtgtggcagcacattgtaaaacagaaaaactatcccgccgccatccgccgcgctttgggtgagttgttggcggcgggtgtgttgctgtcgggcaacctcaaaaacgaaggcacgctgattgtgcaggttcaggggcgggggcggctgaaaatgctggttgcggaagcggcttccgaccgtaccgtccgtgcaaccgcgcgttgggacgaaaccgcagaaatagccgatgacgaaagcctcggcgaccttttgggcgagggcggcgtattcgtgctgacgctgcagcccaaagacggcgaaccctggcagggcgtagtgcctttggaaggcggcggtatcgcgcaaatgttggtgaactatatgaaacgttccgaacagcttgatacgcacatcgtcctgtctgcaagcgacgaagcggcgggcggtctgctggtgcagcgtctgcctgaagaggtattggatgaagaggcatgggaacacgtcagtacgctggcgcgcacgctgacggcggaggagctggcaggactggacgcgcaacacgttttataccgcctgttccacgaaacgccgccgcgcgtgttcgagccggaaacgtttgaattttcatgcacctgttcgcgcggcaaagtcagcgatatgctgttgatgctgggcggggaagaagtcggcggcgtggtggtggaacaaggcagcatcgaagtcgattgcgatttctgccacagcaaatatgtgtttgacgaaaccgatgtcaacgcgctgttcggggaggatgtggtcggcgttgccaaagggctgccccggcataccgtccaataatcttgtgcaacaaggataaatagtcaaatgccgtctgaagcagcttccgcttcagacggcatttttgcgcgggttcagacggcatttaaagcaggaatagggtggcgagccccaagaaaatcaggaagccgccggagtcggtaacggcggtaatcagcaccgagctgcccagtgcgggatcgcgtccgaacttttccattaccacgggaattaatacgccgacggttgccgccagcaggaggttgagcgtcatcgcggcaatcataaccagcccgatgccgaggctgccgtaaagcagccaagatactgcgcccatgaccgttccccaaatgatgccgttgaccaaggcgacaccgacttcttttttcagcaaacgccccgcctgcatatccgtcagctgccccatcgccatcgcgcggacaatcatggtaatcgtctggttgcccgagttaccgcctatgccggcgacgatgggcatcagcgcggcgagtgcgacgattttttcgatgctgccttcaaacgcgccgataacacggctggcgaggaaggcggtgcagaggttgacggcgagccacatccagcggtttttcaccgaatcccacacgggggcgaacaggtcttcctcttcctgcaaacccgccatattcagcatatccgcttccgattcttcgcggatcacgtccaccatctcgtcgatggtaatcctgccgatgagctttttgttttcatcgacgacgggcgcggtaaccaagtcgtagcgttcaaacgcctgcgccgcttcttccacgtcatcttcggcgcggaaacgcacgacatctttcgccatcacgttttccaccaagtcttcgggatcggcgaccaaaagtttgcggatgggcagcacgccctgcagtacgtcgttttcatcgaccacaaaaatcttgtcggtatggtcgggcaggctgtcgaagcggcgcagatagcgcagcaccacttcacaggcgacatcggcgcggatgctgaccaactcgaagtccataatcgcaccgacttggttgtcttcgtaggacattgccgctttgacttgggcgcgttcttcctcatcgcgggtttgtagcgcttcgtaaaccacttggtgcggcaaatcgtctgccagttccgccaattcgtccgcgtccaaatcatcgaccgctgccaacaattcgtctttgtccatcgactcgatcagcgtttcgcgcaccgcgtcggatacttccagcaatacttcgccgtcgtcttccggtttgaccagaatccagacgatattgcgttcgcgcggcggtagcgattccaataccgccgccacgtcggcagggtgcagctcgctcaagaggacggtcagctcggtcagcttgtcgcgcagcggcgcgtcttcgagcggtgtaccgttttcgatttgttcaaaagcaggttcgaggatttcgcagagggagtggacacggtcgaaatcggcggaaacgcgttctacatcgttttcgataccgtcgttttcaaggttcggaggggttggttcgatgctcataaatgctccgcccgccgtgtgcggggaggcattccggcgggatggttattgcgggtttgaatcggatggggtgttcagtaaaaacgaactgggaaggtccataataaaagcctgacggtacaggcgcagggttggaaacggcactattctactcccttttggaacggtttactatttttaacgcaaatgccgtctgaaacgcgggttccagacggcatttttatcggcttgttaccagttgtagcctattttgattcctgcctgtttgtggcgggcggtgttgctgtctttgccgtaagcggcatgaagtttggcgttccagcctttgtatccggcgtcgatttgcagggtatgcagtgtgccgtgggcggcttgctgcagtaaggtacggtcgttgacgctgagggcggaaccgctgttttggcgggtatggtagtaatcgctgctgaaggcgggggtcagcttggcttgacccagttcgacggttttatcgagacggatgccggcatgccatgtggtttggatttgcgccgggctgtttatctctgcgccgtcgagtacgtaccggttgccgttgctgcggtttatacggatgccggcatagggtctgaggttgatgccggtatcgattttgatgccggtgttgatgcctgcatcccatgcgtggcggcggacggcagccccgtcataatcggtaaatcgggtacggctgttgctgtagcctaaatctgccgcggcaaagagtgcgccgttttcccctttgacgaacagatgtgcgccgttgctgcggtttcgggcggatacgccttcatcaaaacggttgtttgtgcgctcatcggttaaaatcgtaccgacactgagacggtcggtgatgccggtttggatgccgatatgtgcatagttggtagtttgttggtagggacggtgtgtgccgctatggtagtcggtttgttgcgtaccggtttccagccagatgttttgctgctgcggatcggtaaggtggcggtcgatgcggcgtcccgcctgttgccggccggtattgtaggcggcctgttcggaaacggcggtgttggccgaccggctgatcagttcggccaggttcggcatacggatgccggcaacgccggttttcaaactgtggatttgtcgggacagacggttgagtgcgttcaggtaggcgtgccgggctgtttcgacggcttgcgcatcgccgccttgccgtgctttgtcaagttcggattcggccatttctacacgttctatatacgtatccagttcggtttcgaagagtgtcaggtcgttcgtgtcggcggctttggcaacctgacggcagatatcggcactgtatccttgtgcggcacacaggttttgggcacgcgtcagaatgccggtcagcgggtctgtctgtttcaattgggcggacagatattggacttggctgtcgatgcgggcaagttcggtttgactgttctgccaggcctgtagtgcctgcctggtcgcgtcagagtcatgttgaacctgtctgctgatgtcggttgcctgtaattggttgtatgcctgttggttgcgctcatgttccgcacgcgtggcttcaatttgaagttcggcctctttgagcgggttgtacaggctgtatccgttgttgtttttgcggaggatgtagcggtaggcacccaaatcggcatagccgttttggagggtgaatcgggcttggtggctgtgtttcggattgaggctcacaagtgcaagcgattcggttgtttgaggttcttgtccggtgtttttgacgtggatttggaatgcgccgcggctgtccccttccagtttgagggggggggcattttgttttcggacgatgccggtcaggaatcggaatgtgccgaacccgtcaagtgtgccgttgacggtcagtgtgttgaagcggttgttgtgtgtattattggcgaaatcggggttcagggtaatttgtgcgccgtcaagcgtcagtgcgccggtgtggctggactgggaaagtgtccagttgctgtctgcttccatgcggactgcggtgtctttgccggcacggatgctgccgtacaggtgtgctttgcccaggcggagctctgaacggtcgttaagggtaatgtcgccgcgtacttgcgttgcaggtagtgcacgatagttttcggcttttaaaacggcgttgggtgtgcagtgggtgctgccgctatggtaggagcggtagcattccggtgttttgccttgggtaaagccgaggtcgatgccggacagatcgtatgcggttatgtcgccgtccagatgcgcggtattgcgccctgccgtcagtcgggcatggtttcgcagggtgaaccgtgcagccttgaagctgccgtcggtccattcgttttcaagaacgggttcgcgtttggcctggtggtcgtaggcatggggtacgggcctgcctgacacaatcatattgccgccctcaatcaagacttccccgttaaggttcatgccgccgttgagcaacagcgtgctgtcggtgcgtttgggacgatagtgcaggttgagtgcgccgttgtaacggtattcgggccggccgtatacggcggcatttgcgatatggcgggttttttctatggctgcttcattggttttgctgtaactcggcgcggctttgcccgtttgcgcgttttcacccaagtatccgccgaaggtaatcaggtcggggcgggcattttcggcttgggcgacttgttcggcggcctgttgcctgttgttgccgataaattgccagcttgttgagtttttcatatttaacgggaaaaattcgcgcgggttgccgccgggtttgagtatgaagtagtcggtccgacggttgcggtgcgggttgatgtattcgtaaaccgccgcgttgccttgcggacggttgccccattgcacccactcgacatgctcgggactgaggacggggttgccggtcagcgtcagtgtcgcggcttggtcagggttgtgattgacgatttgcgcgccgccgtccgcatggcggatatgggtaaaggcaaggttgttgccgttgaggtcgagccgtccgcccctgaagccgaaatagaggttttcgggtttgatttgctggctgtcggcgaggacggccgtgcccctgccgctggtgatgccgacttggttgaatgcttgtttgctgccgtctgaagcagctttttgggcgagtacgacagtgccttccccgatgctgatgtcgccctggttgatgccttgtccgttggcgataagcgtgcctgcgcccagtttggagagccggtcgcctttggggttgctgacttgccagaagacgcgtttgccgtcggctacgataacgcctgcaccttgccatgtgtggtttttaccgacgacggtgaagttgctgtcgaactgcaatgcgcctgcgccttggttgatattgtctgccagcatcagtgttttgttgtcgaacctgctggataggatgagcgttttgccggcatcttcagacggcatgtgcctgctgtcgttttgtggggcaagcgaagggtttgcaatgggcagggtgatgcgttcgttgagcccttgcagggtgctgttgccattaccgttgtcgcgccatatgagttcgttggtggtcagcccgacatccagccgggtttcgtattggcggatggtggaacggatgaattcgggttgcgtgacgatgtatttgttgaagaaattatcgaagccggcgtaggtgctgagtacgcccgcaagcacccagcggttttcatgcttgtcgaaggcaaacaggggggaaccgctgtctccggcgattgcgtaggtgttaaggggttggtcggtcaggctgccgccgacgagtaagccgtggttttggaaccccaatactttcagcggcgtgccgccggtcaggtattggtatgccggggcggttcgtgtacgcgtgccgtctgctttgcggacttgttgcgtgcctgagccgagtcgtacaaagtaggggaagcggtcggtatcgaggtaggcattggcctttggctggccgtttccaagcaagggtacgctgctgagtgcggtaggtgagatttcggtaaccagtttgttgaggcggggaaggtggtagtcgtagtccgggtgcgggttgcgtgatacgaggcggtaggtataggcttgttcttctggattttgggtgtcgttgccgaattgtatggaaccgtagccgacgttgtgtttgacactgttgacgtattgggggtgaaccagggtggcgatggcggtttggcggttgctgacgcggaagtcgggcatggggatgccgttgagaaccctgcctaatattttgccttgcttgtcttggatggaaatattgcttgcacctacggtgaacgcgcctttattttcggcaaagtcgcgaaaatattggtaatcgacatcgttgcggacaatggatgagtaagcaggggaaacggcaaaaagaccgagggtggacaatacggaacaaaatggggtggtgtgtgtgaagcgcatgatgattatccgtgtaatagagaaaatcaacgattcttgcggacaagaatcaccgatcccgttttgtgctggatttatatagtggattaacaatatagtggattaacaaaaaccagtacagcgttgcctcgccttgccgtactatctgcggcttcgtcgccttgtcctgatttaaattcaatccactatattatatattttgtttttgtttgattataaggcaacggtgtcctttcgtctattggcgatgattgtatgattttatttaagattttaataaaaatcctaggaatggctgcgttttcccgttgttttatttcgtccggtattggtttttaagttcacgcagcgcgacaaaggtatcgaggctgctgtttaacgttttcccgctcaatgcctcggcgcggtctctgacgtgcggcaggtcgacgcgcaaaaacggattgacgcggcgttcgtgcgcgagggtaacgggcagggtaggcgtatgcgccgccgctttcagtgccgtctgaatgtcggcgttgtccggctcgatatgggcggcgaaacgcaggttggcggcggtgtattcgtgcgccggatagaacagggtgttttcaggcaggcggttgaagcgttggaagctgtcgtaaagctgttcgattgtgccggtaaacacgcgtccgcagccggcggaaaaaagggtgtcgccgcaaaagacgtgtatgccgtctgaagtttcgagaaggtagctggtgtggcggtctgtgtggccgggtgttgcccaaacggtaacctgtccgtcgccgaaggtgaattgggtgccggcggttacggtgtgggttgctgcttcgatgtcggattcgccgtaaacgggcgattccatgtagccgcgccagagtgccgccgcaccgccctcgtggtcgggatgggggtgagttacccatgtttgggcaagcatgaggcggttgcggacgaggaattccaagacgggcgagggttcggaagggtcgacgcagacggcatggttgccgtgctgtatcatccagatgtagttgtcggttagggctttgacgggggtgattttcatgagtgttcctcggtggacggataccgtttaaaggatggtatgccggaacgccgtctgaaatattcttcagacggcattggtttgagtagggcggttagcccaaggctttacgtgcgccggcaaagaggcggtaccagccggacagttccgtccagccttccggtttccagctcatttgcgcggcacggtacacgcgttcggggtggggcatcatgatggtgatgcggccgtcggcgttagtaacgccggcgatgccttgaggcgagccgttggggttgagcggataagtttgggtcacttggttttgtccgtcgatgtattgcagcgcaatgcccaaatcggcggaaatattgccgccgtgaagcgcgaagtcggcgcggccttcgccgtggctgaccacgacaggcaggctggagccttgcatttcgttcagaatcagcgacgctgatttcggaacgtgaaccatgctcaggcgtgcttcaaactgttcgctcaggttgcgtttgaacttcggccagcctgccgtgccggggatgatttcggcaaggttgctgaccatttggcagccgttgcacacgcccaatgtcagcgtgtccgggtcggcgaagaaggcggcaaactggtcgcgcagagcagggtggaacagaatcgatttcgcccagccttcgcccgcgccgagtacgtcgccgtagctgaagccgccgcacgccgccagcattttgaagtcggcgaggtggatgcggcctgccatcaggtcggacatatgcacgtcgtaagcatcgaatccggcgcgggtaaaggcggcggccatttcgatttgcccgtttacgccctgttcgcgcaggatggcgattttgggtttcgcgccgctgttgataaacggcgcggcgatgtcttcgttcacgtcgaacttcacgtcggcaaacaatgcgctgcgttcgttgtcgccaatcagtgcgaactcgctgtcggcgcaggcagggttgtcgcgcaggcgttggatttgatggctggtttcttgccaggtttgttgcagtttgattaggttgtcagaaataaggtgcgtttgcccgtcgcggatgattaacgtgttctcatcagttaacgtaccgatttcaaagacattatgatgcagctgttgttgatagaataaattgataatatcggcaacatcttgttttctaacttggataacagcacccaactcttcattaaataatgtgcgggcaatggtttcttgccattcagccaacgcttttacctcttcagtccgcaatgattgagacagagcggtatggttggtaataaatgtttgtgcaagcaataaatttaaatctatatccaagccgcaccgccccgcaaacgccatttctaccaaaacggcaaacaagccgccgtcgctgcggtcgtgatacgccaagagtttgttttcggcaacaagctgctgaatcacactgtaaaaggctttcagacgacctgtatcgtccaaatcgggcgcgtcgccgctcatattgttgtacacctgaccaaacgccgaaccgcccatacgcgctttgccgaagcccaaatcgacaaacaacaatacgctgtcttcgacgtttttcaactcaggcgtaacagtcttgcgtacgtctttcacaggcgcgaacgctgagataatcaggctcaacggtgaaaccacggattttttctcctcgccgtcctgccaaacggttttcatcgacaggctgtctttgcccacggggatgctcaaatccaatgcctgacaggctttggaaacggcttcgacagtgcggtagagtttttcgtcttcgccttcgttgccgcacgccgccatccagttggcggagagtttgatgttgccgatgtctccgatgttgaccgccgcgatgttggtgatggcttcgccgacgcacattctgcccgaagcaggcgcatcaaacagggcgacggtcggtttttcgcccatagacatcgcttcaccgcgataggtgttgaagcccatcatggtaacggcgcagtcggctactggagtttgatatttgccgaccatttggtcgcggtgcgtcaaaccgccgacgctgcggtcgccgatggtaatcaggaagtttttggcggctacggcaggcaggcgcaaaacgcggtaggcggcttcggtaatgtcgatatcgcccgcgtgaaacggttttttggacggtgcaaccgttttgtcggtgcgcgtggttttgggcagtttgccgagcaagacgttcaacggcaaatcgacgggattgttggcgaacaaatcgtcgcgtactttcaaatgaccgtcgtcagtcgccgtgccgactacggcaaacgggcagcgttcgcgttcgcagatggcgcggaaagcatccaaatctttttccaaaatcgacaacacataacgctcttgcgattcgttgcaccagatttgcagcgggttgaggccgtgttcttcaagcggcacttcgcgcagcttgaatactgcgccgcgtctggcatcgttgaccagttcggggaaggcgttggacaggccgcccgcgcctacgtcgtggatggagataatcgggtttttgccgccgagctgccagcagcggtcgatgacttcctgcgcgcggcgttcgatttcggggttgccgcgttgcacggagttgaagtccaaagacgcgtcgtttgtgccggtatccatcgaagaagccgcgccgccgcccaagccgataagcatacccgggccgcccagttggatcagcaatgcgccttcggggatttcgtctttatgcgtctgctgcgcctgaatgctgcccaagccgccggcaatcataatcggtttgtgatagccgcgaacctgaccgtcaaatttttcttcaaaagtgcggaagtagcccaagaggttggggcggccgaattcgttgttgaacgccgcgccgccgatcgggccttcaatcatgatgtccagcggcgaggaaatatgttccggcttgccgtagtcttgttcccacggctgtttgaggtcgggaatattgaggttggacacggtaaagccggtcaggcccgctttcggacgcgaacctttgcccgtcgcgccttcgtcgcggatttcgccgcccgcgcccgtcgccgcacccgcaaacggcgcgatggcggtcgggtggttgtgcgtttccactttcatgatgatatgcgtgtcttcctcgtggaaacggtagccttggttttccgccgcattcggatagaaacgctcgattttcgcgccttcgattacggacgaattgtctttataggcaacgaccgtgccttcgggatgcgcgttgtgtgtgtcgcgtatcataccgaagagggatttgggctgcttttcgccgttgaggatgaaatcggcgttgaagattttgtggcggcagtgttcgctgtttgcctgcgcgaacatcatcaattcaacatcggacggattgcgctgcaaagcctgatagttttcgaccagataatcgatttcgtcggcggaaagtgccaagcccatttcggtattggctttgaccaaagcttctttaccgccgcccaaaacatcgacgccggagaaagtttcggattcgagatggtggaataatttggaggccgtctgaaaatcgggcagcacgctttcggtcatgcggtcgtgcagcaaagccgcccattgctgtttctgttcatcgttcagacgaccttccagccacaccgccataccgcgctcgatgcgttcgatgcctgccaaaccgcagttttccgcgatattggtcgccttggaagcccacggcgaaatcgtacccaaacggggcgtgaccaaaaacaaatgcaagccctcgcgcgcttttggcgtttgttcaacgctttgcgccgccaacaaggcttgcagtttttcgacagtcgcggcatcaagtgctttctcgctgccgacgaaataccaaaattcgctgcttaatttgacttcgggcagaccgagtgcggcggctttttgcaagagtttttcaacacggaaatcggaaagggcggtaacgccgcgcaagggcaaaacgacagacatggattcggctctcaaatgcggttggaaaatctgtcattatacgcgcaacggggctgtattgcttgggtattttggcttaaaatgttgacaatctgacgggaggttcccgtttttcggatgtgtttgtattgtttgttcaaaggaaattttatgaaaaaaatcgaggcgattgtcaaaccgttcaaactcgacgacgtgcgcgaggcgttgacggaaatcggcattacgggcatgaccgtcagcgaggtcaaagggttcggcaggcagaaggggcatacggaaatctatcgcggcgcggaatacgccgtcgatttcctgcccaaaatcaaaatcgagctggtgttggcggatgatgctgtggaacgcgcgattgacgtgatttcgaggtggcgcgttcgggaaaaatcggcgacggcaagatttttgtgctgccggttgaggaggcaatccgtatccgcacgggcgaacgttcggacgcggcagtctgacggccggatagaaaataaaaaccgcagccttgcagggctgcggtttctttatcgggagatgctgcttaccactcgtaattgacgccgacatggtaggctgcggaagaaccggacgaagtgccgactgccacgcctgctttggcggcaaagttttcggtaaagcggaagccggtaccgatggcgactgccgattcggatttgtagccgccgactgcagccgttacattgaaccgacccacgttgtaaggttggaacaggccggagagcgcggcttgttctgcaaggccttggcgggtttctttgcgcagattagctacgtttttgtccaagctgtcgatgcgtgctgagtttttagcaatatcagctttgttcgtagcgatatcagctttgatgtcggtaacttttgcagcgacagcttcggccttgtcggctgcagtattagctgtgccagcggcagcttcggctttgcctgctgcagtttctgcagcttttactttggcatcgacgttttgtttggtttcttcggccgtctgtttggcttcattggcggttttgacggcttcgtctgccttagtgttggtttcatccaatgaatcggcgatatcgttgaatgcttcggcatgcttgtcgacggtatcagccacggcttctaatttttcatcaatttttacgatatttgtcttagtctcttcagcaaatgtcgttatattttctcccaatttattcaaggcgttggtggtttcatccagagcggcatcagtatctgctaaagcggcatcagtgtctgctaacttggttgttaacttttctatttcagattctgcagcttttactttggcatcgacgttttgtttgttttcattgacggttttggtcaggttagtcacgacttttttcagacccagacctttaaagtcgtcggcttcaacatcggctgcagttgcgtctttttgggtaattgtgccgtcttcaccaatgtcgtagatggtctctccagctttgaaaccgttgatttcttggccattgttgtaggcagcaacaatggccacagtggcagcttttttaacatcgtcgtcgcttgtggctgccagtgcgccgctacagaaagtggcaaggatggctgtggtcagtactttggctggaaagtgtttcatgctcattacctttgtgagtggataaaaaatggggcggaaatcttttgtaagtattttatccccaccaagtttgtttacatattaaagtatatatgaaaggaggcatatatacaatacattgtcgcaatttatttatttatttatttatttatttatttatttaattcttgcagttaggtagttcggcattaatatctgttaatatgtgcatattatgctgatgtcaattctgccggtgtcgtgtcttaattttgtcaggatatgggttgccgtctgaatgttcagacggcctttttgtcggatttagatatggtggataaccaattttttgccttcgtaatcgaggacgtcgacgtccatatcgaatagggttttgatgtttgcggcggtgaaaatatcgttgggtttgccctgcatggcgacttggccgtttttcatggcgacgacgtggtcggcgtaggctgctgcctggttgatgtcgtgcaatacgacgacggtggtgcgcttgtgttcgtcggtcagccggcgcaggatttgcatgagcgagcgggcgtgatacatatcgaggttgttcagcggttcgtccaaaaggacgtagtcggtgctttggcagaacaccatcgcaatcatggcgcgttggcgttggccgccggaaagctcggtcaggtagcggtcggagaggtcttgcaggtggaattcttcgattgcaccgttaacgatacggcggcattcggcagtcggtctgccttgatggtaggggtaacggccgaacatcagcaggtcgcgcacggtgatgcggctcatgatgctgttttcttgggtgaggatggacagggttttggcgagttcggcggtgggggtatcggcaagatttttgcctcggtaggcgatgctgccgctttcaagcggtcgcagccgcgccataaaggaaaacagggtggatttgcccgcaccgttggggccgacgagggcggtaatgccgccttcggggatgtcgaggctgacgttgtcgaggatggggcgtgtgccgatgcggtagctgacgttgcggatggtaatcatggcggatgcttgtcgggcgtaggtttgttgttgtttggcggggttcagacggcatttgaaattcggaatgccgtctgaacgctcacacttcgcggacgatgacgaactgcgggtcgtccgccgattcggttaaaaatgctttaacgcgtgcctgccagagttgtccgaagcgttcgagttcttctgcgcttgcgctgccgctgacggctttgggcatgatgtcgcgcatttcgggtgcgaagggttgcagggcggcgttgaggccgacggcgacggttttgccgttgtctttgcggcgcggtgctaatggcacagggaaaacaagattagctgtttatattgaagaacaattaaaggaaaaagcacacagaatt

SEQ ID NO: 21 - DNA, 92934 bp, Neisseria meningitidis
acatatttagccaaaaccttattcagcagcatagtcatacwccacgaccagcggtcgcatggtcagaaaatttttcatctttataaacgtgtgcggacacggctttggcagcaagttcgggcgtaaccatctgataatcgatgcgccacccgacatctttcgcatacgcctgccctcggttgctccaccaagtgtagcccggcacatcgggataaagcgtgcgccacatatccgtccaaccgagcttgtggataaccttgcctatccactcgcgctcttcaggcaggaaacctgaatttttctggttgcctttccagtttttcaggtcgatgttttggtgggcgatgttccagtcgccgcagacgacaatgtcgcgcccttcgtttttcatcgcttcgagcatagggtaaaacgcatcaaggaaacggtatttcacctgctggcgttcttccgcgctgctgccgctgggcaaataaagcgagataacgctcaacctgccgaaatcgcaacgcacaaaccgcccttccctgtcgaattcttcaatgcccataccgatttgcacattgtcgggtttgcgtttgctgtacaccgccacgccgctgtaaccgcgcttctcggcgcaatgccaatgaccgtgcatcccgtgcggatttttcatatcggcagacaaatcagcctcctgcgctttgagttcctgcacgcagacaatgtccgcgcccgatgcggcgatgtattcgtaaaaaccttttttgtaggcggagcggatgccgttgacgttggcggaaatgattttaagcataataaaaataagttctcacaataaaaatgccgtctgaacaaaaaagggcaaaatgcggcacatttacccttttcgatggattttaaccgcgccgccaagtcgtgccgccggcgttgtcttccaaaatgattttgtgttcgttcagaaggtcgcggatgcggtcggattccgcccagtttttatcggcgcgcgcctgtttccgccgggcgatcaagtcttcgatttcttcgttggagagaccgtctgaagccgcgccgccttgcaggaactcggtcggatcgcgttgcagcagtccgatgatgccgcccaaggctttcagacggcctgccagttgcgcgtcattggttttgttcacttcgccggcaagttcgaacaacaccgccaccgctttcaccgtatcaaaatcatcattcatcgcaacataaaagcggcgcgtgtagtcatcgccggcttcagacggcatcggatcggcgggcggcgtatttttcaaagtcgtatacaaacgcgtcaacgcgccttttgcatcatccaaatgcgcgtcggaatagttcaacgggctgcggtagtgggcgcgcaggatgaagaagcgcacgacttccggatcgtattgtttcaacacttcgcggatggtgaagaagttgcccagcgatttggacatcttttcgccgtccacgcggataaagccgttgtgcagccagtatttgacgtggctggcgatgctttgcccgtggtgggtttgcgcgtgatgatgaccgcaggtatgccccgtcgcgccgacgctttgggcaatttcgttttcgtggtgcggaaactgcaaatccgcgccgccgccgtggatgtcgaaggtatcgccgaacaggttttcactcatggcagagcattcaatgtgccaacccggacggccgttgccccacgggctttcccacgccggttcgcctgctttggcggctttccacaacacaaaatcaagcggatcgcgtttgaaaccgtccacttccacgcgttcgcccgcacgcaggtcgtccaacgatttgcccgacaattgtccgtaagcggcaaactcgcgcacggcgtagtaaacgtcgccatttgcggcaggatatgccttgccgttttgaatcagggtttcaatcatggcaatcatttgcggaatgttttccgttgccttcggctcaatatccggacgcaacacgcccaaagcatcggcatcttcgtgcatggcttggatgaaacgcgcagtcagtttgccgatggtctcgccgttttcagccgcgcgggcaatgattttatcgtcgatgtcggtgatgttgcgtacataagtgagcggatagccgcactcgcgcaaccaacgggcaatcatgtcgaacaccaccatcacgcgggcgtgtcccaaatggcagtaatcgtaaacggtcataccgcagacgtacatacgcacgttttcagggtcgatgggggaaaagggttctttttgacgggttagggtgttgtagatggtggtcatgggattatggattaatctttgttgctcggatgataatttctgttctgttcctgtagatacggaccaaggaacattacgtagttgcggattattaatatggctgatatttgtgaaaattggttctgcataacagtttgcaaaattttttgtaaattctgataatttaaacttatcttttaataagtttgctaaatctgatgacgagggataaagtttacttcttatactaggcatttcaatatgaaggactatttttatttcgttacaatctaaagccaagcgagaaaaatctttttcttcctgtttttctgctttaaatttagcagaaaccaatcctgccaatgaatctcgaatttttcttgcgattaaatatggtaggtcagaaagtttttcatctattgattgggcatttggctcaagcccaagtcggtaataatctttaatttcgattagccaaagtgtcgattcatgaagggctattatatctacacctgagctgccattatcgtcatctacactttgatttatcccgttctttcccttttcatttgtatcaattttattacgtaaattacaactgttctgaaaaattttataatgttcccattcgtcatacttggtaacgtaataatcttcaggaaaagcaaaggttaatctcttttctgtgattgtagtcatagcttaacctcaaatattcagatacctgtctgcctgcataatgttttcatctaacaatatcaatgtgttcaaatcattaatactgttcccttgctccacttttgttccatcatcggaagcaatcaacgagaaaaaacgtacaggtaaatccgtgttattttcaagcttcaaaagttccaattctctcaataagaataaagagtgtgttgcaataaaaacctgaataccctgttgagataaagaccaaataatacgggcagccactttgatcaatttaggattcagattagcttccggttcatcccaaaatagatagcctttatccagcaatgcccctgttgcgattaaccgggcaatcatgacaaatttccgcaaaccctctgctaccaaaggtgcttcaatcttaccgcccgtatttgtcagcgatagataaaaccttccttgttcttcagatacttttccgcccatcgcgttctcaataggttcgagcaattctcgaatttttgtttctctggggcctttggcaagcgggtgatttaattgcatacaggtatcaaaccaagtttcttcgaaagggatgctttggttttgatacaaagaagtgaaccaagggcaaagtgtaattaattcgcggctgggtaagaagataggtgtcggagtatattcattttctttcaatccgatgctttgaacattgacttgcgatgatgagttactggaaaaattcagactactatgcgtagtgccgttttgcagttttaaaacgatttccgtacgcccgcgcccctgcaaacgtttgctcaacctacccaaggaatcgggacggaaaacattcagtaatttatcggcaaaacttttttgcaattctgttttcagtaatctgtttttggtgttagatgttacttctagcaggctgtataaaatttttaacaaatgtgttttgccacaaccgttttcggcaacaataacattgagattttcagaaaattcaaaagtatcgtttggaagaacggtaaagtttgtcaactcaagcgactggatatattggttagatgacatttttaatccatttcaatcttgctttaaaattgtttcaaacaaccttttgtagaacaaatatcgtctgaaaccctttcttttttcactccggcttaaacacgcctgtatccgttttaggctgctgttcgataatttcaacatttgccgctgctttctccgcttctgctttttcagcttcgatacgttttttctcggtcaggtattggttgatttggtgtaccaattcctgcgtgccttggtgggtcagcgcactgatttggaagaggcgcggggtttccatgtcaaattggaaacggtcgtcgggtttggggtagtcccagccgacggcttcgaggaaggcggcagtgcgcgtttgggcttcttcttcgtcaagcatatcgagtttgttcagtaccagccagcgcggtttgccgtagagttcttcgtcgtatttgcgtaattcgttgatgatggcgagtgcttcttcggcggggttgacggtttcgtcgaagggcgccaaatcgacgacgtgcagcagcaggccggtacgtgataagtgtttgaggaaacgatggccgaggcctgcgccttctgccgcgccttcaatcaggccggggatgtcggccatcacgaagctgtggttttcgtcgatgcgtaccacgcctaagtttggatgcagggtggtgaaggggtagttggcgattttggggcgtgcggcggatacggcggtaatcagggtggatttgccggcgttgggcatacccaataagccgacatcggcgaggactttaagttcgagttgcagggaacgggcttcgccttcttcgccgggggtggattgtttcggggcgcggttgacggacgatttgaagtggatgttgcccaagccgcctttgccgcctttggcgaggcagacgcgctgtccgtgataagtgaggtcggcaacggtttcgccggtgtcgaggtcgcggataagggtgccgacgggcattttgaggacgatgtcgtccgcacctgcgccgtaacggtcggaaccgtggcctttttcgccgtttttggcttggtagcgtttaacgaagcggtattcgacgagggtgttggtgttttcgtcggcttctgcccagacgctgccgcctttgccgccgtcgccgccgtccgggccgccgcgcggtacgaatttttcgcggcggaaactggttgcgccattaccgcctttgcctgcggcgacttcgatttttgcttcgtcgatgaatttcattcaatgctcttgtttgttggtttcaaatggggggttcagacggattaccgtgtgttttgatgccgtccgaacagaatttcggacgctattataagggataagcggtatttcaacacgccgtacccaaactatttgttccgcccatcttaatgaatttttaagcaaatcttcagcctgcaaacaaaattatgtccaacttctttggtacaatcgcgcctttttgacattccgacccgacggaatgtccgttcaaaccgttacatataataagttttttatgaacacaaaccaacctgccgtttacgacccgttgacacgcgcgctgcactggctgaccgttgccggcttcatcggcattctgaccaccattgtcctgtggacgatttatagtggattaacaaaaatcaggacaaggcgacgaagccgcagacagtacaaatagtacggcaaggcgaggcaacgccgtactggtttttgttaatccactatacgaagaggcggaatgggtgggcagcctgttcggcctgcacaaatctttcggtttccttacgctgacggtgattacattgcgcatcgtgtgggcggttgccaaccgcgccaagcgtccgcaaagcgactgcaaggctgcggcggcaggccacggcattctgtatctgctcatgcttgctgttcccgttatcggcatgatccgccaatacggcagcggccgcggcccgttgaaagtgttcggcgttgaagtgatgcaagggttcgccggaaaaaatcgagtggatggcaaacttgggcaacacgttccacggcaatttgggcttgctgctgtttgccgccgtcgccggacacgtcgccatggtcgtcgcccaccgtgttcagggtagagatgttctgtgccgcatgacgggtcgtgtccgctgattccgttcacactatggtgccggctcgtccggcactatttgtttttccaagacagagccagatcgtacaaagctttctttccctcgcccgtgattttggcagcaagctccgccgcctgtttggtcggcagctcggctgtgaggattttcatgatgttttgcgcggactcggacaagccttcgtgtttttcatcctgcgccggataaagcaccaacaccatctcgccgcgcgattggttgccgtcggcagacaatgccgtctgaatttccccaaccgtgccgcttaagaacgtttcaaacgttttcgtaatttcgcgcgccagcattaatcggcgttcggggaacagttccgccatatcggcaagcgtcgcaccgatgcggtgcggcgtttcaaacatgacgataggaaacgccgcccgcacccatttggcaaacagtttcctgcgttctcccgatttcggcggtacaaaaccgttgaaataaaaatcggatccttccacaccggccacgctcaaagccgccatcaccgcgcttgcgcccacgacgggaacgactttaaacccggcctcacgcacgcggcgggcgagtttcgcgcccgggtcgcacacggccggcgtacccgcatcggaaacctgtgccacaaccatgccgtctgaaagatagccgacaatcttgtccgccatctgccgttcgttgtgttcgcgcacactgacgagtttgccctgaatgccgtacgcgctcaaaagctgtgcggtaacgcgcgtgtcttcggcacagatgatgtccgccttttgcaataccgccaaagcgcgcagggtaatgtccgccaaattgccgatgggcgtggcaaccacgtataatgtccctccgacgacgctgtcggaggctttctgcaaatgtttctgaaacataagaatgccgtctgaaaaacaaacattataaaggttaaaccgattatgcgcctaaaccacaaacagggcgaggcaggggaagatgccgcgcttgccttcctccaatcccaaggctgcacgctgcttgcccgcaactggcactgcgcctacggcgaaatcgacctgattgtcaaaaacggcggcatgattctgtttgttgaagtaaaataccgcaaaaatcggcaattcggcggtgtcgcatacagcatttccccatccaaattattgaaactgcaacgaagtgtagagtattatctgcaacagaacaggttgacaaacgtaccgtgccgcctcgatgcggtacttatcgaaggcagccgcccgcccgagtggatacagaatattacaggttgacgatatgacgacattacaagaacgcgttgccgcccattttgccgaaagcatccgtgccaagcaggaagccggaaaagtattggtcgagccgaccgtacaggctgccgagctgatgctgcaatgcctgatgaatgacggcaaaatcctggcctgcggcaacggcggttcggctgccgacgcgcaacacttcgccgccgaaatgaccggccgttttgaaaaagaacgcatggaactcgccgctgtcgcgctgacaacagacacttccgcgctgacagccatcggcaacgactacggtttcgaccacgtattcagcaaacaggtgcgcgcgctcggacgtgcaggcgatgtattggtcggcatttccacctccggcaattccgccaacgtcatcgaagccgtcaaagccgcacacgaacgcgatatgcacgtcatcgccttgaccggccgcgacggcggcaaaatcgccgccatactcaaagacaccgacgttttgctcaacgttccccatccgcgcaccgcccgtattcaagaaaaccacatcctgctgatacacgccatgtgcgactgtatcgactccgtactgctggaaggaatgtaacccttttcagacggcatggcgcaaagcaatgccgtctgaaacgcccaagaaaggaagcacccgatgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctgactcggcaatgccgtctgaaccgccttcagacggcattgcccgacaccccaaaagcacaatcaaaatggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaacctcttctgacccggcacggcaggcacacccgcaatccaaggaagcattatgaacggcatcatcatcaaaacccccgaagaaatcgaaaaaatgcgcgagctgggcaaactcgtcgccgaagccctcgactacatcggacaattcgtcaaacccggcgtaaccaccgacgaaatcgacaaactcgtttacgactaccacgtcaacgtccaaggcggctatcccgcccccctgcactacggcaacccgccctaccccaaatcctgctgcacctccgtcaaccacgtcatctgccacggcattcccgacgacaagccgctcaaagaaggcgacattatcaacatcgacctcaccatcaaaaaagacggcttccacggcgactccagccgtatgtttaccgtcggcaaagtctcccccatcgcccaacgcctgatcgacgtaacccacgcctccatgatggcgggcatagaagccgtcaaacccggcgcgacactgggcgacgtaggttacgcctgccaacaggttgccgaaaacgccggctattccgtcgtacaggaattctgcggacacggcatcgggcgcggtttccacgaagccccgcaagtgttgcactacggaaaaaaaggacagggccccgttctaaaaccgggtatgatttttaccgtcgaaccgatgatcaaccaaggcaaacgccacctgcgtatcctcaacgacggctggacggtggttaccaaagaccgctccctctccgcccaatgggaacacgaagtcttggtgaccgaaaccggctacgaaatcctcaccgtcagccccgcctccggcaaaccctgaaaccggacgtatccgccccataaaaacaaacaatgccgtctgaaagaaacggcagatatgatatataatataaaaacaggcttgacccggcacattacgaaaacaaagcaaatcggaatttgccccgcaaccagacaaacttaaaggaagttttatgaaaatatttgaaaatatagaagatgttaaagccatccgtaaaaagaccgggctgaaccagatagacttctggggcaaggtcggcgttacccagtccggaggatcgcgctacgaaaccggccgcaaaatgcccaaacccgtacgcgaactgctccgcctcgtccatatcgaatgcatcgatttggcgaaagtcaacaaaaaagatatggaaatcgccgccctgttgaaaaaacaccatcccgacctgtatgccgagttgtccaaacagaccaagtccgaaagaaaaaaacaaagttaaaccgcaacctccggatgcccgacagtttttcatttccgaaaaacgcaaacaatgccgtctgaaacaccggacaggtcgccgtatcccgcctgccgcccctgcctcaaaccgccgaaccgcccgaacccgcctttttacaaactttatccaatttcctgtttatttcgggatacgccgacattagaatgtcaaacagctcgaaacgggcaaactccacatccatccaaaggaataaaaatgaaacttctgaccaccgcaatcctgtcttccgcaatcgcgctcagcagtatggctgccgccgctggcacggacaaccccactgttgcaaaaaaaaccgtcagctacgtctgccagcaaggtaaaaaagtcaaagtaacctacggcttcaacaaacagggtctgaccacatacgcttccgccgtcatcaacggcaaacgcgtgcaaatgcctgtcaatttggacaaatccgacaatgtggaaacattctacggcaaagaaggcggttatgttttgggtaccggcgtgatggatggcaaatcctaccgcaaacagcccattatgattaccgcacctgacaaccaaatcgtcttcaaagactgttccccacgttaatcaggcaacaaaaaacagcgttttcagaaatgaaaacgctgtttttttgaccgttccattattcacaaaagggaaaaaacgattacctgccccgtgtatcaaaacctgccctgccggatgaagggcataaccggcagggacggcgtcaacaccatatgggggtacggcttttcttgaaagattcggcttaaatatccaatactttcgcggtataggcgataatttcatccgccctttcagggttttcgttcaacttgatgccgtaacccggtaccagctctttcagacggtcttcccaagacggggcgcgctcggggaagcattggtgcatcagccggatcatcagcggcacagcggtcgatgcgcccggcgacgcgcccagcaatgcggcgagtgagccgtcggcgtgggcgacaatctccgtaccaaactggagcacgccgcctttttcggagtcttttttaatgatttggacgcgttgccctgcggtgatgagttcccagtcgtcggggtttgcctcggggtagtattccagcagggaggcgaagcgttcttctttggttttacgcaattcgcccagcaggtatttggtcagcggcatattcgcccagccggcgcacagcataggatagaggttgtccatatggatggacagcggcaaatccataagcgagccttgcttgaggaagttggaacggaagcctgcgtaagggccgaacataaggtggcgtttgccgtccacgttgcgtgtgtcgaggtgcgggacggacatcggcggcgcgccgacggaagcctgcccgtacactttggcgttgtgttgttcggcggtttcggggttgctgttgcggaagaacaggccggacacggggaagccgccgtagcctttgccttcggggatgccggatttttgcagcagggtcagcgcgccgccgcccgcgccgaggaagaggaagcgggtacggagggtgagctgcccgtcggggttgcgggtatcggcggttttgagcacccacgcgccgtcggattcgcgtttgatgtcttcgacgtggcggttgaactcggtttttacgcccttgccctgcaaatatttcaccatttggcgcgtcagccgtccgaaatcgacatccgtaccttcggcggagtagttggcggcgacgggttggttttcgtcccggccgcgcatcatcagcggagcccaatcggaaattttgttccgatcggtggaaaattccatattttcaaaaagtttttgggttttaaacgcgtcataacgtttttgaagataagaacaatggtcttcattcatcaccaaagacatatgcggcacggcattgatgaaggaattgtcttccaacttgccttccgcgaccagcgtcgcccaaaactggcggctgacatgaaactgttcggcaatattgagggcgcgcgccggatcgataatcccatttgcacccaacggcgcatagttcaattcgcacagcgcggaatgccccgtgccggcgttgttccacgcgtttgacgattccaacgccacatcttccaagcgttcaatcagggtgatttcccaagacggttcgagttctttgagcaaaacgcccaaagtcgcgctcataatgccgccgcccaccaagacaacgtctgtcgcttcagccatggtttactcctaaaaaacaggcatcttctgcccttatggttatttgccgtactacaaacgcctgaatcgcaaaagcagggaaaaccggcaatggtgtgtgtccgagtatgctgtttcggggttggaatgcgttgcaagcatggcttccgacaccgcttcaggggcttgtaatatgttatcgtgaatgtagtggattttactgggaaatgcaaagtttttctgtcgcccgccaagtcgggaaactgcgaaatgaaaaataaaaatagttatttatctatatatatcaaatttttaatagataaaaaatcaaaattgtttatatattaatttttaaaagattgtcagcatattgcgttaagttttttatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaatttgaaaatactgcctcacacctgcacgccataccctgccaacctgccggtcaggatttccctgtttttgcaccaatcttccctcagcatactgtacacgaccgtatcgcgcacactgccgtctttacggagcatatgcatacgcagcacgccgtctttttccgcacccagccgttcgatggcacgttgcgaggcaaggttcagaatatccgtgcgccatcccacgcaacggcaagccaaaacatcaaatgcggaatccaacagcatgattttgcaacaggtgtttatccgtgtccgccgtgccgatgccgcataccatgtgaatccgatatccaaacgcggaatctgcggttcaaaatgataatacgccgttgtcccgaccaccctgcccgcctcttcatcgacaaccgcaaacgccaaacgcgttgccaatgctgtcccgatatagtctgccaccctatccggatggggcgcggacgttacccccagcttccaaacctccccatcgcaaaccgcctcgcgcaaacccgtttcatgatgcacatccaacggttcgagacgaacgccgcccaacgacaagaccggcagtattatcttttccgacatccttttctcccaatattccgccttcagacggcatttccgcccggaatgccgtctgaacggctaaaaacacaatatccccgcctccgacacaaaaccgtccaaagaccggtcgtgcgcctcgaccggcagcctgtccaccaactggcaggcaaagcccacgcccacggtttttgcctgcaaacggtatttcatcgctgaaagcgtcgcatcgtaatagccgcctgcctgtcccaagcggtagcccagcctgtccataccgaccactggcacaagcaggaggttcaaatcatgcacacgctttttccgacctgcaaactgagggacatgcagcttcgccctaccgcgcttgcgttcttgttttactccatcggcaggatacggcgtaaaccacatccgccgcgaacgcggttcgatataaggcaggtagagttccgcaccgcgtttttgcgccgcgcggacaaagccgtccaaacgcaattccttgcccatcggccaatacacgccgattttccgcccttttttaatataacgtttgagcaggtggttgatttttaccgttgccgccgcccgcacgtcccgccccatttgcgaacgccgcccgcgcaattcgcggcgcagggcgcgtttttcctcgttcctcatttcagacggcctttcaggattgcggtagaatgttgcgattataacgattttgttaacattcaaacaggacgcacacaatgtggcacatcgtcgccatcggctatctttttgttgccgttatgtattccgccgcgcagccgagtattgcgcgcgccttgatttatttggttttttgggcggtgctgcccaccgtgttcacggttttcaccattaccgtccgccgccgcaaccacctgatgaggcagcaggaacaggcggaatccgaacagcagcgcgcacaacggcaaaaagacagcggcacaaaaccctgaatcccttttcagacggcatcttatccgctataatccgtcagttttccatttcggaaacacactattttttaaaacttatgcccactttcgccgaagggtgcttgacaataggcgtgacctatcaagttctatgcgattgaatgtgtgctcttaaccctttcaaggaaataaaatgtctcaaattactatgcgtcagatgattgaagccggtgttcacttcggccaccaaacccgtttctggaacccgaaaatggcacaatacattttcggtgcgcgcaacaaaatccatatcgtcaacctggaaaaaaccctgccgatgttccaagacgcgcaagaagccgtacgtcgtctggttgccaacaaaggtacagtattgttcgtaggtaccaaacgccaagcccgcgacatcatccgcgaagaagcgacccgcgccggtatgcctttcgtcgattaccgctggttgggcggtatgctgaccaactacaaaaccgttaagcaatccatcaaacgcctggaagaaaaaaccgcagccttggaaaatgctgccgaaagcggtttcagcaaaaaagaaattctggaaatgcaacgcgatgttgaaaaactggaacgttctttgggcggtatcaaaaacatgaaaggcctgcctgacgcgattttcgttatcgataccggctaccaaaaaggtactctggttgaagctgaaaaattgggcatccctgttatcgccgtagtcgataccaacaacagccccgacggcgtgaaatacgttatccccggcaacgacgactccgccaaagccatccgcctgtactgccgcggcatcgctgacgcagttttggaaggcaaaaaccaagcgctgcaagaaaccgtagccgctgcccaagaagccgctgccgagtaatccggcaaaccgaagaggggcgttatgccccttttctcaaatatgccgtctgaacgtccgttcgcggcacacgattcccgaatgcggaaaatcctttccgtatttcccaaaaatctaggagattcaaaatggcagaaattactgcaaaaatggttgccgacctgcgcgccgctaccggcctgggcatgatggaatgcaaaaaagccttggttgaagccgaaggcaacttcgacaaagccgaagaaatcctgcgtatcaaatccggtgcgaaagccggtaaactggccggccgtaccgctgccgaaggcgtattggcttacgcgatcaacggcaatgtcggcgcattggtcgaagtaaactgcgaaaccgacttcgttgctaaagacgcgggcttcgtagaatttgccaacttcgttgcgaaaactgctgccgagaaaaaaccggcttctgttgaagaactgagcgaactggttgaagcagaacgcaaagccatcatcgccaaattgggcgagaatatgtctgtccgtcgcttccaagtgatcgacactgccaaccaactggttgcctacatccacggcgcattggcgaccgaaggcgtattggttgagtacaaaggctctgaagacgtagcacgcaaaatcggtatgcatattgttgccgctaaaccacaatgcgtaagcgaagccgaagtagatgccgaaaccgttgaaaaagaacgccacatctacaccgagcaagccatcgcttccggcaaacctgccgacatcgccgctaaaatggttgaaggccgcatccgtaaattcttggctgaaatcactctgaacggccaagcattcgtgatgaaccccgatcaaactgttgcccaattctctaaagaaaacggcactgaagtgatcagcttcgtacgctacaaagtaggcgatggtattgagaaaaaagccgtcgattacgcagccgaagttgctgccgctgctaaagtgtaaggcacttatgaaaaagaaagcacctggattccaaacgaatcagggtgcttttttttgagaaaaccgtttacggtacctattttaagacgaccgaatattcagaccgtcttaaaacaaaacaataataaaccgacacaccctatcattaatattccgaccgttggaaattcagacggcccaactccgaccgacgacattcaagaaagcaaggtatccatgacacagcaaatcaaatacaaacgcgtattactgaaactctccggcgaatccctgatgggttccgatccgttcggcatcaatcacgataccatcgttcaaactgtcggcgaaattgccgaagtcgttaaaatgggcgtgcaagtcggtattgttgtcggcggcggcaatattttccggggcgtatccgcccaagcaggcagcatggatcgcgccaccgccgactacatgggcatgatggcgaccgtgatgaacgcgttggcactcaaagacgcatttgaaactttaggcatcaaagcgcgcgtacaatccgcactgtctatgcagcaaatcgctgaaacctacgcccgccccaaagccatccaatatttggaagaaggcaaagtcgtgatttttgccgccggtaccggtaacccgttcttcacgaccgacactgccgccgcattgcgcggtgcggaaatgaactgcgacgtgatgctcaaagccaccaacgtcgacggtgtgtacaccgcagacccgaaaaaagacccgtccgccacgcgctacgaaaccattacttttgacgaagccttgttgaaaaacctcaaagtcatggacgcgaccgctttcgccctctgccgcgaacgcaagctcaatattgtcgtcttcggcatcgccaaagaaggctcgctcaaacgcgtcattaccggcgaagacgagggaacgctggttcactgctgattgaccatagtgtcggcagatatagtcgcatatgggcttcagacagccatttattatatggagattatagtggattaaatttaaaccagtacggcgttgcctcgccttgccgtactggtttaaatttaatccactatatttacaattttgatacaatttgtttttcatcaaaggagaaaatctatgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttgattcacactaccataaccgcttgctaccaaggaaaacaaaatgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatgaatgaacacaacctgttaattttctgtttaaaagacaatgtttcaattagtgaatatactgaaatggttgattgggcttatgaaaacattcaatctgaaacagttgtagaaattacggaaaatcaaattattgaatatcaaaatcgtggattatgggggcttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaagaatgaaaaaacagtaatttttcatttttgaaactaatctaatttttagcagccgtaggtcggattctcgaatccgatattttccaacagcggcatttcggaaacgatagatgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcatcaattccgccagacaatgggctgatgcccatccgaatataacagcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaaccgtctttacaagcgcaactaattggagaacaaattagtagtgggcatgcttataacaagcatgtcataagacaacaagaatttacggatttaaatatcaattcaccagcagattttgctcggcatattgaaaatattgttagccatccaacaaatatgaaagagttacctcgcggtagaactgcgtattgggatgataaaacagggacaatagttatccgagataaaaattctgacgatggaggtacagcatttagaccaacatcaggtaaaaaatattatgatgatttataggaaaaagccatgaatatactatccataaataatcaaaactcaactatttcactaactcaagatgaagtttttgttttacgagctatcttgaatgagatatatgcgggcgtatgtgtagattcaagagaatttgaaaatgtatctggtgttagaaaacatgaagtagataatttacaacaacagtttgctggaatttataaaaaaatgacaacttaacaacccaaatttttgtcagagcctagtgcaaattacaactatgattctattgtagccgaaatgaaagaaaaaaatcatgggttggcgacagggttgatgttgttaatatgcctgatggagcacctactagtatggataacacgcgtattatggcagcacgtgaagcaggagtaaaagtggaagcgaatgttcataattttaatgaccgattatcatcaaaagagagaatcaggtttaagcatgatggtattgagcctcaaacttggggagaagctatccagctacgaattagaaagcaagaaacacaaaaaggagttccagaagggtggagcaaaagatttcctaacggaagtatttatgatgtaaaggtacttaggaaatgataaaacaaaatagttttgttccgtatcctgaagcaatgcttcctaaaggatttaaatatccgcaaagttatttaaaattagctcaatccactcatgccattaactacgatgaacaatattcttttccttggtggtttgaaaatgcagaaagcaatatatcagaagtaattgacatttattttgaaataactggcattccaaacctattaccttttgctagaaaccaagagtgggctgcctgttttgatatttcagataaatcaggtaatcctaaaattatagtagttaatttagataatacaaaatattacgagacttttgaaaattttgatacttggctaaaagaagctgaaaatgatggttggtagcaaccgtaggtcggattctcgaatccgacatttttcaacagcggcatttcggaaacgatagacgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcattaattccgccagacaatgggctgatgcccatccgaatataactgcaacagcccaaactgccctttccgtagcagaagccgcaactacggtttggggcggtaaaaaagtaaaccttaacccgaccaaatgggattgggttaaaaataccggctataaaacacctgctgcccgccctatgcagactttagatggggagatggcaggtgggaataagccaccaaaaccaagtacgcagcaacaccctacacactctgataacaatatcggcttacctgcctcatatgttaaacctgatacatctatttctccgacaggaacaattcaagaccgcatcagatggacaaagtccaagtttcctactgagaaatctttaaatggacatttcaaagctcatggaaaagaatttggcgatataaccattgaagactaccaaaaaatggcgtctgatttgttatcaaaacagacatcggacaagatattaggttatcagacggaacatagacgagtgcgctatgatatcaataacaatatctatgttttggccaatccaaaaacattcaaaatcaaaacaatgtttaaaccaaacttaggaaagaagtattatgatggagaattcaaaaaagacatgggaaattgacggagaaatatggctacattgtcctgtttgcggaactgaagttatggactatgatatctgtgacgtttgtcagtggcaaaatacaggagaaactaatatagatggtggccctaatgaaatgacacttgcggaggcgaaagaagcttacgcaaaaggcttaccaatcagataaataagcacctagagaaatcaatgatgacggaatcccatggttacctatcaaataatttacctgttaaaatcataaatgatattatttatgcaacccagttagtcgaagatttggttttaggaaaaataaaaattgttgattttttaaaatcatataacaatttttattgttggcttggttttgatgagttgcctcaatctgagaaaataaaattcctaagctatcttaatatattaagtattcataaagaaatacaagatgaaactgtgaatagggtttataccgattgaaaaatagtagatagagattaacatgttaaatgaaatttttgaaatttattcgagacaaggggaatctttgataggaattggaattagagaagccgcattacccgtccctattgcaatagatatattaaatttatttatcaatgagagaatacttgtattggggggagatatttatatcaagaaagataattatttttatcaaacatatgataattggtattacgagggaagtaatttatttaacagtatcgacaaagcaatgcattatttatctcaaataaaattagagaatgcatacgtatcttttgtgttgaaatttatctaacaaaggaagcacaagaatagatttatagtaaaacatcaagatgttgaaaatgctgggttttaatccaacctacactgaccggctcagatacagccgctcagcagactctacaaggtattaatgatttaggaaatttaagtccggaagcacaacttgctgccgcgagcctattacaggacagtgcttttgcggtaaaaaacggcattaattccgccagacaatgggctgatgcccatccgaatataactgcaacagcccaaactgccctttccgtagcagaggccgcaggtacggtttggcgcggtaaaaaagtagaacttaacccgactaaatgggattgggttaaaaataccggctataaaaaacctgctgcccgccctatgcagactgtagacggggaaatggctgggggaaacaaatcattaaaaatagggacacaatctgttgaaaaatcaaccggtcgtacaatacctaataatttaaaggaacaattagcaatggaagaagttaaggcaaacccacagggcaaaactcctgcgagaatacctcctatgtccgatactaaaaatggttggttagcaaaagacggttgggttaagcgtgttcaaaacgtaaacaaaattgaaatacattacattgaaaactcaagaaccggtgagaaaacagattttaagtttaaggattagtcatgtttttagatgatgtaaatgtttttttagatgatttaaatgtttttttagatgatttaaatactaatccaatcactgacgaatggtatatgtccaattttgccgataaacatattaaaattttggaaagttacgaagcctttgatattctaaaacaatttgttgattacatgattgaagaatatgatgaaaaatcagaatatgaaatcatggaaatattgagacaattaaaatatcaagcagataccaacgaaaaattttatacaaatacacagaaacagaaaattgtagaattatataaacaagaaattagtcaggatattttaaatgaaatctttagataaactatcaatatagaaggaaatccttggaaaaaataaaatgataatcgaacacaatggaaatatacataaaatagccagaatgactggaaataaaaataattttttagaaataatcctatcagatattcatgaaaacataaaaatcaaaccattaactataaaagtaaaaggagagaatgttataaatatccttcctgaggaagttagtttttatgtaaaacaaggtgttgatttaatttatgaaaaatataaacggaaattctttatctccgaaatttctttttgccaatcagatagccggccttcaagtatctacgcttttcttacatttcacttgcttgaagatattattaaaaatgaatccccatccaactacacctgactggctaatagcaggtatgaaccgtgtattcatatcaatataagattaattacggcagaatttgatgaaattagacaaaaacttatcgtaagattttatttagacagagaagtaactgatgatggcaaagaagatatggaaacagcacgaacagaattacttccaggaggatatgcttcatctctggtagtttgacagatttgaccgcttcataaacttagaacattaattaatgatgataatgtttatatgattggttctaaggatagcaaaagcaaattcagaaggaacatgaatggctatttatgacttaaacgaaatagccgtaggtcggattctcgaatccgacattttccaacagcggcatttcggaaacgatagatgcgtcaaatatttttgtcggatacaaatatccgacctacatctctgcgcagcaaactttacaaggtattaatgatttaggaaatttaagtccgaaagcacaacttgctgccgcaagcgcattataggacagtacttttgcggtaaaagacggtatcaattccgccagacaatgggctgatgcccatccgaatataactgcaacagcccaaactgcccttgccgtagcagaggccgcaggtacggtttggagaggtaaaaaagtagaacttaacccgaccaaataggattgggttaaaaataacggctataaaacacctgctgcccgccctatgcagacgttggacggtgagatggcaggaggaaacaagccagttgttaaatctatcagaccaactacgcgagatgaattacgtcaagcattgcaagaacaaggttttagacgtactggttcagatgcggctcaatatgaaacatggaaaggtcctgatggcgtgaaaatagatattcgtccaaatggagaggttataagaacccaaagagtgccgcgaaccgatggtgtacagggaaaatatccgcaacgacaagattatgaaggcaatccattgccaaataatcatcatcattctggatattttgtcaaatgaaaaaaaatatttttcacaatgtaagcctttatgaaataatcttttccgataatggaaatacccttacattatcttttacagatacaattgaaggtaattatttcggatatatcaaatgcagtaatattttgaattttaaattagatacaaataatttcgtagattatgaggataaggaagatagcttgtttcccttgtttatacccgaaatagagctatataaataccaattttatagtgaaattattattgatgtagggattattataaaaatatctgctgaaacaattaattttgagccactgggaaaatagtaactgctttcccagcagccgtagcaactgtatttttacccgacggggtaaaaatacagttgctacatctctgcgcagcagactctacaaggtattaataattcaggaaaattaagcccggaagcacaacttgctgccgcgagcatattacaggacagtgcttttgcggtaaaagacggcatcaattccgccagacaatgggctgatgcccatccgaatataacagcaacagcccaaactgcccttgccgtagcagaggccgcaggtacggtttggagaggtaaaaaagtagaacttaacccgaccaaatgggattgggttaaaaataccggctataaaaaacctgctgttcgccatatgcagactaaggcgttaggtacggtagatgaaattggcgatacagtacagcaggttgggaaacaggctagcggacaaaaaaccagcggtggtaatcctgcgattgatagcgacccctatagcccgagtagtgtggcagctcgcatagaagccggtaaggcgcgcagtgatttacaaatcaaagacattttgagcaatactactcaaaggagtaaaacaaaaggtcccgctgttcagtatgataaagtgggggattacaatgacgcactaaatgattttaatagtctgaatgttcgaaatgtacaaacacgtcctaatggaacgataacgggcaatttacctgatgggcgtgcggttaatgctcgtaatgatagtagtggtggagaaccaacacttgaaataacaattagtaataaccgaaaaataaaaatcagatatggaaatacacgataaattatgaaattaaaaagcttagatttcccaactggctatttctattttgataatgcagcaataaactctgataaagtagaagttatagcagttggttatagaaatacggataaaaccataaaaatttttattgaagatgttattcattttagggttgttgatgaatcgtattttatagatacttttatggatttaatttcggaagatgcagatagagctttgcttcatgaaaatggtggtcaatctttttttgaacttcttgatgagtgttatgcggaatggatattgaaagaaagttattttcctttgaatagagaattctttaaatactatatttttatgtttgagcaaacattcatagaaataattggttctagtgcaacgtattcaattattgagggctagcgtaagatgagtaataagttgcctatctttctttcaggcagcctgaaaataaaactacccaagttgatggtgtacctgtatcagtgaagggaaattttgttgatggtaaatttcgcattggtacggcaacaatgaaatcattttaaattgagctagaaatgaacctagaaaattatgaaaacattttaataaaattacttttttatcataacaacttagtaaatgaatattcttattttattgaaaataaaaatttatttaaaatagtatctcgaacgaaaacgagtaagggcttttttttcactatagaaaaaccattaaattttctaagcaaaaaaacttattttgagtttaattttaaatatttacactcagggaaagaacgctttggttcgtttatgtgctggataaatactaatttaatggaatttgagggggttttttttaacgacctgctccctgataatatgataataaataacttttttgaaataaatgattaacgatacaccaataaaaattggtggggtaaccgtatggatgatattcgcggcatcatccaaggtgcggttaatcctttaatttacaaggtaagcaagcaaaagattatttacaacaacaaactcatatcaggaacttagacaaatgaatgaacacaacctgttaattttctgtttaaaagacaatgtttcaattagtgaatatactgaaatgattgattgggcttataaaaacattcaatctgaaacagttgtagaaattacggaaaatcaaattattgaatatcaaaatcgtggattatggagacttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaaaaatgaaaaaacagtaatttttcatttttgagactaatccaatttttagtaatattgatgcagagcaagcagcattagatgccgcaaacatggggagaagctattcaatttagaattaaaaaacaaattgaaaatgaactagcaccaccaaattggtctacccagtttcctaatggtagtatttatgatcctaaggtaacgaaatgattattcaaaatgaatttaatttatatcctagtaatatgcttcctgaaaggttttgttatcctgaaaagtatgttcgtatctctaacgatacatctttaataccttatattcagccacataattttcactggtggtttgagaattatggaacagaaggggcagaagtagcttatatatttagaaattctatcctgcctgatttaaatcttatcccattcgctagtaatggagaatgggaagcttattttgatggtaatgatgtaacaggaaattctagggttattgtcattaatttagataatatagaaaaccatgaattttttaatagttttgaagattggcttgaattagcaattaaggatacttggtaagcagctatctataaagagatgaggctgccctggacaactaggataaactcgattttactaattgttttaaaatggaacaagaacttttatttcactgttgttaaaacgccattcgcactcctttaaatacagctcaaaatgcgctttgggaatgccgttaaacttgcgtaaatgacgttttgcttgattccaaaagttctcagttccattaatatggttttgtcgttcggcaaaatgtgtgctgtgattgatacggaaatggctaaattcgcccgcatccaatacatcatagccacgataacaaaatgagtttattttgtttataccgtcttagacgactttctctcatagggataattctaacttaatttgaatttccctagtgatctagggcagcccctaaattaataaagcagcacaactccttttgccgatgttccggactgtcaaacgactgttcctcatgccacatctccatcaaggtacggataacccgctccgccttaccgttggtctgcggacaagcaaatcgggcaagcctccaaccaatcccattatcataacaagctgcaccgaaagcatgttggacggctctttatattacctatcattgtcagagtaaacgtactcaatcaggtacaagcaggggtcggacagatgttcggtcagaaacttggcagcactgtctgcggttttgtccggcaaaatggcagagtataaaaatcgtcaatagcgacaaacaggtaatctcgtttatcagcggccttctgtcctttgagcaacaacaaccgatcggtatcaggatgcacaaaacctcccggggacaacctgccttttacggctttaagtgcacggtaaatagtgacgcggctgacttagtggcagcatactggggaggtgagtgtttttgtgtatatttttattttggtattcccttagaaatactgtaaacaacgctaccggacggcctgcagggcttcgcgcacgcttgctttgagttctgcgccgaagcgtctgcccaagattctgccgaaatcgtccttcggagtgtaatccaccacatcgggggctttgaccacgtctcgcgccacgctgtaaatattgccgagtccgtccaccagcccgactttcagcgcatccgcgcctgtgtacacgcgaccgctgaacacgtcgggatattgtcggaatttgaggcggccgccgcgtccggttttgacggctttgatgaactcgccgtgtatgccggtcagcatttcttcccagatttttgactgttcgggcgtttcgggcgaaaacggatcgcccatgcctttgttgctgcctgcaattttaaccctgcgtttcacgccgattttttccatcaggccggtcgcgtcgaaactgctgccgataacgccgatgctgccgacgatgctggacgggtcggcatagattttgtccgccgccgccgcgatgtagtagcagccggacgcgcacatatcttccgccacgagataaacgggaatgccggggtgctgcgccttcagacggcgtatttcttcaaaagcggtgttggacacgacgggcgaaccgccggggctgttggcgcggatgacgatggcttttgcctgcgggtttttgtaggcggcctccataccgtctttgagttttttgacctggtcttctacaccgttgccgatttcgccgtacagattgacgactgcggtatgcggcgtgttgcccgccaactgcaatgcggcttcgtcttttcggaaaatgcctgcaatcagggcaaccagaatcagggtgctgacggcgcgccagatgtttttccacatccgctccctgcgcctgtcctgataggcggacaacagcacttcgcgcatgatgtcgcgctcccataaggtttcccccgcattttttgcttcgggtgcttcgttttctcttctgattcggtattgcatggttttccttaaatattgtccgatttgggcaaacggttttcagtttacccgatttttcagctctgctcccaatccgtccaagctgtgcaacacttccgcccacgccgcgtccaaaaggttgacggcttctccttcggctttgatgccgaactcaatgtgcggtttgacctgcgtgccgtctgaatgcgtccaaccgacgctgggcaggctgtacgaacgcacgccgggataagtttgctcgatatgctccataagcggcgtaatgcgcgattcgggctgctcaaacacatacacgctgcggctgccgcgttcggtttggttgaagcggtcggcgtaataagtttccaatacccattccgccatcgggtgcgccatcacaggaaagccggggaagaaataatgctcgcggatagaaaatccggcgatgttgttaaacggattgggcaccaattccgcgccttcgggaaaatctgccattttcaggcgttgggcgtgttccggcgaatcaagcggctcgccgcgtttctgggttatgccttcgataaacttggcggcttcagaatggcggacgacgggcaaatccaaagcagcggctgcggcttggcgggtgtggtcgtcgggcgtggcgccgataccgccggtaacgaaagttggcatgccgtctgaaaagctgcggcgcagttgcctgaccagcaaatcgggttcgtcgggcaggtattgcacctgattgagcttcagccctttggattcgagcagggatttgaaaaaggcgaaatgcttgtcttggctgctgccgtgtaagatttcgtcgccgatgatgatgaggttgaacgcgttcatagatggtttctttaccgatgccgtctgaaaatgtcgatggtgctgtgatttgttccctctcccgtgggagagggttagggagagggtcgagcttgcgtttttcaggcagcgtttgcttaaggcctgctgtctgtaccctctccccaaccctcccccgcaggggagggagtcaggttgaggatggcgtaaagaccgtctgaaaagattttcagcgaaacgggcaaagcttcttttcagacagccttaacggctgacaatgggttatatttataagataatgaactccttttttcaagtccgaaggatacccttatgagccaaaaccataccattctgcaatccctccccgtcggtcagaaagtcggcatcgccttctccggcggtcttgatacctctgccgcgctgttgtggatgaaactcaaaggcgcgctgccttatgcctacactgccaacctcggccagcccgacgaagacgactacaacgccattcccaaaaaagcgatggaatacggtgcggaaaacgcccgcttaatcgactgccgcgcgcagttggcacacgaaggcatcgccgccatccaatgcggcgcgtttcacgtttccaccggcggcatcgcctatttcaacaccacgcctctgggccgcgccgtaaccggcactatgcttgtttccgcaatgaaagaagacgatgtgaatatttggggcgacggcagcacctacaaaggcaacgacatcgagcgtttctaccgctacggtttgctcaccaatcccgcgctgaaaatctacaaaccctggctcgatcagcaatttatcgacgaactcggcggccgtcacgaaatgagcgaatttctgattgccaacggcttcaactacaaaatgtcggtggaaaaagcctactccaccgattccaatatgttgggtgccacccacgaagccaaagacttggaatttttgaactcgggcatcaaaatcgtcaaacccattatgggcgttgccttttgggacgaaaacgtcgaagtcagcccggaagaagtcagcgtacgctttgaagaaggcgtgccggttgcactaaacggcaaagaatacgccgatcccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgagcgtttggtcaccggcatccacaacgaagacaccatcgaacaataccgcatcaacggcctgcgcctcggccgcctgctctaccaaggccgctggttcgacagccaagccctgatgttgcgcgaaaccgcacaacgctgggttgccaaagccgttaccggcgaagttaccctcgaactgcggcgcggcaacgactactcaattctgaacaccgaatcgcccaacctgacctaccaacctgaacgcctgagtatggaaaaagtcgaagacgctgcgttcactccgctcgaccgcatcggacagctcacgatgcgcaacctcgacatcaccgacacccgcgtcaaactgggtatctactcgcaaagcggtttgctctcgctgggcgaaggttcggtattgccgcagttgggcaataagcaataaggtttgctgttttacatcattagcaacttaaggggtcgtctgaaaagatgatcccttatgttaaaaggaatcctatgaaagaatacaaagtcatcatttatcaggaaagcctgttgtccagcctgtttttcggcgcggcaaaggtcaaccccatcaaattcagcgagttcctcaataaacaaacccccgaaggctggcgggttgtaacgatggaaaaagatttgcgccgtatgctgctgtttttcaaacgcgaggcctacgtcgtcattttggagcgggatcgtgtttaagctcggcgtttatacctgtctcggactgtttgccggctgggtgctgctgctgatcgtgcaactctggttttcttttctcgaagcggaattgttcttcaaaatcacactgactatggcggggctgtttgtcatcatcctcgccgccttactggtatgcggtcagtatttttccgaaaagaaaatgaaagacgacgggtttatcaactgatgcggacttgaaccggacccgcgacccaaacatcacaatgccgtctgaacgccctcgcttcagacggcatcaacatcaatcctgctcttttttgccggcaaacacgccgaatccgcccttttccgcatctgtcgggcgatagctgtattttcccgccacttcctcgccggccgggccgtaaaactttccggaaacatccccgctgccattttccgtccaagtccccttaaagccgtttccatcgatggcggctttgaatttttgcgtacccatatgcaaatcatcgccgctgtcgataatgccgtccacagatttgctgccgaaatcgacttttgcggcaaacctgcccctggtcgggtacggacggccgttttccgtatggaaatgcagtacttcgccgttgtacacggccgcgcccgcaagcatttcgccttttgccggttcgccttgaacacgaagggcatacgatccgccgggcaatttttccgccccgtaagtcagataccggtaattcccttcgggcgcgaagatattgccggaatgccccgtcaggctgaccgcttccccatcgacaatcagcgtatccgcctgattgacgggaatcagcggcatctcggccggaagcgaccgcctcgaccgtgcagaacgcctaaatcgcgcaaatgaagtgggtttaggtttataaaagataatatattgattgattcccttcatctgcacactatcggcaaccaaaccgacaaatttatcattcttcccatctttcttgtaattacttattttgtctgcatcacttaatttttcaaattctgattttagctgtacttcttcatccaagaaattattgccactacaagaatcgcctttacagtgggtcaacgttatattttgcgacggcccgtcaatcaaaacgccattagccaaatcaacccttccaaaattgctaccgccattcgcaggtgcagggtttgacgcggggatgggatctgaagaaccggcggcttgattgtttccggcttgatttgcaccttgggcagccgtattgccggcattttgcccgcctgccgacggatcgtccccctgcattccgtccgccgcatttgccatatccggttggtttgccggctgagacgattccccggcatccgttgcttgattttccatatttccggcaagcatattcggatccggggtgtgattcggtgtcgaactatctgtaccggcggcattttgcggcatatcattttgtgccacctcgtcttcatttttgggattatccgctgttaccgcaccgccattgcctgtattttcttccgaaaccgccgccatatcttgactgccttgtgcggatggcgcgccctgtccttgagaacctgcctgtggcgcatcttcctttgcctctgtctctttttcagaaacaacaggggcggcaggttttgacagcgtgtccgccgacttgacatcgggcgatccgccaccgccgcccccgcaggctgaaagggcaaaaatacaagccattgcgattacgctgcgtttaaacatcatcatctccttcatcgtatttcctttttggtttaaaccccgccacttggacatccgtccttcggggcggtggaatcagctttatttgggaagagcgcaacctttccaaatcagggcgacacatagggctgtgctttatgtgccgccctgtgtgttgaaacatattcaataaatattgtttccgccgtatgcctataaaattgtaaaaatatgccgtctgaacgccaaacgggcttcagacggcatagcttggtttattccgcccggttcctctgtcggcccaaatcggcggcagcggtaaacaaaacgtcggtcgaagagttcagcgcagtttccgccgaatcctgaatcacgccgataatgaagccgacggcaaccacctgcatggccacatcgttatcgataccgaacaggctgcacgccaaaggaatcagcagcaacgagccaccggccacaccggatgcaccgcacgcgctaacggtagccaccaggctcagcagcagggcagtggcgaagtcaaccgtaatgccttgcgtgtgcgccgcagccatcgccaaaacggtaatggtgattgccgcaccggccatattgatggttgcacccaatggaatggagatggagtaagtgtcttcgtgcaaacccagctttttcgccaatgccatgttcacagggatattggcggcggaagaacgggtaaagaaggcataaacgccactttcacgcaggcaggtaaacaccagcgggaaagggttgcggcggattttccaccacacgatggcgggattgaccgccagcgcgataaacgccatacagcccaacagcactgcaagcagcttcgcgtaccccgccagcgcgccgaaacccgtctccgcgattgtggacgacaccagcccgaaaatgcccaaaggggcaaaacggataatccatttcacgacggtggaaaccgcttccgccaaatcggcaacgacctgccgcgtaacgtccgaaccgtgattccgcaacgccgcgcccaaaaccaaagcccaagccaaaatgccgatatagttggcattggcaatcgcgttaatcgggttggcgaccaggttcatcagcagcgatttcaatacttccacaatgccggaaggcggcgcggcggacacatcgcccgcgcccgccaaaacaatgtgcgtcgggaaaaccataccggcgatgacggcggtcagggctgcggaaaacgtaccgatgaggtaaaggacgataatcggcctgatatgcgccttgttgcctttttggtgctgcgcgattgtggccgccaccaaaataaataccaaaaccggcgcgaccgctttgagcgcaccgacaaacaggctgccgaacaagcctgccgccaagcccagttgcggggaaaccgaaccgattacgatgcccaacgccaaaccggcggcaatctgcctgaccaggctgacgcggccgatcgcatgaaataaggatttgccgaacgccataattcttccttatgttgtgatatgttaaaaaatgttgtattttaaaagaaaactcattctctgtgtttttttttattttccggctgtattttatagtggattaacaaaaatcaggacaaggcgacgaagccgcagacagtacaaacagtacggaaccgattcacttggtgcttcagcaccttagagaatcgttctctttgagctaaggcgaggcaacgccgtactggtttttgttaatccactataaggttgcgttgatttgccctatgcagtagtgccggacaggctttgctttatcattcggcgcgacggtttaatttattgaacgaaaataaatttatttaatcctgcctattttccgacactattccgaaacgcagcctgttttccatatgcggattagaaacaaaataccttaaaacaagcagatacatttccggcgggccgcaacctccgaaataccggcggcagtatgccgtctgaagcgtcccgccccgtccgaacagtgttaaaatcgaaagccgccacaccgatgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaaaccgatatggccacttcagacggcattgcagcaaaccattttgaaacagacattatgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataagcggttttcagacggcgcgccgccaaaccggacatttgaaaacctgcttttccaccgtccgccgccgccgtccgcctgcaagggaacagaatcgatatagtgaattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcgaaagcgggaatctaggacgcagggttaagaaaacctacatcccgtcattcccgcgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcaaaagcgggaatctagaatctcggactttcagataatctttgaatattgctgttgttctaaggtctagattcccgcctgcgcgggaatgacgattcataagtttcccgaaattccaacataaccgaaacctgacagtaaccgtagcaactgaaccgtcattcccacgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggacaaggcggcgaagccgcagacagtacaaatagtacggaaccgattcactcggtgcttcagcaccttagagaatcgttctctttgagctaaggcgaggcaacgccgtactggtttttgttaatcctctataatgcgcccttcggcgtggcggatatataaggaagtgattttccatctaagtaaaaaccgccctatcggataagcccttaacagaaaaggctttacccgcgccgtatcggaacacatcctctaaaatacaatccgttgaattgaaaaaaatataaaaacatccgcccgcgaaaaacggcagcgcgtcgtttgacaaagaatgaaaatatcggttaaaaaccgattttcatacaaaaaacaccgctgccgtccgcatccgtttcagacggtattgagagaaaatcttttaggagaacctttatgtcccggcatcccgcccccaccggagaaaaaacattcttcggccaccccttccagctttccaccctcttccatatcgaattgtgggaacgtttttcattttacggaatgcagggcatcctgctgatttacctctactacaccgccgacaaaggcggcttgggcatagacaaaaccctcgccggcggcattgtcggcgcatacagcggcagcgtgtacctgtccaccattttgggggcgtggtttgccgaccgagtatggggtgcggaaaaaaccctcttcctctcgggcatcgtcgtgatgctcggacacatcgtccttgccgccgccccgggcctgtacggccttttaatcgggctgatattcatcgcattgggcagcggcggcgtgaaatctacggccagttctatggtgggcgcattatacgaacaggacgaaatgcgcccgctgcgcgatgcgggattttccattttctacatcgccatcaacatcggcggcttcctaggcccgctgctgaccggcctactgcaggaaaacatcggtttccattatggtttcggcgcggcggcggtcggtatggcattcggcttgtggcgttattccctgggacgtaaaaacctgccccaccccaccgtcccccatccgctttcaaaaggacagggcaaaactgcggccgccgtcggcatcgccctcatcgccgcacttgcaaccgccatcaaaaccgggcttgtcaacctcgacaatttctccggcatcctattatctaccgtcatccttgccgtcatcgcctatttcgcccgcctgctgaccaacccccgcgtcagttccgacaacaaacggcacatcatcgcctacatcccgcttttcctgaccatctgtatgttttgggccgtctggtttcagatttacaccgtggcaaccgtctatttcgacgaaaccgtcaaccgcaccatcggttcgtttaccgtgcccgtcgcttggaaagattctatgcaaagcctgtgggtcatcctgttttccggactgatggcggcaatgtggacaaaaatggggcgcaaacagcccaaaaccccgctgaaattcgctatggcggtatttgttaccggcgcgtcgtttttgggattcgtcccctttatttcctccggtacgccgatgcctattgcggttttcgcactgatcgtcctcgccatcacgataggcgaactgatgatttccccgattgcgctgtccatctccaccaaaatcgcaccgcctttattcaaaacccaaatggtcgcccttaatttccttgccttttcattaggcttcactttgggcggcgtattgtttgaaaaaggctatcaggcgggcgacgaaatcggcttctatcggctgctgttctacatcggcgcagccacaggcttcctgctgctcctgctcgtccccaaattgaacaaaatgctcgaaggcacagactaagtcccgccccgatgccgtctgaacccttcagacggcatttttccgcataatgaaaccaaaccgtttccacccgacaggacaggctcccgcccaaccggaaggcagcctgccgattgtcatttgaataacgcaagggaaagccgttgatttccgtttgtatggaaacagtttggtttcattggaaaaaggcattttgtccgactaaattagtgctgcatcaacgaaatatatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgttaatccactataaaaacacaacctaaataaaaatgccgtctgaaccatatttcaggtttcagacgacatttgcgtgtcggatgcacaccggacaggcggtaagccgggttctgtctcggacagtcattcctctaggcataccgttaccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacacaaaaatgccgtctgaaacggtacaggtttcagacggcatacagcctaaactacacgccctgtttcaggctggcttcgatgaagccgtccaagtcgccatccaatacggctttggtgttgccgacttcgtagcctgtacgcaagtctttgatacgtgaggaatccaaaacatacgaacggatttggctgccccaacctacatcggatttaccttcttccaacgcctgtttctcttcattgcgtttgcgcatttccaattcatacagtttggacttcaacatttccatcgcagcggctttgttggcgtgttgcgaacggtcgttttgacattgcaccacaatccccgtcggctcgtgggtaatgcgcacggcggagtcggttttattgatgtgctgaccgcccgcacccgatgcgcgataggtgtcgatgcgcaaatcggcggggttgatttcgatttcgatggaatcgtcgatttcagggtaaacgaacacggaggcaaacgaggtatggcgtttgttgttcgagtcaaacggcgagtaacgcaccaagcggtgaacgccggtttcggtacgcagcaaaccataagcgtattcgccttccacacggatggtggcgcggttgatgcctgcgatttcgccgtcgtcttcttcaaggatttcgattctgaagcctttgcgctcggcgtagcggctgtacatacggaacagcatacccgcccagtcttccgcttccgtaccgcccgcgcctgcggtgatgtcgataaagcagttgttcgggtcggcgggctggttgaacatccgtttgaactccaaatccgccatctgtttttccagccccgctacgtcttcctgcacggcggcaaaaccttcttcgtcgttttcttcgacggtcatttcaatcagcatgcggttgtcttcgatgcccgaagcgatgttgtcgagcgtcaacacgatgccttcgaggattttgcgctctttgccgatttcttgggcgcgtttcgggtcgttccaaagttcggggtcttcggaaagaccgataacttcttccaatcggtctttcttaccctgataatccatataaactcggatgtcttcgctgcgcttttccaaatcgttcagggtattgttgagctggttgattacttcggcttccatgattcttttgttctttcaaaattttaggggcgtattgtacgggattcgggtatttttttctatggataaagccttctggaaacacgttcagacggcatagcgtcaataacggtatgccgccagtttgcgtttgatttcaggcaatgcggcacgtgctgcctcctcacccaaccggatggcgcgttttttctgatcgaatccgccgactgcacccaaatccaaaacctgcggtttgataaccacatccgcctgccccaactcattttgcaacgcagaaacgctcattacgttcagcgtctgatcgagataagagaagaaaccttggctgatgtttttgcccggacgggcggaaatatcgacggcaatcacgaaattcgccccctgccgccgggcggcactgacgggcacgggctgcgacagaccgccgtcaacatatgtatgcctgccgatgataacgggttggaacacattgggaatggcggcggaagcgcgcacagcctgcccggcattcccctgattgaaagcgacggccttgccggtttcaaaatcagtagcaacggcggcaaatttgatgggaaactgctgaatctgcctgccgccgacttttcggttgatgtaattttgcagcttttcgcctttgataaaaccactggtggacaaggttaaatcgaccaaatcggttttgcctaaaatttcggcttccaattcgaggcggtcgggcgacatacccgatgcaaaaaggctgccgacaatcgaacctgccgatgtgccggtaaccaccttcacaggaataccgttttctttcaaaaccttaataatacctacatgggcaaatcctttagatgcgccgccaccgagtgccaaaccgaccactgcggcgggtttggcggtttgcaccggcttgcggacagcattatttcccgccgtgccgcaggcggcaagcaacgcggcggcggcgattgccaaaagcggtctgatttttgaaaacgttaccatattttccattcctttatatatcgcaccccgtcaaaaagagggattgcttttcttaacacccccctttgacagccaagcaaatgggggctttgttaagtcatcatcaaaattaatatttcttttttttttcctttacggaaattatatttgaaggcatactatccaaggcgggaattatctcacaacaccgccgttatccaaatatcccgcctttttccctttctttccatcaaaatactttctttttatattcattaacttgttaaatcattggctgccgggtgtcagtttttccgacaaaatccgtctaatggggtatcaacagaaccaaaacaggaacacttatgaaaatcggaacaacttggcagacggcatccgctatgctggttttgcgtctgtttgccgcatatgaatttttggaatcgggtttgcaaaaatggaacggggagaattggttttccgaaatcaacgatcagtttccattcccgttcaacttgctgccggacgcgttaaactggaatctcgccatgtatgcggagcttttgctgcccgtattgttgcttttgggtttggcaacgcgtctgtcggcattggggctgatggtcgttaccgccgtcgcttgggctgcggttcacgccggttcgggttacaatgtctgcgacaacggttataaaatggctttaatttatatcgtggtattaatcccgctgcttttccagggtgcgggcggatggtcgctggatacgctgctgaaaaaacggttttgcccccgatgccgtctgaaacaagattgattcagtcgtggaatctgactttaaacattccaaccttatctcgttaacttgatattttgaaaaggaaatgacatgaacaaaaacattgctgccgctctcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataatcccaccccttcaaaccaagccgcgtttttcagtaaaatgcggcttttttaacggcaaacaaagattttttaacaagcacatcattcttttgtgccatccgaaccgggtaaaaatatgattcaacacgcaggcttgggctaccgccgcgacttggcggaagactttctctcgctttccgaaaacagcccgatatgctttatcgaagccgcaccggaaaactggctgaaaatgggcggctgggcgcgcaaacagtttgaccgtgtggcggaacggctgccgctggcgttgcacggattgtctatgtcgctgggcgggcaagcaccgctggatactgatttgatagacggcatcaaagaaatgatgcgccgttacgattgcacgtttttctccgaccatttgagctactgccacgacggcggtcatctttacgatttgttgccgctgccctttaccgaggaaatggtgcatcatacggcgcggcgtatccgcgaagtgcaagaccgtttgggctgccgcatcgccgtggaaaacacgtcctactatctgcattccccgcttgccgagatgaacgaggtcgagttcctcaacgccgtcgcacgtgaggccgattgcggcattcatctggatgtgaacaatatctacgtcaacgccgtcaatcacggtctgctgtcgccggaggcttttttggaaaatgtggatgcagagcgcgtgtgctatatccatattgccggacatgacgtggaaacgccggaattgttgattgatacacatggcgcggcagttttgccgactgtttgggacttgctcgaacttgcctatgccaagctgccgacgattccgcccaccctgttggaacgcgattttaatttcccgcctttttccgaactcgaagccgaagtcgccaaaatcgccgattatcaaacgcgtgccggaaaggaatgccgccgtgcagcctgaaacctccgcccaataccagcaccgtttcgcccaagccatacgcgggggcgaagccgcagacggtctgccgcaagaccgactgaacgtctatatccgcctgatacgcaacaatatctacagctttatcgaccgttgttataccgaaacgctgcaatactttgaccgcgaagaatggggccgtctgaaagaaggtttcgtccgcgacgcgtgcgcccaaacgccctattttcaagaaatccccggcgagttcctccaatattgccaaagcctgccgcttttagacggcattttggcactgatggattttgaatatacccaattgctggcagaagttgctcaaattccggatattcccgacattcattattcaaatgacagcaaatacacaccttcccctgcggcctttatccggcaatatcgatatgatgttaccgatgatttgcatgaagcggaaacagccttgttaatatggcgaaacgccgaagatgatgtgatgtaccaaacattggacggcttcgatatgatgctgctagaaataatggggttctccgcgctttcgtttgacaccctcgcccaaacccttgtcgaatttatgcctgaggacgataattggaaaaatattttgcttgggaaatggtcaggctggactgaacaaaggattatcatcccctccttgtccgccatatccgaaaatatggaagacaattccccgggccaaaaccatctatccgcataaaattaccttgttcccgatactatgccgctacccgacctgaccgatgccgaattaatagagtcgcgtaaactgcttctgcattttgcgcggcttcagttgcccgaccaccctgatttggctgaagatttagtgcaggaaacattgctgtccgcatacagcgcaggcgacagttttcaaggcagggcacttgtcaacagctggctttttgccatattgaaaaacaaaattattgacgcattacgtcaaatcggaaggcagaggaaagtctttaccacactggatgacgagctactggatgaagcatttgaaagccatttttcccaaaacgggcattggacgcaggaagggcagccgcaacattggaacactccggaaaaatcattaaacaacaacgaattccaaaaaattctgcaaagctgcctatacaacctgcctgaaaacaccgcacgggtatttaccctgaaggaaatactcggtttttcatccgacgaaatacaacaaatgtgcggtatcagcacgtccaactaccacaccattatgcaccgcgcccgagaatcattgcgccaatgcctgcaaatcaaatggttcaaccaagaaaacccgaagtaaacgttatgaaaaaatgccgcgatatcgccctgcttctttccaaacatcaggaccgggaaaccaccccgggcgagaagatttccatatacacacacctgctgttctgtccgtattgccgtgaatataaaagacaacttcaaaccatcaaaagatcactggcaaaaacaaccagaacttcaaaataaatgccgtctgaaaaggcttcagacggcataagctgacggaaacaaatcaaaccgatttactgttatctgcagttcatccataatacacacttcaaaagcagcatatttccccatacggaatgtataaatacgcaaaatacgaaggctgcatcaatttgccatatttgctttatttgccttatttcacagacggcgctacccctcccgcccaacccgttctttctgaatgagcagatttcaatgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctgattgcaacttatacacaaacttacccacaaaccttatcataaaaatgccgtctgaaatactgaaatatcagcatttcagacggcattttgccattccctgaaaattatccacaaagttatccacattattttttaaaaccggcttccatccgaaatatagtggattaacaaaaatcaggacaaggcgacgaagccgcagacagtacaaatagtacggcaaggcgaggcaacgccgtactggtttaaatttaatccactatataaactcgctatacaatttcactatccaaacgtaaattgttccattgatacacaaaactgcttacccccataattttgataaagcatttcttacattcccggctccgtcccgtaaccaacacagcggcggattcgcatttgaagtgcaactttccctaacagaaaaaggccagtatgcggtagcatacgacctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagagcctctaaaaaataatcgcttgttttgacaccgatacactcatatagtggattaacaaaaatcaggacaaggcgacgaagccgcagacagtacaaatagtacggcaaggcgaggcaacgccgtactggtttaaatttaatccactatacaaatacagaaactcaagaaaataaccttgtgtattgaccatctcaagcaattcagaaaaatcaagaaattttctgaccgtaaacaaacgtttccctaaaaaaacgatgtcttcaaaaatatcgaacaaatagagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaaataatcatcttcggcgttttcatttttatggattaaaacaacacgggaaaaatctgttttcagatgcttgcccgcttgattgttcggattattgtccggaacgacaaaaccgtcctcaaaattaaagcagacgttgcgtccttctacctttatctctgtgcaataacaatcatgtagagaaatgctatccgaaaaattttttctttgtgtatgcaaaaaaagttttcattcaagtacccatatctaacgcaaacgtttacctgtttccccgtcaataatctgactcggcgatttctgcctgccgattctcccaccaacaatccacacatcgcgtccgaattgccttctgacttccctctccgtccgacacgcgcgtttgcctgcgcggttgcacgaagtcgagaccaaaggcgtttgcaaagcctgacacaagcggcgcgcacctacatgggcgggaaccctgaccgccaacttgctgcgctgtttcccgcgtaactcgggtaagacacaggatttggcggataataggaacgttttaggggcgggccattcttttctaagcatatcctgaagattttcagacggcatttgaagtaaaggctgcaattgttcaaattgattcccgatgacaatcatacccttgtgttgcggtctttttttcaaatgcgccaacttaccgagtgctttggctaatgtcggaagacaccccaagccataacaagattcggtcggataagcgaccaaaccaccttttttcaaataaacgcttaacttacgttgcgctgatgctgcgataattctcggaaataacataatataaaataccgtctgaagcacattagtcatacttggcttcagacggcatcatcctctttctaattaacggttaatcgctttatcggcaatgtctttacggtattgcatcccgtcgaaactgattttttccaacgcgccatatgccttagctttcgcttgcgccacattatcgcccaatcccacaacacacaatacgcgtccgccgttggtcaatacgtcacctttctcgtttgccgttgtacctgcatggaaaactttgccgatttggttggcagcatccagaccggaaataatatcgccttttttgggcgtttcggggtaattttgcgccgccagtaccacgcccacggcagtttgcgggctccattccgcggttacgctatcgagtttgccgtctattgccgcttcaaccaaatccgataagtcgctgttcagtcggctcataatcggctgggtttcaggatcgccgaaacggcagttaaactcaatcgtatagggtgcaccgctttgatcaatcatcaaacctgcgtacaggaaaccggtgaactcatgcccctccgctttcatccctgctacggtcggcaaaataatttcattcatcgcgcgttcgtacacaacaggcgttaccacaggcgcagggctgtacgcacccataccgcccgtattcagacctttgtcgccgtctaaaagacgcttgtggtcttggctggttgccataggcagtacattattgccatcaaccatgacgataaaactcgcttcttcgccttgcaggaaatcttcaattacaacacgcgcgccggcattgcccattttgttgtccagcagcatatcatcaatcgcagcatgcgcttcatccaaagtcatcgccacaatcacgcctttacctgccgccaaaccatcggctttgataacgataggcgcacctttctgattgacgtaatcatgtgcggcatcggcgttttcaaaggtttgatattgcgcggtcggaatattgtatttcgccataaatgctttggcgaaatctttggaactttccaactgcgccgcatattgtgtcggaccgaatatttttagtcctgcagcacggaaatcatccacaatacctgccgccaaaggcgcttcagggccgacgacggtaaaaacaatattttctttacgacagaattcaatcaaatcctgatgcgcagtcaagtcgatgttttgcaacttgggttcaatcgctgtaccggcattaccaggcgcaacaaatactgtttccactttaggcgactgcgccaatttccaagccagcgcgtgttcgcgaccgccattaccgataaccagcagtttcataccatctccttgacaaatatgtacttttaacgaaaactcgatacaaagggacttttatcccatctgaagaaattttagtagaatcaaacaaaagaccgcttcattccactctgcaacctattcaacttatccataaattaaaaaaggacaagcaaccatgcaaaaacgtattgatgaaatccaaagcaaataccgcgaatggtgtcatttactaccgcaactggaagaagacatccgccgttggaaacatgtcgtcactttaattcgcgacatggacaatttctatacccacgagtatcaggcgtgtcatcaggctattgaagacggggtagaactggatttgagtacggaaggcgaatacagcattatgagtgaagatgcgctatggaacgcgctgggcgaattccatcaattggcttggttatatttgcgctccagcgtcgatgccttagacaaatatacacaagaagattagtcagcgaagaggtcgtctgaaataccatcacaaagcatttcagacgacctttcattcaaaaggcttttccgtatttacttcaatctgccgagtattcttccaagccgcaacacaggcctcataatttaccaacgacaaactgaccgtcaatcggcaatccaactgcaaatcccgctccaatatatccgcctgatattgtttggcaatgcgtatcgcttcattcaaaaacggatattcacatttcagccaaacagttttttcaatattcttttcaactacttctgcaactgccaacgcttgagccgtcgcctctttgtacgcatgtatcagacctggaacacctaacaaagtaccaccgaaatagcggacgaccacaaccaaaacgtcggtaatacccaccgaatcaatctgtcccaaaattggtcgtccagcacttcctgatggctctccatcatcgttggcacgaaattgcacaccatccacacccaaacgataggcatagcaccagtgtcgtgctttatgatgctcttcctttaacggatcgaggtattttttcacatcagccaatgtccgaatcggataggcaaatgcaataaaacggctgcctttatctttaaactcagcctgcgtcaaggaagtaatggttttataagtcgtaatcatgctgaaatgttttcagacgacctcattaataacaaggtcgtctgaaagtttcacgtgaaacatcaatttttcaatacttctgttaattgtggaacgatttcaaataaatcgccaaccaatccgtaatcggctacattgaaaatcggcgcatcagcatctttattgattgcaacaatcaccttactgtcttgcataccggcaacgtgttgaattgcacctgaaataccgattgcaaaatagagttgcggcgcaaccactttaccggtttgtccgacttgagcatcgtttggcgcatattcggcatcaactgctgcacgggatgcaccgattgccgcacctaaaacatccgccaacggtgtcagcacttcattgaatttttccgcactacccaacgcacgaccaccggaaacaatcacttttgcctgagtcagttcaggacgatcggaatgggaaagctgacggttaacaaaacgactcaggttttgggcaggggttgcttcaacattaattacctcagcattaccaccttgcgccgccactgcgtcaaaaaccgtcgcacggaaggtcagcaccaatttttctgaatcagcttgcacggtttcaaatgcattacccgcataaatggggcgcacaaaagtcgtgttatccacaatttcggtcaaatcagaaatttgcggtacgtctaataaggctgctacgcggggcaaaaggtttttaccgaatgtggttgccgttgctgcaacatagcggtaatcggccgccaatttaacaaccagcggagccaactcttcagccaaaccttcggcataatgagcagcatctgcaaccaaaacttttttcacccccgctacttgcttcgcgaattccactacagcagatgcgccgtttccggcaaccaataaatcgactttgcccagtttggcggcagcggtaacagcatgcaaagtggtaggattcaactgtttgttgtcgtgttcgacaataatcaatacactcatttcagcctcctcaaatcactttggcttcgtttttcaatttttcaaccaattcggcaacgcttgctacttttacgcctgcctgacgcgccttaggttcggcaaatttcaccgttttcaaacgaggtgaaatgtcggcaaccaaatcgtcaggagtcagtttttccaaaggttttttctttgccgccataatattggggagtttgacaaagcgcggctcgttcaaacgcaaatccgcgctgataacagcaggcagtttcaatgcgatggtttcttcgccgccatcgatttcccgcacaatctgcacttcgtcgccttcaatttgtactttggacgcgaacgtaccttgcgccgcattcagcaaagctgccagcatttgcgccacttgattggcatcatcatcaatcgcttgtttgcccaaaaagaaaatttgcggattttctttgtccgcaacggctttcagcaacttagcaacggccagagactccagtttagtatcggtttcaacatgaatggcacggtcggcacccatcgccaaagctgtacgcaaggtttcttcgcattttttctcacccaaagaaaccgctacgatttcgcttacttttccggcttctttcaaacggacagcttcttccacagcgatttcgtcaaacggattcatcgacattttgacattgccgatatccacatccgaaccatcggcttttacacgaactttgacgttgtagtccactacgcgctttactgcgaccagtgctttcattgaaccctcctaaaaagaacgctgctttcaccatccagcgaaaccaaaccttcttccctataaaaccaaatccgttttccttaaaaacgaattcattcaaaaatctttcggataatgcttgccgattataccatttttaaagcatttactcagactagcggatatacattcctgtatctaataaattggaaaatatcatgccgccatatcagttttagacgaccctttagcctttatctgctgcaacacaatccatcagcgcttgataaaccaaatctgcggtcggaatctgcccgatattgcccaaattttttgcaattggcgaaacctgaacgcctgttttaatcggatcggtatcggtataaatgccgaccacaggtttttccaaggcatttgccaaatgcagcaaaccggtatccacgccgacaattccgaccgcgtatttcagcagatacgctgcctgcaataaatttattttgtcgcacacaatagcaaacggcagcccatctgcaatttgtttggcacgcgttttttcatcttcatttccccaaggcaggtaaatattgcattgctgttcttcattcaacttttgcagcaacgaccgccagttttccacaggccataacttactgtcccgactggtcgcatgcaaagccgcataatacggctgcgctaaatttttcagacggcctgcttcaggaacagtcaagccaaatacctgcgtttccggcattacatacccaaatacttgggcaaacagttcacggttgcgccaaacggcattttttcccttcggtacagcgtatgtttttacatacgccaaagcagcccatccctcgcgcgcactgtttttatccaaaccacaaatcggggattttgccattttagcgaaacacgcgcttttaatcagaccttgactgtccaatacgaaatcaaatacttcctgccgcaaagtctgtttcagatgacccatttcccgccaagtttcagcccgaaagagatgtttgcgccattgccgccatttcatcacatggattttttttacaaacggatgcaggcgcgcaatatctgcaaatccagcctcacatagccaatgcagttctacatcaggacattgtcgcgccaaatcttcgattgcgggcaaagtgtgaattaaatcgcccatactagacaagcggacaagcaaaattttcatatttaggaagggggtttcacgtgaaacaattttaacttattgattattaatatatttatttatttcatcagcgttttttaagatgattgccccagcagaatgcatttcctgccatgctgtttcgatggtttccggcgcaataccccgacaagccgcttcattgacgacaacctgccaacgaccgcctttgagtaactgcaaaaccgttgttttaacacaataatccgtagctaacccaccgataataaccgtatccgtattttgacaacgcagccattcaatcagccctgtgcttagtttttcctcaatatcgtgaaaacacgcgccgtaaggatgcaattcaggatcaacacctttccaaacgcaataatcgtattctttagcagaaggcagcccgtccaataattcatagccgcgcgtaccgaccatcgcatgagccacccaagtcaaatccgcatcaggcaaacctgtcggcttcaacatatcaacagggttatccacaagccatttcgctaccatatgatgcgcatctttcgtcatcacgcgcaaatccgccaaagcggcttgcgcattcaactcctcgacaatcaaatgcccctcgttcacgggcagttcgtcaggacacagtggcgtaaacgttttttgtgcatcaacatcaatggaaacaatcatctcattatttcaacgcgattaaaatgccctgtattataacaaattactgcccaaaagcggtaaaaccgattgtgataagataaggtttttccaaaaaacttatccacaaccttatgacttataccattacccccatcggcaccgcccgctcgccctacaaacagaaattcggcatcgcccgccagcccggtttggtctccgccgcaaaagcctgcatcgagctgaatcccaaattcaccgcagacagcgtgcgcgggctggaagatttcgattatgtgtggataagttttatttttcacggcgtattggatgaaggctgggcgcaaatggtgcgcccgccacggctcggcggcaaacaaaaaatgggcgtgttcgccacgcgcagcccccaccgccccaaccatctcggactctcgctcctgaaactcgaacgcatcgaaaccggcaaacccgtccgcctctattgcagcggcgcagacctgctggacggcacaccgattgtggacatcaaaccttatatcccctttgtcgaatccaaacccgatgccgcatccggtttcgtcagcggcaaacccgtagagttggaagtcgtttggcaggaaaacatcggcgcggaaaatttatctgcaaacaccaaaaaccttatcagccaaagcattgcccaagatccgcgccccgcctatcagaatattcccgaacggatttatgtgatgaatattgcagattacgaagtcagatttcaaatcgaggaaaaccgtgcaaccgttattgatctttccccaaccccgctttaaatcgggcaaaaatccggttttgccgcatagcagttgaacaaacggctgttgtttgttcgccataagccgcaatatcaagttatagcggattaaatttaaatcaggacaaggcaacgaagccgcagacagtacaaatagtacggcaaggcgagataacgccgtactggtttaaatttaatccactatacagataaacaatgccgtctgaacgcaatgtgttcagacggcatttacttatccacaggtttgttcaagccttagattttgcctgcgaagtattccaaagtgcggacgagttggcaggtgtaggacatttcgttgtcgtaccaggcaacggttttcaccaattgtttgccgcccacggtcatcacgcgggtttgggtcgcatcgaagagcgagccgtattcgatgccgacaacgtcggaagaaacgatttgatcttcgttgtagccgtaagattcgctggcggcggctttcatcgcggcgttgatttcttctttggttacagggcgttcgaggatggaaaccaattcggtcagcgagccgctggcaacagggacgcgttgggcggagccgtcgagtttgccgttcaattcggggataaccagaccgatggccttggcggcaccggtgctgttgggcacgatgttgagcgcggcggctcgggcgcggcgcaaatcgcctttgcggtgcggcgcgtcaagggtgttttggtcgccggtgtaggcgtggatggtggtcatcagaccttcgactacgccgaactctttttgcaggactgccgccatcggggcaaggcagttggtggtgcaggaagcggcggagataacggtttcgctgccgtccaaaatgtcttggtttacgccatatacgacggttttcacatcattgccgccgggtgcggaaatcacgactttgcgcgcgccggccctgatgtgtgcttcggctttggttttattggtaaagaagccggtacattcgaggatgacatccacacccaactcgccccaaggcaattcttcgggattcggattggcaaaaactttgatctctttgccgtttaccacgatggcatcgtcttttaattcggcagtaccttggaaacggccttgtgtgctgtcgtatttgaaaaggtgcagcagcatttcggcaggggtcaggtcgttgacggcgacgacttcgatgtcgtgggctttttcaatttgacgcaatgcgaggcggccgatgcggccgaaaccgttaatcgctactttaatgctcatgtatatactccaagctgtgaaacgaaatttcaatacctgtattgtattctgaaataaagttacattccactattacatctaactacttgccgcttatttgatatagatgaattttactgtttgcacagatttccaaaacttttaccatcaatatttgaatttaaaattttaatgatgattttgatgattgccaacctgcttgtgcgtaagtagcaaatatccaatattttcattacctttttgtcaaataagtttgagtttaagacttgctgtataagacagataagcgtggatgttttttgacttaataatatttctgtggataactttgctgttttcctagttgtctccacaaccttattgacaggcttacggtcagtctcattccgtcgaagacaaaaccttttgctacaataccgttttcctaatgataaggcagccccatgtccaaatccgccgtttccccaatgatgcagcaatacctcggcatcaaagcgcaacataccgacaaactggtgttttaccgtatgggcgatttttacgagatgtttttcgacgatgcggtagaagcggcaaaacttttggatattaccctgaccacgcgcggacaggtggatggcgagccggtcaaaatggcaggcgtgccgtttcacgccgccgaacaatatctggcgcgcctggtcaagttgggcaaaagcgtggcgatttgcgaacaggtcggcgaagtcggcgcgggcaaagggcctgtggagcgcaaagtcgtgcgcatcgtaacgcccggcacgctgaccgattccgcattgctggaagacaaggaaaccaaccgcatcgttgccgtgtcccccgacaaaaaatacatcggtttggcgtgggcatcgctgcaaagcggcgaattcaaaaccaagctgacaactgtggataaattggacgacgaactggcgcgcctgcaggcggcggaaattctgttgcctgacagtaaaaacgcaccgcaacttcagacggcatcgggtgttacgcgcctgaacgcgtggcagtttgccgccgacgcgggggaaaaactgctgacggaatatttcggctgccaggatttgcgcggcttcggtttggacggcaaagaacacgccgttgcgattggcgcggcaggtgcactgttgaactatatccgtctgacgcaaaacctgatgccgcaacatttggacggcctgtcgctcgaaaccgacagccaatatatcggtatggatgccgccacgcgccgcaatctcgaaatcacgcaaaccctctccggcaaaaaatcgccgaccctgatgtccacgctcgacctttgcgctacccatatgggcagccgcctcttggctctctggctgcaccaccctttacgcaaccgcgcccacatccgagcgcgccaagaagccgttgccgcgctggaaagccaatacaaacccctccagtgccgtctgaaaagcattgccgacatcgaacgcatcgccgcccgtattgccgtgggtaacgcccgcccgcgcgacctcgccgccctgcgcgacagcctgtttgccctgtccgaaatcgaattgtccgccgagtgcagcagtctcttaggaaccctcaaagccgttttcccggaaaacctatccacagccgaacagctccgccaagccattttgcccgaaccttccgtctggctgaaagacggcaatgtcatcaaccacggttttcatcccgaactggacgaattgcgccgcattcaaaaccatggcgacgaatttttgctggatttggaagccaaggaacgcgaacgtaccggtttgtccacacttaaagtcgagttcaaccgcgttcacggcttttacattgaattgtccaaaacccaagccgaacaagcacctgccgactaccaacgccggcaaacccttaaaaacgccgaacgcttcatcacgccggaactgaaagcctttgaagacaaagtgctgactgctcaagagcaagccctcgccttagaaaaacaactctttgacggcgtattgaaaaaccttcagacggcattgccgcagcttcaaaaagccgccaaagccgccgccgcgctggacgtgttgtccacattttcagccttggcaaaagagcggaacttcgtccgccccgagtttgccgactatccggttatccacatcgaaaacggccgccatcccgttgtcgaacagcaggtacgccacttcaccgccaaccacaccgaccttgaccacaaacaccgcctcatgctgctcaccggccccaatatgggcggcaaatccacctacatgcgccaagtcgcgctgattgttttattggcacacaccggctgttttgtgcctgccgatgccgccacaatcgggcccatcgatcaaatcttcacccgcatcggcgcatcggacgacctcgcctccaaccgctccactttcatggtcgaaatgagcgaaaccgcctacatcctgcatcacgccaccgaacaaagccttgttttaatggacgaagtcggacgtggtacttccactttcgacggcctcgccctcgcgcacgccgttgccgaacacctgctgcaaaaaaacaaatccttcagcctgtttgctacccactatttcgagctgacctacctgcccgaagcccacaccgccgccgtcaatatgcacctttccgcgctcgaacagggacaggacatcgttttcctgcaccaaatccaaccgggtcccgccggtaaaagctacggcattgccgtcgccaaactcgccggcctgcctgtacgcgcattgaaatccgcccaaaagcatttgaacggactggaaaaccaagccgccgcgaaccgtccccaactggatattttcagtaccatgccgtctgaaaaaggagatgaaccgaatgtgggcaactttgtggataaagcagaggaaaaacattttgaaggtatattggcagcagccttggaaaaactcgatcccgacagcctgaccccgcgcgaagcattgtcagaactgtaccgtctgaaagatttgtgcaaatccgtatcttaatttccgttgtcggaacagcatcaaaccatatggaaaaatctgtggataaacattatctgacaggaaatttccaaacataaaaaatgccgtccgaacagctcagacggcatccgtccattcggcttaaaccttatccacatccaaacgcataaccgtaacccattcaccgttatggaaatgtcgcccgacaaccacccagccgaatgattcataaaatatttgcacatcaggcgtataaagatacaagaactttatccccagcgaacgcgctgcgcctatgcagtgggcgaccagcctcctgccaatgccttttccgcgatattcaggtaaaacaaagacatcccccaaccaatattcataccgtggaaaactttccatatcatgccgcttgaccgcagccgaacccaacaggattccggaatcatccacagccgcaaatgccagcggcagttcgtcatccttcaaacacctgccgtaataggcatgaatcttatccacagaagaccacggttcaaatccgtgccactcctcaaacaacgcctgaaccaacctgccgatatgcccggctttcagccgtgtaatgaaaacagtattgtccacaaagagggaattcatcggtcaattccccgacgccttcgttccccctgcgccgtaaaccgcattccaagcatggtccaaacgcactccgatttgcctcaaatcttcagcctgccgggctttttgcgccattgctgcaggaatttccgcttccaaacgggcgatgtctgcctgagccgtctgcaaacgccggcgcgcatcttccaaatccgactgcatcccgatgatttttccgtccagattgttttgcttttgcaataaggcgcggtaaccggattggatgctgagcagattgtcttcagcatcccctgcccatacgcttgtagaaaaaacaaccatcagaaaataaaatatttttttcatttttaacttccatttaaatgctgtctgaagccgtattccgacatcagacggcatcgcccacgcctgtggataacttaagcgcggatgcgtttcaacacttcttctttgccgattaatgccaacacagcatcgacgctgggggttttcgccgtaccgcagacggcaaggcgcaggggcatgccgagtttgcccattttaatgccttcttcgtcgcagaagggtttgaagaggtcgtggatggcttcggcattccagtcttccagcccttcgaggcgttcggcaaagcgcagcatacgggcggcggcttcatcgtcccagtgtttctgcacgtctgcttcggcaggcgtttgtttgacgtagaagtagaagcactcgtcggcaagcgtgttcaagtcttgggggcggtctttgaccagttccaacacatcttccaaagcaggtttttcggtttcatgaatatcgcgcaacgcaaggcggggtttgacgagttcggcgagtttgccgttgggtgtgattttgatgtgttcgccgttgatccagtagagttttttcaagtccatacggcttggagacggggaaacgtctttcaaatcaaaccattcgatgaattgttccattgtgaagaattcatcgtcgccgtgcgcccagcccaagcgtgccagatagttgagcatcgcttcgggcaggatgcccattgcgccgaaatcggtaatggcaacggtatcgccgctgcgtttggagatttttttgccttgttcgttaagaatcatcggcaggtggccgtattcgggcaggttcgcgtcgatggcttttaagatgttgatttgtttcggcgtgttgttcacatggtcgtcgccgcggataacgtgggtaacgcccatgtcgtagtcgtctacgacaacgcagaagttgtaggtcggcgtaccgtcggcgcgggcgataatcaggtcatcgagtgcttcgttggggatggagatttcgcctttgaccaagtctgtccatttggtcacaccgtccaaaggcgttttgaaacggacaacgggttgtacgtcggacgggatttcgggcagggttttacctacttccggacgccagcggcggtcgtaagtcgccgagccttctttttcggctttctcacgcatggcttccagctcttctttgctgcaatagcagtagtaggcatggcctttttctaaaagttcggcaatgacctctttgtagcggtcgaaacggcgagtttggtaaacgacgttgtcggcgttgtcgtaattgagaccgacccatttcatgccgtcgaggatgatgttgacggattcggcggtagaacgcgccaagtcggtgtcttcaatacgtaataggaactcgcctttatgatggcgggcaaacgcccatgaaaacaaggcggtgcgcacgccgccgatgtgcaggtagccggtggggctgggggcgaaacgggttttgacggtcatgatggctccgaaatctttgaaagcgtttattttactggttttaccgtgcttgggcatcaaaaatgccgtctgaaccctgcctgcggataaagtttcagacggcattttccttgttttcaatgcttcggcacgcggaacagtgtatcacgcgccgccgaccgaattccttcgggattgcgtccaaaaaaaagttcaatgaaacagctaattgaaaaaatcccgcccccatttttccaaacggtagagggataacgcatatccctcttgcagcataaagatttttttcttatttcccgcatcaaaccgcgtggtcggcgtggcagacatataaacgcggacacccaaatcctccgccatttccgccgcccgcgccaaatggtagggatcgctgacaatcaccacgctggcaataccgttggcacgcaaaaccggacggatgttgttcaggttttcataagtgttgcgcgaagtgttttcaaacaggatgttgcgcgccggaaccccctgtttgagtgcgtaccgccgcccgacctcggcttcggtcatatagccttttttggtccggcctcccgtaaacacgattttgcctaccctgcggctctgataaagtgcgatggcatggttgatgcgttcgcggaaaacaggagaagggcgtttgtcccacgcggcggcgcccaacaccagcgcggcatccgcccggacatacggcggcaaaacctgcccacccgtccgataaaccgcccaaacggatgaggcaaacaccagcaaaagcggaaaaacactcaaacagaaaccgcccaacaggtaatagcgcaagccgttgcggctgcaaaacagccgtttgttcacaataccgcttcgatattttccagcggtctgccgacagccgccttaccgtttgccaaaacaatcggacgctccaacagggcgggatgatcggcgatggcacgcagcagcgcgtcattgtccaaattggggttgtccaaacccaattccttatacaaatcatctttcacgcgcatcatcccgcgcgccgatgccaagcccaatttgttgaaaatatccttcaattcggacaagtcgggcggcgtatccaaatatttgaccacttcggcagcaatgccgcgttcttccaatagggacaaggcggcacgcgatttgctgcaacgcggattgtggaaaattttgatttcaggcatgacatttccttgcttctcgacaatccccttattatcggcttacacagggttttactcaatatcccgcctacaaccgtaccaaacggtttacaatacccgaatcgacatacaaaggacaaaacgatgaaatacttgaatcttgccgcaatcacccttgccgccacatttgccgcacataccgcctcggcagacgaactggccggatggaaagacaacaccccgcaaagcctgcaatcgctcaaagcccccgtacgcatcgtcaacctttgggcgacttggtgcggcccgtgccgaaaagagatgcctgccatgtccaaatggtacaaagcgcagaaaaaaggcagcgtcgatatggtcggcatcgcgctcgacacatccgacaatatcggcaacttcctcaaacaaactcctgtttcctacccgatttggcgttacaccggggcgaacagccgaaactttatgaaaacctacggaaacactgtcggcgtactgccctttaccgtcgtcgaagcaccgaaatgcggatacaggcagaccattaccggggaggtaaacgaaaaaagcctgaccgacgccgtcaaactcgcccattcaaaatgccgttaaacgccggatgccgtctgaagccgcttcagatggcatttttcttttccacccgcctgccggtgcaaacttatccactatctaaaaacaggcggaatctttataatcggcactgtcttacctattgttcagacggcatatccctgcggacgcaaccgcccgaaacgatatgccgcccttccttacaggacctcctatgatccgtttcgaacaagtttccaaaacctatcccggcggttttgaagccctgaaaaacgtcagcttccaaatcaacaaaggcgaaatgatatttatcgcgggacactccggttcgggcaaatccaccatcctcaaactgatttcgggcattaccaagccgagcaggggcaaaatcctgtttaacgggcaggacctcggcacattgtccgacaaccaaatcggctttatgcgccaacacatcggcatcgtgttccaagaccacaaaatcctctacgaccgcaacgtcctgcaaaacgtcatcctgccgcttcggattatcggctatccgccgcgcaaagccgaagagcgtgcccgcatcgccatcgaaaaagtcggcctgaaaggacgagaattggacgatcccgtaaccctctccggcggtgaacaacaacgcctgtgcatcgcccgcgccgtcgttcaccagcccggcctgctgattgccgacgaaccctccgccaacctcgaccgcgcctacgcgctcgatattatggaattgttcaaaaccttccacgaagcgggaactaccgtcatcgttgccgcacatgacgaaaccctgatggcggactacggacaccgcatcctgcgcctctcgaaaggacgactcgcatgagcatcatccactacctctcgctgcacgtcgaatccgcgcgcaccgcgctcaagcagctcctgcgccaacccttcggcacactgcttaccctcatgatgctcgccgtcgcgatgaccctgccgctgtttatgcatctgggcatccaaagcgggcaaagcgtgttgggcaaactcaacgagtcgccgcaaatcacaatctatatggaaacctccgccgcacaaagcgacagcgataccgtccgcagcctgctggcgcgcgacaaacggctcgacaacatccgcttcatcggcaaagaagacggtctggaagaattacagtccaatcttgaccaaaatctgatttccatgcttgacggcaaccccctgccggatgtctttatcgttacccccgacccggcaaccacgcccgcccaaatgcaggcaatctaccgagacattaccaaactgcctatggtcgaatccgcgtctatggataccgaatgggtgcaaacgctgtaccaaatcaacgagttcatccgcaaaattttgtggtttctttccctgacgctggggatggcgttcgtccttgtcgcacacaacaccatccgcctgcaaatcctcagccgcaaagaagaaatcgaaatcaccaaactcttgggcgcgcccgcgtcgtttatccgccgcccattcctttatcaagccatgtggcagagcatcctttccgccgccgtcagcttggggctttgcggttggctgctctctgccgtgcgcccattggtcgatgccattttcaaaccctacggacttaatatcggctggcggttcttctacgctggcgaactcgggctggtgttcggcttcgtcatcgcgttgggcgtattcggcgcgtggcttgccaccacccagcacctgctcggcttcaaagccaaaaaataaaacaccgtcaaaaatgccgtccgaacccgttttcagacggcatttcaatttgccagtataatggcgcatttttccaacaaggaacctaccatgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataatcgccacacaaaaatgccgtctgaaaccatttcgtttcagacggcattttttttatatcaaaccgcttacgcgccgcgtttttccaaagcggctacggcaggcagctctttgccttccaagaactcaaggaacgcgccgccgccggtggagatgtagccgatttgttcggtaacgccgaatttggcaatcgccgccagcgtgtcgccgccgcccgcaatcgagaacgctttgctttgggcaatggcttcggcaagggctttcgtaccgcctgcgaattggtcaaactcgaacacgccgaccggcccgttccaaacgaccgtaccggcggctttaagcaaatcggcaagcgcggcagcggatttcggaccgatgtccaaaatcatctcgtcttcggcaacgtcggcaatgtctttcaccacagcttccgcatcggcggcaatgtctttcaccacagcttccgcatcggcggcaaaggctttggcaacgacgacatcggtcggcagcggcacagaaccgccttttgccgccattttcgccataatttttttggattcttccaccaaatcgtgttccgccaaagatttgccgatggctttgccttccgccaacaggaaggtgtttgcgataccgccgccgacgatgagttggtcgactttgtccgccagcgattcgaggatggtcagcttggtggacactttgctgccggcaacgatggcaaccatcgggcgcgcgggctgtttcaaggctttgcccaaagcgtcgagttcgcccgccatcaatacgccggcgcaggcaacgggcgcggcttgggcgacggcttcggtcgaggcttgggcgcggtgggcggttccgaacgcgtcattgacgaacacgtcgcacaaagaagcgtaggctttacccagttccaaatcgtttttcttctcgcctttgttgatgcgcacgttttgcagcatgacgacatcgcccgcgttcagggcgggtttgttttcacgccagtcgttcaatactttcacgtctttgcccaacaggctgcccaagtgcgcggcaacgggggcgacatcgtcttcggggtggaactcgccttcggtcgggcggccgagatgggtcatcacgataacggacgcaccgttgtccacgcagtatttaatggacgcgagcgaggcgcggatacgggtgtcgtcgctgattttgccgtctttgaacggtacgttcatatcggcgcggatgaggacggttttgccctgcacgttttgttcggtcagttttaaaaatgccataatcagtccttttcaatcagtgtttgcgatacggaaacaattgatgccgtctgaaggcttcagacggcatcgcaacccgatcagccggatacgcgctcgattttcgcgccgacgctgccgagttttttttcaatattttcataaccgcgatccaagtggtaaatctgttcgaccacggtttcgcctcgcgccgccaaaccggcgataacgaggctggcggacgcacgcaaatccgtcgccttgacgactgcgccggaaagctgttccacaccctgcacaaatgccgtattgccctcggttgtgatgttcgcccccatccggttcaactcggggacgtgcataaagcggttttcaaaaatcgtttccaccacgcggcagcttccctccgccacggcattcaatgccataaactgcgcctgcatatccgtggggaagccggggtggacgaccgtgcggatgtccaccgccttcggacgctgccgcatatcgatggcgatccaatcgtcgcccgcctcaatcaccgcacctgcctcaaccagtttgtccaacaccacttccatcgttttcggcgcggcattccgcaaaaccaccctgccaccggttatcgccaccgcgcacaggaacgtccccgcctcgatccggtcggggacgacgctgtgttcgcagccttgcagctcgtccaccccttccacaatcattgtggacgtaccgatgccgctgattttcgcgcccattttgaccaggcattccgccaaatcgaccacttcaggctcaatggcgcagttttccaaaaccgtcgtaccttccgccagcgtcgccgccatcagcaggttttccgtgccgccgacggtaacgacatccatcgccacgcgcgtacctttgagtttgcctttggctttgacgtaaccgtgttcgataacaatctcagcacccatcgcttccaagcctttcaaatgctgatcgacggggcgcgaaccgatggcgcagccgcccggcaggctgacttgcgcctcgccgaaacgcgccagcgtcgggcccagcaccaaaatcgaagcgcgcatcgttcggaccaactcgtaaggggcgcaggtattgtttaccgtaccgccgttgatttcaaattcgctgatattgtcggtcaggacgcgcgcgcccatcccctgaagcagcttttgcgtggttttcacatctgccagcatagggacgtttttcaggcgcaacgtacccgatgtcagcaaacccgcgcacatcagcggcaatgccgcgtttttcgcgcccgagaccgttatttccccgttgagcgggccgtttgcggagattttcagtttgtccacgtttgttctttcctggtgggtacttgtatagtgaattaacaaaaatcgggacaaggcggcgaagccgcagacagtacagatagtacagaaccgattcacttggtgcttcagcaccttagagaatcgttctctttgagctaaggcgaggcaataccgtactggtttttgttaatccactataatatttcaattctcgggacaacgcataaagcatcacccgatgaaggttgcagaggcggaattataagggattttcgggaaaaatacggaagccgcaccaaagaatttgacgaaatgccgcgctttccgaacaaggattgtcggaagacaaaaaagccgagttttgaaaactcagcttttttgctttatctggtgggtcgtgagcgattcgaacgctcgaccaacggattaaaagtccgctgctctaccggctgagctaacgacccgataagtttggaattttacagaccggccgaaaccctgtcaagccccttgcgggcggacgggcgttatatccgcttatcggcctgtttttttcgtataaaccaaagaagtcaacaccgatgcacccaatgcgccgaacacgaccgacagcgaaacggaaatcgggatatgcacccaatgcattaccagcattttcacaccgataaaacccaacacgaatgccaatccatatttcaggaagataaagcgttccgccacatccgccagcaggaaatacatcgcccgcaagcccagaattgcgaaaatattggaagtcagcacgataaacggatcggtggtaacggcaaagacggcggggatgctgtccacggcaaacacgacatcgctcaattcaatcatgaccagcaccaaaaacagcggcgtggcgatttttttgccgttttcgacggtaaaaaatttctcgccgtgaaattccgtgccgaccggaacgactttcttgacggtattcagcagcctgctgtttgccaaatcctctttctcatcgccttcgggcttcatcatgtgtataccagtatagagcaggaacgcgccaaacagatacagaatccactcaaactgctgaaccagtgccgcgccgacgaaaatcatgacggtgcgcaataccaatgcgcccaatacgccgtacagcagcacgcggtgctgaaactgtggtgcgactttgaagtagccgaatatcatcaggaacacgaaaatattgtcgactgccaacgatttttccaaaatgtagccggtaaagaattccaatactttttcttttgcgactgccgcgccgtagccgggattgccggcgagttcaaaatacagccagcccgcgaacaggcaggatacggcaacccacaagccgctccatgccaaggcttctttgacgccgactttatggctgccgtttttcttcagcgaaaacatatccaaggcaatcatgaccagcactgccgcaaaaaaaacgccgtaaaacaacggcgaccygatgccgggatattctgtcatggttcaatctcctgatttgaaatgtaattgtgttaccagctgatataaaacatcgcttttgccaaaaagacaatcagcagcatatgggtaaagacgacggcgtgtatgtatttcgaccaaccgaccgtcagtgtggaacgcgccattttgacgacggcgatggcgaagtgcgccaatacgctgaacgccaacaggattttcagcgtcagcatcgtaccgaaggaagtggcaaacggttcgcccaatatagaaagatagcggtttgccgccatcacgatgccgctggcgaacagcagtccgaccacaaacggcatcaccctgacggcgcggtaagacattgccttttccacttcgcgccgcgcctcgcgcgacacccgtcccgtatgcaggacggacaaaaccagcacttcaaaaaacacgccgccgacaaaggcaatagcgcaatacagatgaacgatgtgcgcgacggcataaatactcatacgatgctccaaacggaaaactcggatacggattgtatcactatcgcccccgatatccgcataccgcttcccgcaccgcctcggcgattctcgcgcccgctccgcgatgttgtgcgataaagccgtccacgcgcgcctgcatctgcatcccccccccctcggacgataaggttttttcaacggcttcccgccacgcatccgccgattcgacttgaaccgccgcacccgatgccaaggcgtgtcggcaggcttcggaaaaattgtaggttgaaaagccgaatatcgtcggaacgccgcaggaaagcggttcgatgatgttctgacaacccgaatcgaccagactgccgccgacaaaagcgacatcggcgcacaggtaatacgcatacagctcgcccatactgtcgcctatccacacctgcgtatcaggttcgaccggcaaaccgtcgctgcgccgctgaaccttaaacccgaagcgttttgccgtttcaaataccgtctgaaaatgctcgggatggcgcggcacgacgaccagcagcgcatcgccgcgatattgttgccacgccgccagcagtttttccgcctcgtcttcaccccgataaacgcgcgtgctgccgcacacggcaaccggccggcctccgatgcgtttttcaaactgccccgccagcgttttcatctgttccgacggtatgatgtcgtatttggtattgccgcacacctgcacggatgccgcgcccaatttcgccaaccgcgccgcatccgcctctgtctgcgccagacaccccgtcagcgaagcggcggcaggacggatcaggcggcggactttcagataaccgttcaacgatttttccgacagccgcgcattcgccaaaaacagcggcacacccgcgcgccggcattccctcatcaggttgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgccccgtcggggtcatctgcgtcatcagcagcggcgcatcgggaaaacgccgccgcaactcgcgtatcaaggactgggcggcacgcgtttctccgaccgaaacggcgtgtatccaaaccgcgccggtaacgggattcggatacggcttgccgaaacgctcgtcccgatgcgcccgatatgccggggcacttccggagcgtttgtccaaataacgccgtatccatatcggcgcaagcagccacaatacatcataaagccattggaacatctttctatttcctgcaaaacaaatgccgtctgaacggttcagacggcatttcggcaacggaatcaaatatcgtaggttgtcgaagcggtatctccgcccttgcccgtccagttggtatggaaaaactcaccgcgcggtttgtcggtgcgctcgtaagtgtgcgcgccgaagtagtcgcgctgtgcctgcaagaggttggcaggcagacgttcggtcgtgtagccgtccaagaacgtaatcgccgaagccatgcagggcatagggatgccgcattcgaccgccttggcaaccaccttgcgccacgccggcaggcagttttccaaaatatttttgaaatacggatccgcacccaagaacaccaaatcgggattgttttcatacgcgtcgcggatattgcttaagaatgcgctgcgaatgatgcacccctcgcgccacagcagcgcagtgttgccgtagtccaaatcccagccgtagctttcgcccgcttcgcggatcagcataaagccttgtgcgtaggaaatgattttagatgcaagcagggcctgtctcaacgcctcgacccattcttgtttgccgccttcgacgggcgtaacggttcgggcgaacagtttgccggtctgcacgcgctgttctttgaacgacgaaacgcagcgggcgaatacggcttcggaaatcagcgtcagcggaatacccaaatccaaagcattgatgcccgtccatttgcctgtacctttttgccctgccgtatcgaggattttctcgaccagcggttcgccgccttcgtccttatagcccaaaattgccgctgtgatttcaatcagataagaatccagctcggttttgttccactcggcaaacacgcggtacatttcgtcgtaagacagccccaagccgtctttcatgaactggtacgcttcgcaaatcaactgcatatcgccatattcgatgccgttatgcaccattttgacaaaatgccccgcaccgtctttgccgacccagtcgcaacacggttcgccctgcgacgttttggcggcaatcgcctgaaaaatcggcttgaccgcatcccaagcgcgcttatccccgcccggcataatggacggcccgcgccgcgccccttcttccccgccggacacgcccgcgccgacaaacaaaatccctttttcagcaaggtaatgtgtccgccgtgtcgtgtcggggtaattggcattgccgccgtcgataaggatgtcgccttcttccaacagcggaagcagttgttcgataaattcgtcaaccaccgaaccggcacgaaccatcatcataatttttcgcggtttttccagcttatcgaccaaatcttgcaaagaatacgcgccgataatattagttccttttgccgcgccgtttaaaaattcgtccaccttggcagtcgtgcggttgtaggcaaccaccttaaatccgcaatcgttcatattcaaaatcaggttttgccccataaccgccaaaccgattacaccaatatcgccgttcattgcaggaagctccgttatagatttaatttatcgaccgcaactctacccgatttacacttgtttaacaatccttaactttttaattttttgaaaagatgcctttacgctttgctgtaccgttttgctgaagggttataaataaaatataaaatttaaataataaaacgatgattatattgataggagaaattttctgtgggtaacttttttttattttaaaaatcatcaggatttcttttttttagggtgtcggtaaggcggattcccttttgtgcatacctgtggattgtttttcatgaagaatagtttttgtggacagtttgcttgttgtgcaaatggcatcctacttttctttaccgaatggctgccgatgtctttaagaaccggaatactgtggaggtttgagaggaaagtgtgtttggaacttgtggaaatggtcaggtgtcggcacgaatgtcttatttctgcatatcggcagagtgcgcatccgaatttgtgtataagtggtggaaaaaatgagatttgcgggtaaatctcacaatatttcagtcagataactttggattgcttgtgtataagtaaactttcggatggggatacgtaacggaaacctgtaccgcgtcattcccacgaacctacattccgtcattcccacgaaagtgggaatgatgaaattttgagttttaggaatttatcgggagcaacagaaaccgctccgccgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatccagaccttagaacaacagcaatattcaaaggttatctgaaagtccgagattctggattcccactttcgtgggaatgacgggattttaggtttctgattttggttttctgtttttgtgggaatgatgaaattttgagttttaggaatttaccggaaaaaacagaaaccgctccgccgtcattcccgcgcaggcgggaatccagaccttagaataacagcaatattcaaagattatctgaaagtccgggattctagattcccactttcgtgggaatgacggcatcagtctgccgtttacagcacggtttctttagattttacgttctagattcccgcctgcgcgggaatgacgaatccatccatacgaaaacctgcaccacgtcattcccacgaacctacatcccgtcattcccacaaaaacagaaacctcaaatcccgtcattcccgcgcaggcgggaatctagacttgtcggtgcggacgcttatcggataaaacggtttcttgagattccgcgtcctggattcccactttcgcgggaatgacgaattttaggtttctgttttggttttttgtccttgtaggaatgatgaaaatttaagttttaggaatttaccggaaaaaatagaaagcgttatccacaagttctgatgttcagctcgtgaaatgcgtcgggcaaatcatcgctgtcggcaaattccacccggtcgtaagccgtttcgtctgccaaaaccgcgcgcaagagtgcgttgttgatggcgtgtcccgatttgtagccttcaaatgcgccgacaatcggatgtccgacgatatacaaatcaccgatggcatcaaggattttgtggcgcacaaactcatcgggatagcgcaagccttcaggattcaggacatccgtgtcgtcaatcacgatggcgttgttcaaattgccgcccaaacccagattgtgggcgcgcatcatttccacttcgtgcataaagccgaaagtgcgcgcgcgcgcgatttcgtcgatgtaggatttgccggcgaaatcgatttcaaaagtgggcgagctgcggttgaaaaccggatggtcgaattcgatggtcagcgttaccttaaagccgtcatacggcgtaaagcgcacccatttgcccgcttctttgatttcgacaggcttgaggattttcaaaaaacgcttttgcgccttttgatcgaccacgcccgcatcttgcaaaaggtaaataaacggcaggctggagccgtccataatcgggatttcgggcgcgttcagctcaatcagcgcattgtcgatgccgtaggcggacagcgcggacataatgtgttcgatcgtgccgacgcgcacgcctttgtcggtaacgatggtggaggaaaggcgggtatcgttgatcaaataaggggtcagcttgatttgttcgcccatctcgccgtccaaatcggtacggcggaaggaaatcccgctgttttcaggcgcggggtgcagggtcagcgcgacgcgttcgcccgaatgcagcccgacgccggtaacgctgatggatttcgccaaagttctttgcagcataaaccgcttccttatcaagggggtaagttttggaataatacgataaaaccggaaaaacaggctatgtttttccatagtatttgccaatgtatccgttttcaatacgtaagccgcataaaaatgtatagtggattaacaaaaatcaagacaaggcgacgaacccacccccctcctgaaaaacgcaaaaaatgccgtccgaaaacctttcggacggcattttcgcgtaaaccgtcattcccacaaggacaaaaaaccaaaacagaaaaccaaaaacagcaacctaaaattcgtcattcccgcgcaggcgggaatttggaatttcaatgcctcaagaatttatcggaaaaaaccaaaacccttccgccgtcattcccacgaaagtgggaatctagaaatgaaaagcagcaggcatttatcggaaatgaccgaaactgaacggactggattcccgcttttgcgggaatgacggcgacagggttgctgttatagtggatgaacaaaaaccagtacggcgttgcctcggcttagctcaaagagaacgattctctaaggtgctgaagcaccaagtgaatcggttccgtactatttgtactgtctgcggcttcgtcgccttgtcctgatttttgttaatccactatatctagccgaattactttattttttgatacgtaaccggccggttgccgtcattcccgcgcaggcgggaatctagacattcaatgctaaggcaatttatcgggaatgactgaaactcaaaaagctggattcccactttcgtgggaatgacgcggtgcaggtttccgtacggatagcttcgtcattcccgagtaggcgggaatctagtccgcttgttcggtaaatgagagggcggattgcgcgcctgtcagataaaccacgtgtttaaacgggcggcaatgaggtacgcgcagagccttgaagcgcaatcgatatattattttcagccaaaacggacgcccccgcttgccttgcaaacctttaaaaaggaagccacccggattaatccgagtggccgtggaaaatcacttaccgcttgatttatttaaaatttatggtataatttaccttagctggcatcacttgcgtcgcggcaggttgacggcaggtgcttggtgtcaatcttcttaccgttggcggcggcggcggcggtaacgtcgtcgttggcggctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaagtgttgttgccgggccattcgccgtgattcaggtaatactcggtaacggctgatttttgaccttcggccaaaagaatggcttcggaaacttgtgcgcgggctgtgtagtcttgataagcaggaagggcgactgccgccaaaatgccgacgatggcaatcacaatcatcagctcgataagggtaaaacctttttgaagggtgttcataaaattactcctaattggaaaggaaatgcctcaagcttacgccatcggcattatgcaatgtatttgaccatcggtattttgttgcgatacctgtgtattataaagcaagattggtaccaagtttgtattttgaggtgaaaatttatgcgtttatctctatgtaattgtttttattttacattttctttcgtttggcgtggtttgagtaattagggggttgccgttttttgtcagcagtgttgaaaattgtcagttttagtgccgattttcggcacttttttattggcgtggggtatctctattggcatggggcatcgggtgtgttgattgggtcggaatttgagatttttgaatttgcgcggtagcatagggtgggttgggtgggaaattttaaatttaatttttaaaaatttccgttttcttggaaagtgattgaaatcggcgcgtggtgttcctgtgcaaccggcagttgaatcatcgcggcaggtttccgtgcggatggcttcgtcattcccgcgcaggcgggaatccagccttgttggtacggaaacttatcgggaaaacggtttcttgagattttacgttctggattcccactttcgcgggaatgacgcggtgcaggtttccgtatggatagcttcgtcattcccgcgcaggcgggaatccaggtctgtcggcacggaaacttatcgggtaaaaaggtttcttgagatttttcgtcctggattcccactttcgtgggaatgacgggatgtaggttcgtgggaatgacggtttaggtatttttatagaaagccgtaggtggtgtttctatgcaaacgacagatgaatcatcgcggcaggttgacggcaggtgcttggtgtcgattttgtcggtgccggtggcggcggcggtaacggcgtcgtctttggcgttgtcggcgcgcgtaaccggcagtccgcagaaccattttaccgaaccggcttgacgcttggcccacagggagagttttttgcctttgatttcgttgtttacgttgcttgaagccatttgggcggtaacgacgccgtttttgacttcaacgcttttaacatatttgcctttgatgtcggcggaggttgccacgccggcagaactgttgttgccgggccattcgccgtgattcaggtaatactctgtgacggctgatttttgaccttcagccaaaagaatggcttcgtcattcccgcgcaggcgggaatctaggtctgtcggcacggaaacttatcgggaaaacagtttcttgagattttgcgttctggattcccgctttcgcgggaatgacgggattaaagtttcaaaatttattctaaataactgaaattcaacgaactagattcccactttcgtgggaatgacgaattttaggttgctgtttttgtgggaatgatgaaattttaagttttaggaatttatcgaaaaaacagaaaccgctccgccgtcattcccgcgcaggcgggaatccagcctcgtcggtacggaaacttatcgggtaaaaaggtttctctagtttggtgtcgattttcttgtcgatgctgttgacggcaggtgcttggtgtcgatctgcttgccgttggcggcggtgtcggctttgacggcgtcggcgctggcgttgtcgcgcttaaccggctgtccgtagaaccattttaccgaaccgtcttgacgcttggcccacagggagagttttttgccttggatttctttgtttacgccgcttgaaagcattgtggcggtaacgacgccgtttttgacttcaactttctcaacatatttgcctttgatgttggcggaggttgccacgccggcagaactgttgttgccgggccattcgccgtgattcaggtaatactcggtgacggctgatttttgaccttcagccaaaagaatggcttcgtcattcccgcgcaggcgggaatctagaccttagaacaacagcaatattcaaagattatctgaaagtccgggattctagattcccactttcgtgggaatgacgaattttaggttgctgtttttggttttctgtttttgagggaatgatgaaattttaagttttaggaatttatcagaaaaaacagaaaccgctccgccgtcattcccgcgcaggcgggaatccaggtctgtcggtacggaaacttatcgggtaaaacggtttctctagtttggtgtcgattttcttgtcggtgctgttgacggcaggtgcttggtgttgatgttggcggtgcccttgccggtggcggcggtgacggcgtcgtctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaactgttgtcgccgggccattcgccgtgattcaggtaatactcggtaacggctgatttttgaccttcgaccaaaaggatagcttcgtcattcccgcgcaggcgggaatccagccttgtcggtacggaaacttatcgggtaaaacggtttctttagattttgcgttctggattcccactttcgtgggaatgacgggattaaagtttcaaaatttattctaaataactgaaactcaacgaactagattcccgcttttgcgggaatgacgaattttaggtttctgttttgggttttctgtttttgagggaatgatgaaattttaggtttctgtttttggttttctgtccttgtgggaatgatgaaattttaagttttaggaatttatcggaaaaaacagaaaccgctccgccgtcattcccgcgcaggcgggaatccagcctcgtcggtgcggaaacttatcgggaaaacggtttctttagattttacgttctggattcctactttcgtgggaaagacgaattttaggtttctgtttttggttttctgtccttgtgggaatgatgaaaatttaagttttaggaatttatcggaaaaaacagaaaccgctctgccgtcattcccgcaaaagcgggaatccagcctcgtcggtgcggaaacttatcgggtaaaaaggtttctttagtttggtgtcgattttgtcggtgccggtggcggcggcaacgtcgtctttggcgttgtcggcgcgcgtaaccggctgtccgcagaaccattttaccgaaccggcttgacgcttggcccacagggagagttttttgcctttgatttcgttgtttacgccggttgaaagcattgtggcggtaacgacgccgtttttgacttcaacttccttaacatatttgcctttgattgttgaagaagatgccacgccggcggcatcattaaatcccgtcattcccactttcgtgggaatgacgggattaaagtttcaaaatttattctaaataactgaaactcaacgaactagattcccgcttttgcgggaatgacgaattttaggttgctgtttttggttttctgtccttgcgggaatgatgaaattttaagttttaggaatttatcgaaaaaacagaaaccgctccgccgtcattcccgcgcaggcgggaatccagcctcgtcggtgcggaaacttatcgggaaaacggtttcttgagattttgcgttctggattcccgctttcgtgggaatgacggtttaggtatttttatagaaagccgtaggtggtgtttctatgcaaacgacagatgaagcgtcgcggcaggttgacggcaggtgcttggtgttgatgttgtcggcggtcttggcggcggcggcgacggtgtcggctttggcgtcggtgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgttgccgggccattcgccgtgattcaggtaatactctgtgacggctgatttttgaccttcggccaaaaggatagcttcgtcattcccgcgcaggcgggaatccaggtctgtcggtacggaaacttatcgggtaaaacggtttctttagattttgcgttctggattcccactttcgcgggaatgacgggattaaagtttcaaaatttattctaaataactgaaaccaacgaactagattcccacttttgcgggaatgacgaagtttttctgccatttgccgtgattcgggcaatactcggtaacggctgattttttgaaagtgtttgaaatcggcgcgtggtgtttctatgcaaccggtagatgaatcatcgcggcaggttgacggcaggtgcttggtgttgattttgtcgtcggtcttgccgttggcggcggcgacgtcggtggcggtggcggtggcggtgtcgttgcgcgtaaccggctgtccgcagaaccatttgaccgaaccgttttgacgcttggcccacagggagagttttttgcctttgatttctttgtttacgccgcttgaaagcattgtggcggtaacgacgccgtttttgacttcaactttctcaacatatttgcctttgatgtcggaggaggatgccacgccggcggcatcattaaatcccgtcattcccgcaaaagcgggaatctagaactcaggaccggagaaacctttttacccgataagtttccgtgccgacagacctagattcccgcctgcgtgggaatgatgggattaaagtttcaaaatttattctaaataactgaaactcaacgaactagattcccgcttttgcgggaatgacgaattttaggtttctgtttgtgggtttctgttcttgtgggaatgatgaaattttaagttttaggaatttatcggaaaaaacagaaaccgctccgccgtcattcccgcgcaggcgggaatccagccttgtcggtacggaaacttatcgggtaaaaaggtttctctagtttggtgtcgattttcttgtcggtgctgttgacggcaggtgcttggtgttgattttgtcggtgtcgggtgtggcggcggtgacttcgtcggtgccggctttggcgttggcggcgttgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgtttttcggccattcgccgtgattcgggtaatactcgggtgtttttgtgcaaacggcagatgctgcgtcgcggcaggttgacggcaggtgcttggtgttggttttcttgttgccggtgttgtcggcggcgacggtgtcgtcggtgccggcgcgcgtaaccggctgtccgcagaaccattttaccgaaccgttttgacgcttggcccacagggagagttttttgccttggatttctttgtttacgccgcttgaaagcattgtggcggtaacgacgccgtttgcgactgtaacttccttaacatattttcctttgattttagaggaggatgccacgccggcggcatcattaaatcccgtcattcccacgaaagtgggaatctagaactcaggaccggagaaacctttttacccgataagtttccgtgccgacagacctggattcccgcctgcgcgggaatgacgaagtttttcggccattcgccgtgattcgggcaatactcgggtgttttgtgcaaacggcagatgctgcgtcgcggcaggttgacggcaggtgcttggtgtcaatcttcttaccgttggcggcggcggcggcggtaacgtcgtcgttggcggctttggcgttgtcgcgctcaaccggctgtccgcagaaccattttaccgaaccggcttgacgcttggcccacagggagagttttctgcctttgatttctttgtttacgccgcttgaagccattatgtcagacggtattgcccgggcagctttattcgtacactttcagcagctcgacttcaaatatcaaagtggcgtgcgggggaatcacgccgcccgcgccgtgtgcgccgtagcccatttccgaagggatggtcagcttgcgtttgccgccttccttcatgccgccgaagccttcgtcccagcctttgatgacttgtccgacaccgagcgtgatggtcagcggctggcggcggtcgaggctggagtcgaatttggttccgttttccagccaacctgtgtaatgcacggtaatctctttgcctttaactgcttcttttccgaagccttcttgcaagtcttcaataatcaggccgcccatatttgtcctttcgttgcttgttggtcaaaacggcaagggtaacataccgt

SEQ ID NO: 22 - DNA, 27671 bp, Neisseria meningitidis
aattaataataattatcattatattaatatgtacagataatatcaagccgtttttatagtgaattaacaaaaatcaggacaaggcgacgagccgcagacagtacagatacattccgtcattcccacgaacctacatcccgtcattcccacgaacctgcaccacgtcattcccacgaaagtgggaatccagttcgttcggtttcgcttgttttaagtttcgggtaacttctacttcgtcattcccacgaacctgcatcccgtcattcccacgaaagtgggaatccaggacgcaaaatctcaagaaaccgttttacctgataagtttccgcactgacagacctagattcccgcctgcgcgggaatgacgggatttgagattgcggcatttatcgggagcaacagaagccgctctgccgtcattcccacgaaagtgggaatccagttcgttcggtttcgcttgttttaagtttcgggtaacttccacttcgtcattcccacgaaagtgggaatccagttttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgaacctacattccgtcattcccacgaaagtgggaatccagttcgttcggtttcgcttgttttaagtttcgggtaacttccacttcgtcattcccacgaacctgcatcccgtcattcccactaaagtgggaatccaggacgcaaaatctcaagaaaccgttttacctgataagtttccgcactgacagacctagattcccgccttatatgatgcgctctatcaaaggggcgcattaattttcttaacattcccctttgacagccaagtgaaaggggcttttttatgtcagcagtaaatgtaatattttcctgttcttattggagaatatttaaaaaatcagattcttgtgttttgtgtttttatcagttcagacatggcgaaccgcataaactcattaatcaagagaatttttcaaagctttatcaggcgttcgattatatagattcggttggttcgaattttccagtgattatcacaacggatggttgtggtcttttttgttgatctttaaaagtttgtcaggatttggctttcggtcgttgaccgtcgtacgcgctttagcgcggaagacgggaaacggctgaaagccccccccttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaaaggaaatcaaaatgtttaatcaaactcaaactgtaacttatcctgcaacttttttgggagccaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaatatcatgaaaatgaaccttgcaacactaattatcggctgggtggtctgtatgtttctttttcttttcgcaatcctctattttatcggctaaaaacgagattcggaaaagacttcgtccggatgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataaacagagtgaagaaaaaggggcgtataaatgggctatcgtgtcggcataaattgttttgatacaagattgcaggcagacgactatttattgtcgtcccttcctcctactgttacccaggacggaaaaatcatcaggccggaaagggtgggcgataaatggattttgaacggaaagccggttacgttgtcttatccggaatgttccaattttgagcagataaagcaaggttcttatgtcggttcgacggttctaattctgtttgtagtcatttacggtttcaggcttctgattaattttttaaaagacataggcaaggttgggactgattgatgattatagatttctggtttcttctcggtttcttcttggctttgtctgttgcttggctgttttggtaacggttggtagaatcggctttttagagtgttttaaaaggtccgaattatgtttatttctgaatatcatttagttaaatttcaaactgattcacatatttatagagatttaccacaagcgttaatttattatagggaattgattagaaaaggggtttttaaaacttcgttttcatttgatatttttaggaatttctttcatcgttatgatagagattttatagaaattcaattccctgattcttctacattattaattaaattagatgaagcaaaatgttatgtttattatcctagggcgaaattttttaaagattatcctatgctttagtttttttgtatctaaatttgcattggcatcagtaaatgctccgggtaaatttgatagggttgaagtttatgatgatggcagatatttaggtattcgaggttcagatgacaaaagaagaagaatttggaaaggtgtatttgatagagaatcgggaagatatttaacttcagaagctcaagatttaaaagttaggcatgtatctactggagcatcaagtacgggtaaagttagttcggttgtatcttcatcagtttcccgcgctggcgtattggcgggggtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatagttgcacatttgattggaacggcggagattgtgtggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctagcaggcgcagcaccgccgggcttcagtaacttgtaccaaggcagggggaggacgtccagaaagatttgtaaagacggctttatcgtctttataaatctttttggataccccttgccgccccgccaaaagaacacattctgccgcaagggcaggtggtaaggcgcgcgccttttgcgccgttccccctgcccccgcggcgtcgcaagtgagactgggggtgcgggggctagtccccgcaaagcctttcagcttcggaagccacggccgaaaggcaggcgcagcactgccggtctgagcggaagccaggctacaggcaggcgcagcaccgccgagctaggcggaagccaggctacaggcaggcgaagcaccgccggttgggcggaagccacggccgaaaggcagggcgaagcaccgccaggcttaggcggaagccacggccgaaaggcaggcgaagtaccgccggtctgggcggaagccatggtaaaaggcaggcgaagcaccgccgggcttcagtaacctttgttcaggcagggggaggatgtccgtaaagaatcgtaaaggcggggttttttcgcctttatgattctttttggataccccttgccgccccgccaaaagaacacattctgccgcaagggcaggtggtaaggcgcgcgccttttgcgccgtccccatgcccccgcggcgtcgcaagtgagactagggggtgtgggggactagtcccccgcaaagcgttcagcttcggaaactttggccgaaaggcaggcgaagcagcgcactttgcgacgaatgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatagcaaatgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataaatggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctttatccatcctcgaaattgaatatcatcctagccgtatcaaggctgtataaataaggaaaataccaatgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataaaattcaacaaaattaaacggttacgcgaatatatttgtgtaaccgtgcatttgcatatcgtaaataaacgtaaataaaaataacaatataaatcagtatattgcaactttgttttttattttgtgttgacgggcaacatatcatctgcgcgggaatgacgggatttgagattgcggcatttatcgggagcaacagaagccgctccgccgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaacctacattccgtcattcccacgaaagtgggaatccagttttttgagtttcagtcattcccgataaattgccttagcattgaatgtctagattcccgcctgcgcgggaatgacgggattttaagttggggtcatttattggaaaaagcagaaaccgctccgccgtcattcccacgaaagtgggaatccagttttttgagtttcagtcatttccgataaattgccttagcattgaatgtctagattcccgcctgagcgggaatgacgaatccatccgtacggaaacctgcaccacgtcattcccacgaacctgcatcccgtcattcccacgaaagcgggaatccagttcgttcggtttcgcttgttttaagtttcgggtaacttctacttcgtcattcccgcgcaggcgggaatccagtgcgttgagtttcagctatttagaataaattttgaaactctaatcgcgtcattcccacgaaagtgggaatccagttttttgagtttcagtcatttccgataaattgccttagcattgaatgtctagattcccgcctgcgcgggaatgacgaatccatccatacggaaacctgcaccacgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaaagtgggaatccagctttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgcaggcgggaatccagtgcgttgagtttcagctatttagaataaattttgaaactctaatcgcgtcattcccacgaaagtgggaatccagctttttgagtttcagtcattcccgataaattgccttagcattgaatgtctagattcccgcctgcgcgggaatgacgaatccatccatacggaaacctgcaccacgtcattcccacgaacctgcatcccgtcattcccacgaaagtgggaatctagttcgttcggtttcgcttgttttaagtttcgggtaacttccacttcgtcattcccgcgcaggcgggaatccagtttcttgagtttcagtcatttccgataaattgccttagcattgaatgtctagattcccgcctgcgcgggaatccagtgcgttgagtttcagctatttagaataaattttgaaactctaatcgcgtcattcccacgaaagtgggaatccagttttttgagtttcagtcattcccgataaattgccttagcattgaatgtctagattcccgcctgcgcgggaatgacggcggagcggtttctgttttttccggtaaatacccacaagctaaaatcccgttattttcacaaaaacagaaaaccaaaaacagaaacctgaaattcgtcattcccacgaacctacatcccgtcattcccacgaaagtgggaatccagttttttgagtttcagtcatttccgataaattgcctcagcattgaatgtctggattcccgcctgcgcgggaatgacggcggagcggtttctattttttccggtaaatacccacaagctaaaatcctgttattttcacaaaaacagaaaaccaaaaacagaaacctgaaattcgtcattcccgcgcaggcgggaatctggttcgttcggtttcgcttgttttaagtttcgggtaacttccacttcgtcattcccgcgcaggcgggaatccagtgcgttgagtttcagctatttagaataaattttgaaactctaatcccgtcattcccacgaaagtgggaatccagttttttgagtttcagtcattcccgataaattgccttagcattgaatgtctagattcccgcctgcgcgggaatgacggctgcagatgcccgactgtctttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatactgtaatcagggatgctcagttcgtcgaaacggcaaaacaggttgaagtcgatgcgggtgatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcatgagaaatctcctaaatgtcttggtgggaatttaggggattttggggaattttgcaaaggtctcaacttgagtttcacgccccgcttaacaatattcagttggtaaatattagataaaaccataaaaattaaattgatggcttttataatccccgatttgcgaaaatgccgtctgaaagtcttcattcaggctttcagacggcattttgatcatcaagtaacgctttatcaggcttttttattgttcaacgcagctttgacaaacgcggtgaacaaaggatgccctttgcgcggattggaggtaaactcggggtggaactggcaggcgaagaaccaaggatggttcggcagttcgatggtttcgaccaagcgttcgcgtccggcagatacaccgccgatgaccaaacctgcctgttccagtgtaggaacgtagttgttgttgacttcgtagcggtggcggtggcgttcgcggatatgtccgctgccgtagattttggcggcgaggctgcctgctttcaattcgacttcttgcgcgcccaaacgcatcgtgccgcccaaatcggtggattcgtcgcgggtttcgacgctgccgtcggcagtttgccattcgtcaatcagggcaacgactggcgcggcgcatttgaggtcgaactcggtggaattcgcgcctttcaagcctgccacgtcgcgggcgtattcgatcagcgcaatctgcataccgaggcagatgcccaagtatggcacgttgttttcgcgggcgtagcgcacggcggcgattttgccttccacaccgcgcgaaccgaaaccgccgggaacgaggatggcgtccatgtctttaagcatggaaacgtcgcccttgtttttctcgatgttttcgctgtcgacaaaggtaatctgcacgtcggtttcggtgtgaatgcctgcgtgtttcaaggcttcgatcagcgatttgtaggactcggtcaaatcgacgtatttgccgaccatggcgattttgacggtgtgtttcgggttttggatggcgtggacgatttttttccacgcggtcaaatccgcctgctgcacattaagctgcaactgctcggtaatgatgttgtcgatgccttggtcgtgcagcatttcggggcattcgtagatgctgtccacatcgtagctgccgacaatcgcgcgttcttccacgttgcagaacaaggcgattttgcggcgttcgtccgcaggcattgtcctgtccatacggcaaatcaggatgtcgggttgcaaaccgatgctcaacatttctttaacggtgtgctgggtcggcttggttttgatttcgcctgcggcggcgatgtaggggacgtagctcaagtgggcaaacaaggtgttgttgcgccccaactggcttcgcatctggcggatggcttccaaaaacggcagcgattcgatgtcgccgaccgtgccgccaatttcgacaatcgccacatcgtaacctgccgcgccttcgtggatgcgtcgtttgatttcgtcggtaatgtgcggaatgacttgaaccgtaccgccgaggtagtcgccccgtcgttctttggcgataacgttttcgtacacctgtcccgtgctgaagctgttgcggcgggtcatcgtggaatcgataaagcgttcgtagtgtcccaagtcgaggtcggtttccgcgccgtcgtcggttacgaacacttcgccgtgttggaacgggctcatcgtgccgggatcgacgttgatataaggatcgagcttgagcatggtaacgttcaagccgcgcgattcgaggatggcggcaatagaagcggcggcgatacctttacccagtgaggagacaacgccgccggtgacgaaaatgaatttggtcataatgaaatacccgtattggaatgcgtgattttaacgtgaagcgcgcggttctggcaaacggacggatgccgtctgaacgatggacggctgttttcagacggcatcttttctttatttcccggtactttgccgcaactcgcggcgcaggattttgccgacgttggacttgggcaactcgtcgcggaattcgatatttttcggtactttatatgcggttaattcggtgcggcaaaaagcgataagttcttctttggtcaaagacgggtcttttttgacgacgaatactttgagtgcctcgccggttttttcgtcgggaacgccgatacaggcgacttccatgactttgccgtgatgcgcgatgacttcctcgatttcgttcggataaacattgaatccggaaacaacgacgaggtctttcttacgatcgaccagcttcaaccagcctttttcgtccatgacggcaatatcgccggtttccaagaagccgcgcgcgtctatggctttggcggtttcttcggggcggttccagtagccttgcatcacttgagggccttttacccacaattcgcccggctgcccgacggggacttctttgccgtttgcgtcgcgcagttcgacttcggtggacgagacgggcaaaccgatgctgccgctgtatgattcgatgtttaaggggttgcagcacacgccggggctggcttcggtcagaccgtaggcttcgacgatgggcgtgccggtgatttttttccatttttcggcaacggctttttgggtcgccataccgccgcccaaagtcagccgcaattctgaaaaatcgacttcggcaaaatcaggacggttaaccatcgcgttaaacagcgtgttcacgccgataaatacattaacccgctgttttttcagttctccgataaagcctttcatatcgcgcgggttggtaatcaggatgattttcgagccggcattggcaaaaatcatcagattcacggttaaggcaaaaatatggtacagcggcaaggcggcgataacggtttctttgccctcgcgcaactggtttttaatccattcttttgcctgaagcatattggcgcagatgttgccgtgactcagcaccgcccctttggcaacacctgtcgtgccgcccgtgtattgcaacagcgcggtatcttcgcggtttaatgcgacaggttggaaaacgtgcttcgccccttctttcaatgccgtctgaaaggaaacggtttcccgaatacggtattcgggcaccattttcttgattttccggatgacgaaattgatcagcgaacctttaagcagcccgaacatttcgccgacggaggctacgatgacgtgtttgatctgcgtgcgcggcagcaccagctccagcgtgttggcgaaattttccaaaacgatgatggcggtcgcgccgctgtctttcaactgatgctccagctcgcgcggggtatagagcggattggtgttcaccgctaccaaacctgcctgcaaaatgccgaaaagggcaaccggatattgcagtacattgggcaacattattgccacgcgctctcctcgaggcaatttaaggacgttttgcagataagaagcaaaatctgttgccagtttgccggtttcggcataagtcagcgtcttacccatgttttgaaaagcaggttggtcggcaaatttttccacgctttggcggaatacgtcgctgacggaattgtattgcgtgatgtcgatttcggcactgacgcccttctcgtagctgtctaaccagattttttccataggtatcggtctttaaagtggaattgagcggaacaatgccgtctgaaaaccgtttcagacggcattacctttatcgtgtgatgatgacgggtttgtcggtcgtttggatgataccgccgcccaaacagatatcgccgtcgtacagcacggcggactgacccggcgtaaccgcccattgcggttcgtcaaacaccagctcggcggtttcatcatccaaatagcgcaactcacaaggcgcgtccgccatacggtaacgcgttttgcaggtatagcgtcctgccttcgggcgttcgggcagcgtgaaactcaaatcgttcatcacaaggctgcgggtataaagcagcggatggtcgtgtccttgcacgacaatcagttcgtttttcgtcaaatctttagccgcaacaaaccacggttcgcccgcgccgccaatgcccaaacctttgcgctgtccgagcgtgtagaacatcagcccgacgtgttcgccgacggttttcccttcgggcgtaaccattttaccattgtcggtcggcaggtatttctgcagaaactcgcgaaacgggcgttcgccgatgaaacagatgcccgtgctgtcttttttagcggcggtcggcagtttgaactcggcggcaaggcggcgcacttcgggtttttccaaaccgcccaacggaaaaatcgcgcgctcgagttggaaaggcttgaggcggtagaggaaatagctttggtctttgtttcgatccaaacctttgagcaggtaatgcacgccgttgcgaacttctttgcgcgcatagtggccggtggcgatggtatccgcgccctgccctacggcgtagtccaaaaagcatttgaatttgatttcggcgttgcacaacacatccggattcggcgtgcgccccgcactgtattcctgaagaaaataagcaaagactttgtctttatattgcgcggcgaaattaacgatgtcgatatcgatgccgataatatcggcaacggcgatggcatcgaacgaatcctgtttgatgctgcaatattcgtcgttgtcgtcgtcttcccagttctgcatgaacacaccgcgcacttgataaccctgctgcttgagcagggcggcggttacggaagaatcgacaccgccggagagcccgacgatgatattggaagggtttgctgtcgtattcatgcgtagaatatggttggaaacggcggtttttaaaggcggattttaacacattttaaaggcgggcataaaaatgccgtctgaaagcccgggctttttcagacggcatttcaaacattttcagcagattagtgctgatgcgcttcgccgtggtgatgaccgtggttcattgccggcatcggcgcgattttgacttccagttggacggtttgcgctttggcgtttttaaatttcagggtaacgggaattttatcgccctcttttaattgttttttcaaacccataaacatcacatgatagctgccgggtttgagttcggtaacggatttcgcttccaaaggcacgccgccttcgacttcgcgcatccgcatcacgccgttgtcgttgatgtgggtatgcacttcgacgcggtcggcaacggggctgcttccgccgagcaaaaagtcttgtttggcttcgtcgttgtggattttcatgaacgcgccgcctattttcataccttcgacggtggtgcgcgcccagccgtcctcaacgtggactccggcggcggaaaccgcgcctgccaaacctgccatcatcacggccgccaataattttttcatctttctgctccttataatatcagacggggaatgtgcttaatcttatagcggattaacaaaaaccagtacagcgttgcctcgccttagctcaaagagaacgattctctaaggtgctgaagcaccaagtggatcggttccgtactatttgtactgtctgcggcttcgtcgccttgtcctgatttttgttaatccactatacatacaaatactgcctggaaatttgatgtagattaagtgaataataaataccacatactaatcctaaaggattacaaatcctgctgcaagcgttttacccgaacagggcagacagccaaaccgccgccaacatcagcatcgcgaacaattgtgcggcagaacctgcgtctttggcgagtttggccagctcgtgtttttcggtcgaagtatgatcgacggcagcttcgacggcggtgttgaacagttcgacaatgaccgacacaaaagacgcgataatcaacggcaggcggacggcggtttcggaaacccaaaaaaatgccgcgcacaccagcagtacgttcagccacaaaacctgacggaatgccgcttcgtaacggtaggcggcggcgatgccgtctatcgaatagccgaatgcgttaatgacgcgcctgatgccgcctttgccttttttttctgccgcgtaggaggaaggttccatcggtatcctttcaaaatgttctcaatatagtggattaacaaaaacctgtacggcgttgccccgccttagctcaaagagaacgattctctaaggtgctgaagcaccgagtgaatcggttccgtactatttgtactgtctgcagcttcgccgccttgtcctgatttttgttaatccactatatataccgtctgaaaacggggcggcggggtgtccgtacggtattaagcgtatccctgccggctgagagaaaaccctgcctgcccaatcaaaccaggcggttgtgaagcaaaagcctttcagacggcatcggtttaacgtaccgaccacgcggcaacggcatcggcaaacattgccgccacatcgaaacctttttgtttcataatttcttggaatccggtcgggctggttacgttgacttcggtcaggttgctgccgataacgtccaaaccggccagcaggatgccgcgccgtttgagttcgggggcgagcgtttcggcaatttcgcggtcgcgtccgcccaattcctgcgccacgccgcgcccgcctgccgcaaggttgccgcgtgtttcgccgttttgcgggatacgcgccaaagcataggggacgacttcgccgccgataatcaggatgcgtttgtcaccgtgtacgatttcgggaatgtagcgttgcgccataatggtgcgggaatcaagctgcatcagggtttcgaggatgctgccgatgttggggtctttttcggtcaggcggaaaattcccataccgcccatgccgtcgagcggtttgatgatgatgtcgccgtgttctttcaaaaatgtgcggacatcggcggaacgggtcgttaccagcgtgggcgcgataaagcggctgaagttcaaaatcgccagtttttcattaaagtcgcgcatcgcctgtccgctgttaaagaccttcgcgccctgctgttccgccagcgtcagtaattgggtggcgtagaggtattgcatatcgaacggcggatcggtacgcataatcacggcatcaaatgcttccaatgccgtctgaactttgtcggcagatttgaaccacgcatgatcatcatcgttttttgcacccaaaaattcaaatgccgatgcctgcgccgttaccaaaccgccgtttacagacaattccccgctcaatgtgtgaaacagccgccagccgcgttttgccatttcgcgcatcatcgcgtaggtggtgtctttataggttttgaaacttgccatcgggtcggcgataaagaggactttcatcatatttcctttccggtgtgccgaatgtgccgcatttcgcgggtaaaggagaaattccgcccgaacaatattcagacggcagggatggggttttacttaggctgccaagagtctttcagcgttaccgtgcggttaaacaccggcgtgtctttgccgtggtctttacggtcggttacgaagtagccgatacgctcgaactgccaacggctttctgccggcaaatctttggcggcaggttcggcgtaggcggtgatttccttgacggattccggattgaggaaatcggtgaacggcaggtattcgccgtcttcgccgcgcacggcatcgggacgctcgacggtaaagaggcggtcgtacagacggactttgatttcggcggcgtgttcggcggaaacccaatgaatcacgcctttaactttacggccttctggatttttgcccaaggtgtcgtggtcgatgctgcatttgagttcaaccacattgcctgcttcgtctttgacgacttcatcgcacttgatgacatagccgtggcgcaagcgtacttcgccgccgggaatcaggcgtttgaagcctttgggcggattttcggcaaagtcgtcggcttcaatatagatggtttgggaaataggtacttcgcgctcgcccatttcctcgtggttcggatggaacgcggcacggcggctttgggttctgccggtttcaaagttggtcagggtcactttgagcgggttcaacaccgccatcaggcgtggggcggaattttccaactcttcgcgaatcgcgccttccaacacgctcatatcgacgatgttttcagatttggaaataccggcgcgtttggcaaacaggcgcagcccttcgggcgtgtagccgcgtcggcgcataccggaaatggtcggcatacgcggatcgtcccagccggaaacgtgtttttccacaaccaactgattcaatttccgtttggaggtaatggtgtacaaaagctccaaacgggaaaactcgtattggcgcggacgggtggcatgcggcgcaggaatgttgtccaacacacagtcgtacagcggacggtgtgcttcgaattcgagcgtacacaaggaatgcgtgatgccttcgatggcatcggagatgcaatgcgtgtagtcgtacatcgggtagatacaccatttgtcgccggtgttgtggtgatgggcgcggcggatgcggtagatgacggggtcgcgcatattgatgttgcccgatgccatgtcgattttcaggcgcagggttttgctgccgtcggggaactcgccgtttttcatgcgtgtgaacaggtcgaggttttcttcgacgctgcggtcgcggtaagggctgtttttacccgcttcggtcagcgtaccgcggtattcgcgcatttcttcgggcgtcaaatcatcgacatacgctttgccgtctttaatcaaaccgacggcgtagtcataaagctggtcgaaatagttggaagcgaaacgcggctcgcccgcccaatggaaaccgagccactcgacatcttctttgatggcgttgacgtattcgtcgttttctttttcggggttggtatcgtcaaaacgcaggttgcacaagccgtcgtaaatatacgccaaaccgaagttcaggcagatggatttggcgtgtccgatgtgcaggtagccgttgggttcgggcgggaaacgggtttggacagctgtatgtttgccgctttcgaggtcttcttcgatgatggtgcggataaaatggttgtccgcaaattggtctttattgagcatagttttctttgaacagatggcttcagacggcattggaatgattccgtatgccgtctgaagcggtttgggaatgtgtttattgtacccgacttgcgcgctttgacatagcgttcagacggcatcggcaatcaagcattccacccccgcctctttcagcatcttctgcatcgcggtatcgggcagccggtcggtaaatactttgtcaaacgccgtaatgtcgccgagcctgaccagcgcgttgctgcggaatttactgtggtccacgccgaggaagcggacgcgcgcattggcaatcatcgcctgcatcacgctgacttctttgtagtcgtcgtccaaaagcgaaccgtcgctttccacgccgtgcgtactcatcacggcataatcgactttgaactggttgataaaatcgacggttgccacgccggtaataccgccgtccaaagggcggacgactccggaagtgatgatgaccgtataatccgtccgcgccgaagcaatcgaggcggcgtggatattgttggtaatcaccctcaggctgccgcgccgcctgaccagctccgacaccacggcctccatcgtcgtgccgatactgacaaacagcgacgaaccgtcggggatgtgttccgcaatcagccgggcaatggcgtttttttcgttttgacaccgggtttggcggtcggcgggcaggccctccggcaagtttccgcccgaagatgcgccgccgtgatggcgtttcaggctgccgacctcctccaactcgcggatgtcgcggcgtatcgtctgcggggtaacgtccaatgcggcggcaagctcgtccaccgacataaactgatgccggcggacaaggcttaaaatctctccgtgcctttggattttcggcttcatcgttttctgcctccttgcatcgggatgccgattttaccgcgttcaacccaaagcggaaaacaccaccatcagaaacggggcggcgatattgaccaccacgccgaagctgaccgctaccggcacgacttccaaaccgcccgcaccctgaatcacgggcaatgtaaaatccatactggtcgcaccgccaacccccaccgccgcatctggaaaacgcttcatcagcagcgggataaatgccagtgcaaacagctctcgtgccaaatcgttcagcagcatgatgctgccccataccgcgccgtaagcctcggtcatgaccaaacccgagagggaataccaaccgaagccggaagccatcgccaaacctttcgtccacgacacaccgtctgtcgatgcggcaaacagcagcccgcccgaaagagatgaaagcataaaccagaccgacaaccgaatacccctgcggttgaccaaaacctgccgcaacgatacgccgctgcttttgagctgtacgccgatgaggaacaccagcagcatcagacaatacatgcccgcgctttcagacggcatccaaatatcgcgcatcagtttgccgaatgcaaatccgagcagcacgcatccgagctgccccacactgcccgacacgccgaccgaaacgcccttccctttcccctttatccgccacgggaataactttcccaacactgccaaagcaagcaggttcgccccgaccgtacaaacaaacagccacagaaccgtcaacgccatatcgtccaaccgcgaacccaaatcctccacgcgcgacaacgagacgccgatcagcagcagcacagcatacaccaagaccgatagcaccttatccaaagcgggcaggtaaggcttgggcacacggataaaaaatccggcaaacatcggtatcaataccgaaagcaacgtcatcaggctgtccatctactgctctcctttattgccgcatgatatgtgcggtttaaaaattgccgtctgaaaattgcagatacccgcatccatatttcagacggcatcaggttcgccattaaaaaaccgcctgaaggttcaggcggcttatccgctccggcattcaatcttccaaagtcttttccaaacgctccatacagttgcccaaatggcggcgcaggattttgaccacgcggttgcgcctgcccgccagcagcaggtcgaggatttcgcggtgttcggaatgcgtatgcgtattgatggcgtgtttttcctcgcgatgcacgcccgccacggcgacaatcagggaagaccgcgcgcacagcgtattcataatgtcgaacagcacatcgttgcccaccaggcgcgccagttcgacgtggaaggcattggacaggcggttccagccgacgcggtcgcccctgccggaggcctcttcttcgcgccgtatcatcgcataaagcggcttgaggcgcgtttccaaatccggcaaatctgcgaggatattcaaaatcatcgtctccatttcgatgcgcgcattgaacacatcctgcatttctttcaaatcgggaacgtggacgaacgcgcccctgttgggttgcaaatcgacaatcttgtcgtgcgccaaaagcgacagcgcgccgcggacggtgttgcgcgaacacaccatctgacggcaaagttcggattcggtcagctttttgccgggcagcagcacctgatcggtaatgccgtccaaaatcagggcgtaaacacggaacagctccgaatcgtgccgctcttcgagaatcagggaagacgtggtcggcgcatggataatgtcgtcgttttcaaagttcatgatgttttccgtatttttacgctttcaaattttttaagatgttttaaggcggctgtgtttcaaatcgtgtcagaggaattaaagcattgcacaaatttattttatagtggattaacaaaaatcaggacaaggcgacgaagccgcagacagtacaaatagtacggaaccgattcacttggtgcttcagcaccttagagaatcgttctctttgagccaaggcgaggcaacgccgtactggtttttgttaatccactataattcaataaattaatatatggcttaaaataacgggattctcgcctcccgcccgcccgcagaagcaggcggatatcattttaaaacgcggcatttaaaatttgaccgaaaattgttgacaatccggaatcaagtctgcacaataccccgacaagtccaagtattataaaggctgaataaagaggaaacagcaggcagatatattcgggaggtgcagtccgaatatatctgcttttttatgcgcctccggattgcctgccgcacctttcccttcagacggtatcagccgtttccccataatgccgcccgatgcctatttatctgccccggcaatttcaaaactgtgggtaatctttgccgctttgcccaacataatcgaagccgaacagtatttttcggcagacatctgaacggcgcgctcaatggccgattctttcaaatcatgcccgaatactttgaaatggatgtggatttcggtaaacacgcgcggcgcatcgtccgcccgtttcgccgtaaccgtcgcacggcagtcagtcactttctgacgctgtttttcggcaatcatcaccacatcgatgctcgaacagcccgccacgcccaacagcagcatttccaaagggctgggcccgcgcttagccttaccttctgccgccgacccctccataacgacgctgtgcccgccttccgtcgtgccgacaaaacacatcccgtctatccattttgatgtaacctgcatggtgtcattcctgaaaatagcgttaaaaccgctttgcatatggcgttattgtaaacaatttcaagcggcttatgcagaaatatggacaaaacggcaaaaaaacacttgaaaaccgatttacggtttggctgcctggccgttgatctgcaccgatttgagtttcagcgtataggttttgccgtcgtcggtatagccgatttgtgccggaatattgttcagggacggtgcgaagaaatacattaccgcatcgtcgccgcgccgcacccgatatttgacgacttcggtttccacgccgcctatgctgtattttcctgtacccgccttattcaaaccgccgacggaataaagttttttgccgttggtgattttcagccccggggggagtttcgcgtcatttgccgccaactgccaggcaagcgtgaacaaatccatagccttggggctttgctcggttttgctctcgcccgctttgccgtaagttacgctgccgtcggcgaatttggcttccgcatacagtttgcccctgcgtatgtctctatagtaggtagggtgcagggtattgccgacaaccgtaccgccggactcgaaacggatattgtatagcggcactttaatcgtcgaaacgattttgtaagcattgccgctgcgttcaaatgtcatcgtggcgggaatgccgtagctgccggaatagtgcagcacggcggattggggcagccctgccgcatacgcgcacggcagggcggcggacaaaatggcggcggaaaatatatttttaaaagtcttcatcatttgctcccgcccggtttacgccgtcagaaaacgggcggcatcggcgttttccgaatttctgacgcggtttccctcaataatcaggcggccggcggcaaaatcggcaacggctttcggataaagtttatgctcgacagccaaaacccgtgcggcaatatcgtctgccgtatcgccgtcgagtatcggcacaaccccttgcgatacaatcgggccgcaatccagttcggcagtaacgaaatggatggtgcagccggcaacgcggcagcccgcctccaaagcgcgttcgtgcgtatgaagtccggtaaacgagggaaggatggacgggtgaatgttcatcagcctgccttcgtaacgggcgcaaaactcgggggtcagaatccgcataaaacctgccaaaaccaccaagtcgggttgatatgcgtcgattttctccatcatggcggtatcgaaggcaagccgggatgtaaagtttttatgattcaggctatcggtcgggatgccgcgttcggccgcccattgcaaaccggcagccgtttcgctgttgctcaacacggcggcaatgcggacgttgtgaatggcggcattgacgattgcctgcatattgctgccgcgtccagaaatcaggatgacgatgtttttcataatggtgcgcttttgaaagggatgccgtctgaaccgctgtttggtggtttcagacggcatttgccgtaaaaatgcccgaaaacctgtttcgggcatggattcggacttaatttacttttttgatgtcgacttgagccggctgcttggcgggcgcgttttcgggtgcgccgattttgaccagtttcacatcaaataccaaagtggcgttcggaccgattttgtcgcccgcaccctgttcgcggtaggcaaggttggacgggatgtagaacgtggcttcgccgccttctttcagaagctgtacgccttcggtccaacccggaatcacttggctcaaagggaaggtgaccgggccgccgttggctttgctgctgtcgaataccgtaccgtcaatcaggcggccttcgtattccacggtaacgatgtcgtctttggtcggctgtttgccttcgccctgtttggtgattttgtattgcaggccggaagcagtggtcttcacgccgtctttggcggcattttctttcagaaaggcttcgcctttttctttattggccttcgcgtccgccttgtgtttttctacggctttagcctgttgttcctgaaggaatttcatcatgacttcctgagcctgctcttcggtcattttgatttctttgccgtcatacactgcctgcatggcttcggtaaagactttcaaatcgatttccgcgccctgttccttcatttgcttcagggagcgtccgatgtccacgcccatcgcatagcttgcctgctgcatcgtgctgccgatcgaagaggtgtcgccctgcgcggaagaagcggcggcaggttcggatgcagatgcgggggcggcttcttttttgccgcaggcggaaagtgccaaagtcggcggg

SEQ ID NO: 23 - DNA, 916 bp, Neisseria meningitidis
  misc_feature (651)..(651): N is any nucleotide
  misc_feature (705)..(705): N is any nucleotide
  misc_feature (789)..(789): N is any nucleotide
  misc_feature (881)..(881): N is any nucleotide
  misc_feature (906)..(906): N is any nucleotide
cgttttcatcaccaaatgctgcgtcaggttgtggaactcggcgcgactgatgcttgtgtcgattgccatgccgtctgaaagcgtcgcctgaatgcgcgcttcggtttgcgtggttaattgttctttggcggcgcggacgagcgagagcaggagttggctgtcttgttcgttgagttgggagagtccgttttgttcgagcaggcggcagaacaggcggtggtcgaaatcgtcgccgcccaacgcgctgttgccgccggtggctttgacttcaaacagtcctttggtcagttgcaatacggatacgtcgaatgtgccgccccctaagtcgtacacgacaaacgtgccttccgaggcgttgtccagcccgtatgcgattgcggcggcggtgggttcgttgagcaggcgcaatacgttcaaacccgccagacgcgcggcatctttggtggcctggcgttgggcatcgtcgaaataggcggggacggtaatcaccacgccgaccaaatcgccgcccaaggtttcttcggcgcgcgatttaagggttttgaggakttccgccgacacttcgacaggcgttttcaccccctgccgcgtatgcagttcgataacgcgttgattgtcgccgaaacggtaaggcaggtagtgcgtattttnaggcggcgcacggcgttgcgttcttccatcagacgcgaatcggcaacgcgggtntcggggtgggcgcaaaacgggcatttcatcgggttcgtcctcctatgtcgtctgaagttcagacggcgacgccgcgggcgggcnatttccagaccttcttcggcactcatatagacggggttttcgggacggtcgtgtcggacgatgttgccttcgcggaacatgaccagtttgtncacggcaagttgggaccatgattcntcgcgggtca

SEQ ID NO: 24 - DNA, 56485 bp, Neisseria meningitidis
cggcgaaaatagcggtcaatgaggcgaagcctgccgatgccaatgcccaaaacagccatgcgttgctgcccatgttttctccttggattgtgaacaatatgaacggtatttttgttgctgcgtcaaaaatttcactgcgggtttggtgcggataacgttataatatgcctgatattattttcaatccacctgtttgtcgcctgatgctttcagacggcatgtccctcctcatttctaaaggaaaatcatgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctgaacggttttctgaaaccggatgccgtctgaagccgtttcagacggcattttttcggaacgcgggcggcggtatgctataatccgccgttaaatttctctattttcaggaaaaaacatgagtttgaaatgcggcatcgtcggtttgcccaacgtcggcaaatccaccctttttaacgcgctgacccaatcgggtatcgaagcggcaaactatcctttctgtaccatcgaacccaacgtcggcatcgtcgaagtccccgatccgcgtatggccgaattggcaaaaatcgtcaatccgcaaaaaatgcagcctgccatcgtcgaatttgtcgatattgccggtttggttgcaggcgcgagcaaaggcgagggcttgggcaaccagttccttgccaacatccgcgaaaccgatgcgattgtgaatgtcgtgcgctgctttgacgacgacaacatcgtccacgttgcaggccgcgtcgatccgattgccgacattgaaaccatcggcacagagttggcacttgccgacctggcaagtgtcgaaaaagccatcgtccgcgaagaaaaacgcgcccgctcaggcgacaaagacgcgcaaaagctggtcgatttgtgcaaaaaactgctgccgcatctggacgaaggcaaacccgtgcgttccttcggtttggacgcggaagaacgcgcgatgctcaaaccgctgttcctgctgaccgccaaaccggcgatgtatgtgggcaacgtcgccgaagacggttttgaaaacaatccgcacctcgaccgcctgaaagaattggcggcaaaagaaaacgcccccgtcgtcgccgtttgcgccgcgatggagagcgaaattgccgaattggaagacgacgaaaaagccgagttcctcgccgaaatgggcttggaagaaccgggcctgaaccgcctgattcgtgccggttacgacctcttggggctgcaaacctatttcaccgccggtgtgaaagaagtccgcgcgtggacgatacacaaaggcgacaccgcgccgcaagccgccggcgtgattcatacggattttgaacgcggcttcatccgcgcccaagtcatttcttacgacgactttgtctcgctcggcggcgaagccaaagccaaagaagccggcaaaatgcgtgtggaaggcaaggaatatgtcgtgcaagacggcgatgtgatgcactttttgtttaacgtgtaacccaaatgcggcaggtttcaggcggcttgccggaaatgccgtctgaagccgattttgatgattttcggcgtttcccgtaccgccggaatgcagccgcatcaaaataaactcccacccgcatttccgatttgccctccccgattcctgcaaaacaaaccgcctgccccgccgttacgggaagccgtccggcattccgaatatcccgatccccgatacgaaatgacctttcagacggcatttgcgccgccgcgtttcgagtatagtggattaactttaaatcaggacaaggcgacgaaaccgcagacagtatagatagtacggcaaggcgaggcaacgccgtactggtttttgttaatccactataaaaacattatgagccaagccttaccctaccgcccggacatcgacacattgcgcgccgccgccgtcttgtccgtcatcgtgttccatatcgaaaaggattggctgccgggcgggtttctcggtgtcgatatattctttgtgatttcaggctttttgatgacgacgattcttcaccgcgaaatgtcgggggggggggggaggttttccctgaaggcattttatatccgccgcatcaagcggattctgcccgcatttttcgccgtattggcggcaacgctggcaggcggcttctttttattcaccaaagatgatttctttcttttgtggaaatccgcgctgaccgccttgggtttcgcctctaacctgtattttgcaagggggaaggattatttcgatcccgcgcaggaagaaaagcccctgctgcacatctggtctttgtcggtcgaagaacaattttactttgtctttccgatactgctgctgcttgtcgcccgcaaaagcctgcgcgtacagttcggcttccttgccgcactgtgtgccttaagccttgccgcctcctttataccttccgcgctcgataaatattacctgccccacctgcgcgcctgcgaattactgataggatcgctgaccgccgtgtggatgcgctgccggcaacctgccgtcggcagacgctgtgccgccgtcggcgcattgtttgccgtgtgcatattgtcaacctgcctgttttcctattcggaacaaaccgcctatttcccgggccccgccgctttgattccctgtctggctgttgccgcgctgatttatttcaatcattacgaacacccgcttaaaaaatttttccaatcgaaaatcactgttgccgccggtttgatttcctattcgctttatctgtggcattggccgatattggcctttatgcgctatatcggcccggacaacctgccgccttattcgccggcggcggcggtcgtcctgatattgctgctttccctgttttcttaccactgcatcgaaaaaccgtttaaaaaatggcaaggttcgttcgcacaatccgttttatggatttatgccttgcctatgctcattttgggggcgggctcgttttttgcgatgagactgccgtttatggcgcaatacgaccgcttggggctgacgcgttccaacacctcctgccacaacaataccggcaaacaatgcctatggggggatacggaaaaacagccggaactgctggttttgggcgactcccacgccgaccattacaaaacattcttcgatgccgtgggcaaaaaagaaaaatggtccgccactatggtttccgccgacgcttgcgcctatgtggaaggctacgcgtcccgtgtgttccaaaactgggcagcctgccgcgccgtttatcgctatgccgaagaacacctgccccggtattcaaaagtggttttggcgatgcgctggggcagccaaatgcccgaaaacagccgctcccttgcctatgatgccggttttttccaaaaattcgaccgtatgctgcataaactctcgtccgaaaaacaagccgtttacctgatggcggacaaccttgcctcgtcttacaacgtccagcgcgcctatatcttgtcttcacgcataccgggttaccgccaagccctgcgcccggacgacgaaagcaccctgaaagccaatgcacgcatcagggaattggcagccaaataccccaacgtctatattattgatgccgccgcctatatccccgcagattttcaaatcggcggattgccggtttactcggacaaagaccacatcaacccttacggcggcacggaattggcaaagcgtttttccgaaaaacaacggtttctcgatacgcgccataaccattgattcgcttaaatttgttacaatcggcggtttgcaaaaacgctaattttttttgaaagagaccgatgagcgtcatccaagacctgcaatcgcgcggccttatcgcgcaaaccaccgacatcgaagccttagacgctttgttgaacgaacaaaaaattgccctttattgcggcttcgacccgaccgccgacagcctgcacatcggacacctgctgcccgtattggcattgcgccgcttccaacaggcggggcatacgccgattgctttggtgggcggcgcgaccggtatgatcggcgaccccagcttcaaagccgccgaacgcagcttgaattccgccgaaactgttgccggctgggtggaaagtatccgcaaccaattaacccctttcttgagctttgaaggcggaaatgccgccattatggcgaacaatgccgactggttcggcagcatgaactgccttgacttcctgcgcgacatcggcaagcatttctccgtcaacgccatgctgaacaaagaatccgtcaaacagcgcatcgaccgcgacggcgcaggcatttccttcaccgagttcgcctattccctgctgcaaggttacgacttcgccgagttgaacaaacgccacggcgcggttttggaaatcggcggctccgaccaatggggcaatatcaccgccggtatcgacctgacccgccgcctgcaccaaaaacaagtattcggtctgaccctgcctttggtaaccaaatcagacggtaccaaattcggcaaaaccgaaggcggcgcggtatggctgaacgcgaaaaaaacctcgccctatcagttctaccaattctggctgaaagtcgccgatgccgatgtgtataaattcctgaaatactttaccttcctgtccatcgaagaaatcgatgccatcgaagccaaagacaaggcaagcggcagcaagcccgaagcgcaacgcatcctcgccgaagaaatgacccgcctgattcacggcgaagaagcccttgccgccgcgcaacgcatttccgaaagcctgtttgccgaagaccaaagcagcctgaccgaaagcgacttcgagcagctcgccctcgacggcctgcctgcatttgaagtttcagacggcatcaatgtcgtcgaagccttggtaaaaaccggtttggcatcctccaataaagaagcgcgcggctttgtgaacagcaaagcggttttgctcaacggcaaacctgccgaagccaacaaccccaaccacgccgccgaacgccccgacgatgcctgcctgctgaacggcgaacacaaacgtttcggcaaatacactatccttcggcgcggcaaacgcaaccacgcgcttttggtttggaaataatccgattgccgcagaaatgccgtcattcccgcgcaggcgggaatccggacctgtccgcacggaaacttatcgggcaaaacggtttcttagattccacgttctagattcccgcctgagcgggaatgacgagtttcaagattacggtgttgtcggaacgcaactgaaccgtcattcccacgaaagtgggaatctagaatctcggggtttgagcaactgtttttatccgataagtttctgtgcggacaggtccggattcccgcctgcgcgggaatgacggcggagggttgtttgtctcggtttacctggttaaaaaagaacgattttcactgatgttgcatcaggtttggggcgatgtttcaacacatagcaccgcgcctgctgcgcgtttttgtgcgtttggcgcgttcggcggcgggaaatttgcctacttttcccgcgtcgggcgggcgtaacgggcggcacactgtctataaaccgcaataccgtttacaatgaccgcctgtttcaccacatacccgaatgcaacaatgagaatcaggctggggcggcacaacgcgcccgactttccacagggtgccgccgtaaccataggcaatttcgacggcgtacacctcggacacaaacacatcctccaaaaactccgcctcgaagccgacgcgcgcggactgcccgtcgtgaccgtcgttttcgaaccccaacccaaagaatttttcgcactccgcaccggcaggatgccaccgtgtcggatcagccccctgcgcaccaagctcgaattattggaaggcacaggctgtgtcgatgccgtctgggttttgcgtttcgatcaaaatttttccgaaatatccgcgcaagggtttatcgaccgcctgctgcgtcaaaccttgaatacgcgttatttgctcgtcggcgatgatttccgtttcggtgcggggcgggaaggctgttttgaacttttggcacaacagcccgatatgcagaccgagcgtacgccttccgtcatcgtcgaagacatccgcaccagcagtaccgccgtgcgacaagccctttcagacggcaaccttgcctatgcgaaaaaacttttgggacacgactacgtcttgagcggcagggtggtgcacggcagaaaactcggacgcaccttaaacgccccgactgccaacatccgcctgccccgccaccgttatgcactcggcggcgtgtttgtcgtcgaagcagacggcgcattcggcacgcggcgcggcgtggcgagtttcggcttcaatcccaccgttgatagcggctgttctcaaaagcttgaagtccacctgttcgactttcaaggcgacctgtacggacaagggctgaacgtccgcttcctgcacaaactgcgcgatgaggaaaagtttgacggtatggaagaactgaaaaggcagattgaagccgatatggaagccgcaaggcgttggtagaaaaaccttatacaaaccatccgattgggctacaatcaatcttttaactgttcagacggcacagggttttcccgttgtgaaatgctgtttggggcgcaatgccgtctgagaccgaaatattgtaacaatagagattaaaaaatgaccgattacagtaaaaccgtaaacctgctcgagagcccgtttccgatgcgcggcaatcttgccaagcgcgagcctgcatggctgaaaagctggtacgagcaaaaacgctaccaaaaactgcgcgaaatcgccaaaggccgtccgaaatttattctgcacgacggcccgccgtatgccaacggcgacatccacatcggtcatgccgtcaataaaattctcaaagacatcattatccgcagcaaaacccaagccggttttgacgcgccttatgtgccgggttgggactgccacggcctgcccatcgaagtgatggtagaaaaactgcacggcaaagatatgcccaaagcacgtttccgcgaattgtgccgcgaatacgccgccgaacagattgcccgtcagaaaaaagactttatccgcttgggcgtgttgggcgactgggaccatccttacctgactatggatttcaaaaccgaagccgataccgtgcgtatgctcggcgaaatctacaaatccggctatctctaccggggtgcgaaaccggttcaattctgcttggactgcggttcttcgctggccgaagcggaagtggaatacaaagacaaaatctcgcccgcgattgacgttgcctatctgtttaaagacactgccgcgcttgccgccgcattcggtttggctggtttcgaaggcaaagcgtttgccgtcatttggacgactacgccttggacgctaccggcgagccaagccgtgtctgcgggtgcagacgtggtgtatcaactgattgatacgccgaaaggcaaattggtattggcgaaagatttggcagaagacgcgctcaaacgttacggtttttcagacggcattgctattctcgccgaaaccaccggcgacaagctggaaaatctgcacatgaaccatccgttcctcgaacgcgatattcccatgctcaacggcgaacacgttaccaccgatgccggtaccggcttggtacacaccgcccccgcgcacggtttggaagactacgccgtctgcaataaatacggcatcgagctttacaaccccgtcaacgccgaaggccgatacatcggcgaaacgccgcgtgtcgccggtatgcgcgtttgggaggcgaaccccgtcatcctgcaatggttggaagaaaccggcaaccttttggcaagcagtaaaatcgaacacagctacgcccactgctggcggcacaaaacgccgctgatttaccgcgcgacaggtcaatggtttgtcggtatggacaaagccggtgccgacggcaaaaccctgcgcgacaaagccatcaaggccgtggacgacaccgaattcttcccgtcttggggtcgcgcgcgtttggaagccatgattgaaggtcgtcctgactgggtggtttcacgccaacgctattggggcacgccgatgactttctttgttcacaaagaaacgggcgagctgcatccgaactctgccgaacttttggaaaaagttgccctgaaaatcgaagaaaaaggcatcgaagcgtggttctccctcgataagagcgaactcttgagcgcggaagattgcgaaaattacgataaactttctgacacaatggacgtatggttcgactccggctcgacccattattccgttgtgaaacaacgcgaagaattggaatggccggctgatttgtatctcgaaggcagcgaccaacaccgcggctggtttcaatcgtccatgctgaccggctgcgcctcatcaatgggtcgcgcgccgtataaacagctgctgacccatggtttcgttgtcgacggcgaaggcaaaaaaatgtcgaaatccatcggcaacgtcgttgcaccgcaagaggtttataacgaattcggcgcagacatcctgcgcctgtgggcggcatctaccgattacagcggcgaattggcgatttccaaagaaatcctcaaacgcgtaaccgaaagctaccgccgtatccgcaataccttgagctttttgtttgccaacttgagcgactttaatccgattgaagatgccgtgcaacaggcggatatggtggaaatcgaccgctacgccgtggtattggcacgtcagctgcaagagtgtctggcaggcgattactatccgcgttatgccttccactttgccgtaaaagacattgtttctttctgctcggaagacttgggtgcgttctacctcgacatcctgaaagaccgcctctacaccaccaaagcagacagccatgcacgccgcagcgcacaaactgccctgtatcacatcacacgcagtttggttctcttgattgcaccgattttgtgcttcaccggcgaagaagcgtgggacatcatcggcggcggcgaagaagacagcgtcctcttccatacttggcacgagttcccgaccatcaacgaaaaaaccgaagccgaactggtgaaaaaatggacggcaatccgcgaagcccgcgaagcggtaaccgccgccatcgagcctttgcgcgccgacaaaaccgtcggttcgtccttgcaagccgaagccgaaattaccgcgccggaagaaatggccggctatctgaatgctttgggcgaagaattgcgctttgctttgctggtgtctaaagcagaagtgaaagtaggcagcgaacttgccgttgccgctaaagccagtgatggtgaaaaatgcgaacgctgctggcactacacccgcgatgtgggcgcggttgcaggctatgaaaccgtctgcaaacgctgtgcagagaatgtcggcggagaaggcgaaacgcgccattacgcctgataaagtttgagcaaatgccgtctgaaaccgccgaacagcatttcagacggcattttttgtgccgcgatttgtctttataacggcggaggggtttcaagattgcggtgttgtcggaatgcaactgaaccgtcattcccacgaaagtgggaatctagaatctcgaggtttcagtcatttccgatagattcccgcctgtgcgggaatgacggatttcgagattacggtgttgtcggaacgcaactgaaccgtcattcccacgaaagtgggaatctagaatctcggggtttcagtcatttccgatagattcccgccgcgtcggaggtctggattcccgcctgcgcgggaatgacgggtttcaagattgcgctgttatcgggaatgacggatttcaagattacggtgttgtcggaatgcaactgaaccgccattcccacgaaagtgggaatctagaatctcggggtttcagtcatttccgatagattcccgccgcgtcaggggtctggattcccgcctgtgcgggaatgacggatttcgagattgcggtgttgtcggaacgcaactgaaccgtcattcccacgaaagtgggaatctagaatctcggggtttcagtcatttccgatagattcccgccgcgtcaggggtctggattcccgcctgtgtgggaatgacggatttcgagattgcggtgttgttggaacgcaactgaaccgtcattcccacgaaagtgggaatctagaatctcgaggtttcagtcatttccgatagattcccgccgcgtcggaggtctggattcccgcctgcgcgggaatgacggatttcgagattgcggtgttgttggaacgcaactgaaccgtcattcccacgaaagtgggaatctagaatctcgaggtttcagtcatttccgatagattcccgcctgcgcgggaatgacggatttcaagattacggtgttgtcggaatgcaactgaaccgtcattcccacggaagtgggaatctatagtggattaaatttaaatcaggacaaggcaacgaagccgcagacagtacaaatagtacggcaaggcgaggcaatgccgtactggtttgaatttaatccactatagaacgcggggtttgggcaactgtttttatccgataagtttctgtgcggacaggtctggattcccgcctacgcgggaatgacgggtttcgagattacggtgttgtcgggaatgacgggttttaagattacggcatttgccgtttcgggtacaggaaagggggttttcgggtaaaatggtactcttttaccggctgttgaaaaatatgtcttcatctgtttcaagtaaaacgcgctattgggtattggcacttgccgccatcgtgctggaccagtggtcgaagtgggcggtgctgtcgtcgtttcagtatcgggaacgcgtcaatgtcattccttcctttttcgatctgacgctggtgtacaacccgggtgcggcgttcagcttccttgccgatcagggcggctggcaaaaatacttttttttggtgctggcggtggcggtgagcgcgtatttggtacgcgccatcttgcgcgatgagtttgcaaccctcggcaaaacgggtgcggcaatgattatcggcggtgcgttaggcaatgtcatcgaccgcctgatacacggtcatgtcgtcgatttcttattgttttattggcaaaattggttttatcccgcctttaatattgccgacagctttatctgcgtcggtgcggtgttggcggtgttggacaacatcgtccaccgtaaaacccaagaagaaaaatattgatgccgtctgaaaacgaaataccgggcttatgaacgagaaaaccatcatccttgccaatccgcgcggcttctgcgctggtgtggatcgggcaatcagtattgtcgaacgtgctttggaagagttcggcgcgccgatttatgtgcgccacgaagtcgttcacaacaaattcgtcgtggacaacctgcgtgaaaaaggtgcggtgtttattgaagacttggcggaagtgccgccgggcgcgacactggtttattcggcacacggcgtatcgaaggcggtgcggcaagaagcggcggagcgcggtttccgcgtgtttgatgcgacttgcccgctggtgacgaaagtgcataaggaagtcgcccgactggatgcccaagactgtgaaatcatcatgatcgggcataaggggcacgtcgaggtcgaaggaacgatggggcagcttgcgccgggcaaaatgcttttggtcgaaacggtcggagatgtggcaaaactcgaagtcagaaaccccgacaaactcgcctatgtcagccaaaccacgctctcggtcgatgaaaccaaagacatcatcgccgcgctgaacgcgcgtttccccaatatccgcaatccgcacaaggaagatatctgctatgcgacgaccaaccggcaaaccgccgtcaaagagttggcagaacagtgcgacatcgtgattgtggtcggttcgcccaattcgtccaacagcaaccgcttgcgcgaagtggcggcatcgcgcggaatcgatgcgtatatggtggataatgcaggctacctgcaacgcgcatggtttgagggcaaaaacaaagtcggcgtaacggcaggcgcgtccgcgcccgaagtgttggtgcgggaagtactggcaaccatacgcggatgggggcacgaaaccgtacgcgaaggcgagggtgcggaagaaagcattgtgttcgtcctgcccaaagagttgcgccgcgagggcgaaaccaaacccgatttgtgcaaacgttgacgcaggcgttgaatgtttgggcaacacaaatgccgtctgaacaggcttcagacggcatttttgccgtgtgccggatgcggaaaccaatcaggcgtaatgttgtgcaagaaaaccgggcagttcggacaaaccgtccaatacggcgagatgcggtgcgctaaggagctgttcgcgcgaatgtgcgccggtggccacgccgactgccgccgcgcctgcgtttgccgccatatgcaggtcgtgcgccgtatcgccgacgaccaatgcctctttcgggtcgagtcccagttcgccgcagattccgaataccatttcgggcgagggtttggagggatattcccccgcgcaggcggtggcgagccaatagccgccggtggcggtttgactgatggcgttgtccaaacccgcccgccctttgcccgtggcgacggcaagccagtatccttgtgctttgagcttgtccagacagggcagggcatcgggaaataaggacatattgcggttgttgggattgaggtaatgtgcggaataagtgcgtgtgatgtcggcaacggcggtttcagacggcatttcgagcagggtgcggatgatttcgggcaggctgtagccaatcaggctgcggacgcgttccgcttcgggcggcggaaaaccgcattcggcgaagctgcggcgcatggtgtcgatgatgggttgggtcgtatcggcaagcgtgccgtcccagtcgaagatgatgagtttgggcgtggtcatagcaggttggttgcagtaaaaaagcaaattttatgcggaaaacgcagacgtgtcgcattttcgacaaaatttgtcggctgcgcgatatgtttttccgaacaagccgcgttgcgctttattaaaatagaaccattatcatttatgtgaatgggacagtttatgtcagttttccgcatcaatatgaccgccgccacggttttggcagcactctcgtcttcggtttttgccgcacaaacggaaggtttggaaaccgtccatattaagggtcagcgttcttacaacgcgattgccaccgagaaaaacggcgattacagctcgtttgccgccaccgtcggtacaaaaatccccgcttctttgcgcgaaattccgcaatccgtcagcatcattaccaaccagcaggtcaaagaccgcaatgttgatacgtttgaccagttggcacgcaaaacgcccggcctgcgcgtgttgagcaacgacgacggacgctcttcggtttacgcgcgcggttacgaatacagcgaatacaacatcgacggcctgcccgcgcagatgcagagtatcaacggcacgctgcccaacctgttcgccttcgaccgcgtggaagtgatgcgcgggccgagcggactgttcgacagcagcggcgagatgggcggcatcgtgaatctggtgcgcaaacgcccgaccaaagcgttccaaggtcatgcggcggcagggttcggtacgcacaaacaatataaagccgaggcggacgtatcgggcagcctcaattcagacggcagcgtgcgcggccgcgtgatggcgcagaccgtcggcgcgtctccgcgtcccgccgagaaaaacaaccggcgcgaaaccttctacgcggcggcggattgggacatcaaccccgatacggttttgggcgcgggctatctttaccagcaacgccgcctcgcgccgtacaacggcctgcctgccgatgccaataacaaattaccgtccctgccgcaacacgtatttgtcggcgcggattggaacaaatttaaaatgcacagccacgacgtgttcgccgatttgaaacattacttcggcaacggcggctacggcaaagtcggtatgcgctattccgatcggaaagccgattccaattatacgtttgcgggcagcaaactcaacaataccggacaagccgacgtagcgggtttgggtacggacattaaacaaaaagcctttgcggttgacgcaagttacagccgtccgtttgccttgggcaacaccgccaacgaatttgtgattggtgcagactacaaccgcttgcgcagtactaatgaacaagggcgttcgactttgtcaaaaagcgtcgctttagatggtttccgcgctttgccttataacggcatacttcagaacgcccgcgccggaaacaaaggtttcaatcactccgttaccgaagaaaacctcgacgaaaccggtttgtatgccaagacggtgttccgtcctctggaaggtttgtcgttgattgcaggcggacgtgtaggacatcacaaaatcgagtcgggcgacggcaaaaccctgcataaagcttcgaaaaccaaatttacaagctacgccggcgcggtttacgatatagacggcagcaacagcctgtacgcttccgcctcccaactctacacaccgcaaaccagcatcggcaccgacggcaagctgctcaaaccgcgcgaaggcaaccagtttgaaatcggctacaaaggcagctacatggacgaccgcctcaatacccgggtttcgttctaccgcatgaaggataaaaacgccgccgcaccgctggactcaaacaacaaaaaaacccgttacgccgcattgggcaaacgcgtgatggaaggtgttgagaccgaaatcagcggcgcgatgacaccgaaatggcaaatccatgcaggttacagctacctgcacagccaaatcaaaaccgcctccaattcgcgcgacgaaggcatcttcctgctgatgcccaaacacagcgcaaacctgtggacgacttaccaagttacgtccgggctgaccatcggcggcggcgtgaacgcgatgagcggcattacttcatctgcagggatacatgcaggcggttatgccacgttcgatgcgatggcggcataccgcttcacgcccaaactgaagctgcaaatcaacgccgacaacatcttcaaccgccattactacgcccgcgtcggcagcgagagcacctttaacattcccggttcggagcgcagcctgacggcaaacctgcgttacagtttttaaagaccaatatgccgtctgaaacggcagccgcagcatcatcaaactacaacaagctgcgcggcataccctatgctctcacaactggagtatggcattgcgaaggaaaatagaccgaaccggcaggcagaccgctttgccggttcggttttaccgcttgccgccagtctgacccacaagccgaacatcatgaaacccataccgaccgacacattccaacctgccatactgccccaagcctttgaaaccgaaatcaaatccacctgcacggggcgaatctatcggattcagacggcaacactcggcgaaataccgtctgaaggctatcccgtcctctttgtcctcgacggcgaagcctttttccccgcacttttcaacatcatgcagtcgctgatgaacaaccccgttacccgaagcaacgccccctgcctgattgtcggtatcggctacacgacaggcagtgtgcgcgatttggcacaacgtgccgccgactacacgccgccgcttggagacaacgccacagcagacgaacggcagcagttcggacaggcagaccgcttcgccgcctttatcgacagcgagctgaccgcctttttagaaagccgctacaccctcaaccgcaatgaaaccgccgtattcggacactcgttcggcgcactgttcggactgtattccctgctttcccaccgccgtttcagacggcattggctcgtatccccatcgatttggtggcacaacaggcggatactcgactttatgccgtctgaaaaccggctaaacggcatcgatgtctgcctcaacatcggcgcgctagaacggggtagcgattgtaaacgcagggaagaacgcgatatggcagggcaggccgaacaaatggcggcagagttagacaggcacggggccgccgtctttttccgggaatatccgaatgccgaccacggcaatgtcccgttctactcgctgaccgattgcgtcgaatatttgaggaaggcttggcagaggtagggggaattaaatatatgactgctttgttttgcatcggaaaataacaagagctacctaagggttattgctccctttctcattttattttgatataaaaatccctgcttcaggccgtctgaaacagggataggttaatttaacggacgggtgggcgttttttcaggcggcacggtctgatttctttgcccggtttgtcgatttggtatttttggagtgaaagggcggttttgataccgatactttggaaaatgccgtttttccctttggtgctgtctgtgtcatgcacacggatatcaatcgtcccggttgctctatttagactggcgaaataaccaaaaaatacgtttttcttggcagttacttttattcaatcattcgaataaagtacgaatgaaaccggtttttgggcttcagacggcatttatattttgggttaccagttgacgcgcaccgaccggctgccgagcaatgtttccagttcgccgaacaatgcggagctcggtgtaaccgtccatttcggcggcacttgaagcctgcccgacgctttttcgttggcatacgacagttgcagcgggatgcgcggcgtgtcgggcagttggtgggcggcgagcagccgtaccagtccgccgatgtcgtgatgcggggcgagggcgaggctgaggctgcgggcgtagcgttcgcgcgccgtttgcagggtcatgacttggtttgccagaatacgcagcccgtcgccgccgccgtagtcgtcgcggctgactttggattcgataatcagcacttggtcggctttgaggcagtcggcgcagttttccaacgtctgaccgccgaccatgatttcaacctgtccgctcaaatcttcgaggctgacgaaggcgattttgccgcgtttgcccatcatcgtacgcacggcggtaacgaatccggcgaggcgcacgctgtcttgcggcttcagacggtctaatttggtcggtgcgatttggcggacttcttgggcatacgggccgaacgggtggccggacaggtaaaagccgatgacggttttttcttcggcgagtttttccgattcgctccacatcggcgcgtcgatgagccgcaccggttcgatggcgtcttccatcatgtcgaaaagcccgccctgattggcgttggcggctttttggtcggcgttgtccatagcgaggtcgatgttcgccaagagcatggcgcggttgggttcgatgctgtcgaacgcgccgccgcgtatcagggcctcgagggtgcggcggttcatgtgttctttgccgacgcgctcgcagaagtccaacagaccggtaaacttgccgccgctttgccgcgcggcggtgatggattcgacggcggcttcgcccgtgcctttaatcgcgccgagcgcgtagcggattttcatgtccggatacggcgtgaagcggtagtcggattcgttgatgtcgggcggcaggaactcaatgccgttggcgcggcagtcgtcgtagaaatgcttgagctggtcggtgttgtccaattcggacgacatggtcgccgccataaattcggcggggtagtgcgctttaagccatgcggtctggtaggaaatcagggcgtaggcggcggcgtgggatttgttgaaaccgtagccggcgaatttttccatgtagttgaagatttcgtcggatttttcgcgcgaaatgccttgttttgccgcgccttcggcgaagatttcgcggtgtttcaccatttcttcgggttttttcttacccatggcgcgacgcagcaggtccgcgccgccgagcgagtagccgccgataatttgcgccgcctgcatcacttgttcctgatacaccataatcccgtaggtcggcgcgaggatgccttcgagtagcggatggatgtattggaattcttgccccttcatacgtgcgacgaagtcgggaatgttgtccatcgggccggggcggtagagcgatacgaaggcgatgagttcttcaaacttggtcgtgtgcgccgttttcagcatttttttcatgccggtcgactcaaactggaagacggcggtggtgttcgcatcgcggaagatttggtaggcgacctggtcgtcaagcgggattttgccgacatcgatgatgtcgccggtagtgtttttgatgttgttctgcgccatttcgataatggtcaggttgcgcagacccaaaaagtcgaatttcaccaaacccacatcttccacgtcgcccttgtcgtacatggatacgggcgaggcggattcgtccgcctgatacacggggctgtaatcggaaatcttgcccggcgcaatcaacacgccgcctgcgtgcatacccaaaccgcgcgttaaatcttccagctttttcgccagcgtaatcagttcgtccgcttcttccgcttcgattaattcctgaatctgtggctcggtctccatggctttttccaaactcaggggtttgttggcttccaacggaatcagcttggacagtttgtcgcacagcataaacggcagctctaacacgcgcccgacgtcgcggatgaccgctttggacgacatcgtgccgaaggtaacaatctggctgaccgcctccgcgccgtatttctcgcgcacatattcaatcacgcggccgcggttgctttggcaaaagtccacgtcgaagtcgggcatagaaacgcgttcggggtttaggaaacgctcgaacagcagcgcgtatttgagcggatcaaggtcggtaatcttcaatgaatacgccaccagcgaacccgcgcccgaaccacggcccggcccgaccggacagccgtgtgttttcgcccagttgataaagtcttgtacgataaggaaatagccggggaatttcatttggatgatgatgttcagctcaaaatccaaacgttcctgatattccggcatttttgccgcccgctccgcctcgtcgggataaagctgaaccatacgttcctgcaaaccctcgttggagagtttgatgagatagtcatcgagtgataaaccgtcgggcgtggggaaaaggggcaggaagtttttgcccaatgtgatgtgcaggttgcagcgtttggcaatttctaccgtgttttccaaggcttcaggcaaatcggcgaaacgttcggccatggtttccggcggaatgaaaaactggcccggcgtgaaatcgcgcggacgtttcttgtccgtcaatacccagccgcctgcgatacacactcgcgcctcgtgcgcgttgaaatcgtcgcggctcataaactgtgtcggatgcgtcgccaccaccggcaaacccaattcctccgccagcttcacgctgcccgaaacgcaagcctcccattcggggcgttcgggtaggcgttgcagctccatatagaacgcatcggggaaccacgccgcatacttcaacgccgccgtacgcgccgcgtcttcattgccgttcaacagattcacgcccacttcgccgtaatgtgcgccgctcaaacaaatcaagccgctgttgtcgccgttttccagccattcgggattgagttccgcatgatggacattgcggtctttgccgacataagccgccgtcagaagctcgctcaagcgcagatagcccgcatcgttacggataatcagcatagcgcggaacggcttgtcgggcgcatccggattgcctatccgcacatccgccgcgccgataggcttaatccccgcgctgcggcaggctttataaaatttcaccaaaccgaattcgttcatcaaatcgctgatgcccaaagcaggcaaaccgtattcctgcgctttggcaatcagttttttaatccgcaccataccgtcggtaatcgaaaattcggtatgcaggcgcaggggaatgtaggtcggctcggtcatggcaaaatcggcgtggacaataaaaggcgtattgtagcagggttgtctttagatggcggtgtaggtaatgccgtttcgggttcagacggcatgacctgcaaatgtttttgagcttttactacggcaaaaaaatgcctcctgccgtatggcggaggcttcccaaggagtattgatagatataaaggactatcaaactagttataaagaactatatgccttattcggacggatggcaagcagttaaattaattttacgttcaaacaggtttttgatttcgttttgatgccgattgccggtgtatcgggcagttcgcgtttgaggatgtgcatcagcgtcaatgcggattcgtcggggaacaggatttgcagtctgccgttgggcaggatttctttgaacggatggcggcatatggggtttcagacggcatttttacttttacggaacaggcggtgcggatacatcgccggtttttcggtaattttgggtacggcggcggcaggtgctacaataacggcctctttctgcaagggaacattatggaagccactgtctatctcgaagacaacgaatacatcgccttgtgcgacctcttgaaattggtcggacttgccgaaagcggcggacaggcgaaagcgtttatcgccgaagggctggtgttgcgcaacggcgaaaccgaaacccgtaaaaccgccaaaatacgcggcggcgaagtcatcgagtttgacggcgctcgcttggaaatcgccgatggatacgaccctgaagtataaagccgaagcccttttgggcgagccgcttttagacgaacccgtccgacccgagtcgtgggaatgctgcggcagcgactgcggcgaggcgtgcattcagacgatttactgggcggataaagccaaatacgacgtgcaacggcagaaattgaaagaagcgggttggtcggacgatgccgtctgaaacggttcggcttgatatagtgaattaacaaaaatcaggacaaggcggcgagccgcagacagtacaaatagtacggaaccgattcacttggtgcttcagcaccttagagaatcgttctctttgagccaaggcgagccaacgctgtaccggtttaaatttaattcactataaaaccacgttttcagacagtcttttatagtagattaaaactgaaaacgtccatatcgtcattcccgcgcaggcgggaatccggaagttcgaaatagcggttaaccttaaatatttttgacaaatcaaggtctggattcccgcctgcgcgggaatgacggcatagggacttttcctttgcatttgccatacacctgtttgttgaaatcaccgctgtatccacaccaaccgataatattaacccccgaccttcattcacaacacacataacaccccatgatagacctgcactgccattccaccgtttccgacggtatgctctcccccgccgaagtcgtgcgcctcgcgcatcaaaacggctgcacgctgctggcgttgaccgaccacgaccacaccggcggcatcgccgaagcgcgcgccgaagccgacaagctcggtttgcgcctgattaacggtgtggaaatctccgtaacgtggcgcgggcgcaccatacacgttgtcggtttggatttcgacgagcaggacgaaaacctgcaaaacctgttggcgcaagtgcggaaaggccgtctgaaacgtcttgaagccatcgccgccaagctcgaaaagaaaggcatcggcggcgcatacgacggcgcgctggcactggcggcaaacaaagaaatggtcagccgcacccacgtcgccgagttcctcatccaagcgggacacgtcaaaaacaagcagcaggcgttcaccaaatacttgggcgacggcaaatcctgcgccgtccgccacgaatgggcgacgctggaagactgcgtctccgccgtcaacggagcgggcggcatggcagtcatcgcccaccccatgcgctacgatttgtccgccaccgccaagcgcaatttgtttgaagaatttaaaaacctcggcggcgcaggcatcgaagtccacagcggaaactgctgcaaaaacgaccgcctcaactacgcgcttttggcagaacgcttcggtatgctcgccagcgcgggcagcgacttccaccgcttaaacgacttcagcggcggcatcctcggcgcgtgtcccgagctgccggaaaactgcaaaccggtttgggaacatttttcccgatattgaatgcagataaaaatgccgtctgaaaacttttcagacggcattttttgcgttttaaacgttgtcgtacagttttcggacggttttaccgatggcggcaatgcctttttccagcgtttgagcgtcctgcgcgatgctcatgcggatgcactcgcccgcatgcgggtaatcctgcgtgtcgatgccgacgaagaaatgttcgcccggaataatcagtgtgccttcggctttgagcatttcgtacagggtttgcgaagaaacgggcaggttttcaaaccagagccacaggaaaatcgcgccttcgggtttgtggattttcatcgggtacgcgcccagctcccgcttgagcagcgagacggcggtttgcgcctgattgcggtaaaacggccggatgacttggtcggcaagccgtttcatctcgccgctttccagcagcggcgttgcgatggccgcgccgaagcgcgtgggggcaaggttcacaatcgcgttcaggctgctgacggctttgacgacttcgggcgcggcgacgatgatgccggtgcgcacgcccggcaggccgactttggacaggctgaagcagaggatgatgttttcgtgccaattcagcgttacgtcgctgtaaatgatgttggggaacggcattccgtaggcgttgtcgataatcagcggaatgccgtgttcacgcgccaaagcgtccaaacgcgccatttcgccgtcggtcaacacattgccggtcgggttggtcgggcgcgaacagcaaatcgcgccgattttgcccgctttgagttcgggcaggttttccagtgcgtcaaagtccacgcggtatttgaagaagccggcttcgccttcgtgttcgacgttttcgattttgggcttgacggaaacgaagtgctgcccttcgacatgcacgtcggcatagccgatgtattcgggcgcgagcggcaacaaaatggctttttctgcggatgtgccgtctgaaaggttgaatttgccgccgaagaggttgaaaagatagaaaaacgcgttttgcgaaccgttggtcagcgcgatattgtcggcggtcagattccagctgtattcgcggttgaggaaggcggtcagcgcgtcaatcagcacggcatcgccttggggattggagtagttgccgatgttttcgacggcgtgttctgccgccagtttggagaatatgtcggcgaacgcctgatcgatttccggaatgcgcgccgggttgccgccgccgagcatgttgacgggcttgtcgcttttgagcgcgtcgccgaggtcgtccatcagttggaggatgccgctgtgttgcgtgaatttttcgccgaatgctgagaactgcatgtcaaactccgtgtgtgtaaggtaggttggtttgtacgttatgccgtctgaaggttcagacggcattttttctgtgtgtttctcgtacccaaagcaggtcgcagatgccgtcgctcggggcaaagccggtcggggcgttgatgagcagggtgcggattgcctgctggtcgtaacggtcgcaggccgcacggatgcggtcgagcagggcggagagctcgtgccacggcagcatggtctcgttggcggtcatgatgcgcggatggccggttttgcggacgttgtcgccgatgagcagctcttcgtagagtttttctccgggacgcagtccggtaatgaggatttcgatgtcgccgtcgggttgttcgggtgtgttgggtttgaggccgcttagggtaatcatttggcgggcaaggtcgatgattttgacggattcacccatgtcgaggacgaatacgtcgccgcccgtacccatcgcgcctgcctgtatgacgagttgggcggcttcgggtatggtcatgaaataacgtgtgatttcggggtgggtcagggtaagcgggccgccttctgcaatctgtttttcaaacagcgggacaacggagccggacgaacctaaaacattgccgaaacgtaccatgctgaagcgggttttttgtccgggttcggcggcgagtgcctgaaggcagagttccgccatgcgtttgctggcacccatggtgttggtggggcggacggctttgtcggtggagatgaggacgaaagttcttacgcccgatgtcgtggcggcaagcgcgcactcgagtgtgccgaagatgttgttgcgtatgccttcgacggtgttgaactcgaccatggggacgtgtttgtaggcagcggcgtgatagacggtcgcaacggaaaaggcggtcatgacgtgttcgagcagcgtgcggttttgcaccgaaccgagaaagggcaggatttcggtgtcgaggcgtttttggatgcaggtttcgcgcaattctttttcgatggcgtacagggcgaattcggataactcgaacagcagcagcttttcggggcggcggcggataatctggcggcagagttccgaaccgatggagccgcccgcgccggttaccatgacggttttgccttcgatgtcggcactcatcaggcggtcgtcgggcgcgacggaatcacgcccgagcaggtcggacacagagatttttttgagcgtgccgatgctgatttttccgtccatcaggtctttcattccgggaatggtcaacacttcgcacggataggcttccagtttgttgatgattcggcggcgttgttcctgggtcgcgccggggatggcgagcaggattttttccacgccgtagcgttcgatgaggaaggcgatggcatcgggctggtaaacggcaaggtcgtagatgacggtgtgccacagtttggggtcgtcgtctacaaaggcggcggcggaatattcgcgcatttgtttgacggcctcaagcagttgtctgcccgaccgtcccgcgccgtaaatgatgacagggatcatctgttttttggggtgttcggacaacagtccgcgcaaaaccatacgcgagccggtcacggaaacaaacagcagtaagaaatagacaatcggcagggcgaggcgcagcctttcttcaaatatcagcgtattgaggaaaaacaacacggcggaggcgaggctgcccgccagtgcggtggtgaggatgcggaagctgacgaagcgtgtaacggcgtggtaaagccccattcggataaataatgtgatggtcagcaaggcagtcagcaaaaaagactgccagttggcaaaatcgaaccattcgtccgagtagtcggcctttaggctttgggtgaaccaaaaggcaatgaaaatcatcagaaaatcgtgtatgaggaaacagattttcttgatgttgcgcggcagggcgatcagagtttccagattcatatcgtggggcggtatgtgttttcaggcggcatatgccgtctgaagggttatcgtgcggcttcggtcaagacggcttcgatgtgttttttgcaaaacgcaatttcgtcgtcggtcagcgtcgggtgcaccaagaacatcaggctggtgtcgcccaactcgacagcatttgtcaaacgctctttcggtcgccacggcgtgttgtcgaaggctttttccaaatagacttcggagcagctgccttgatagcaggggactttgcgcgcgttcagttcgccgacgatgcggtcgcgcgtccagccgtctttgaggtgttcgggtttgacgaaggcgtagaacttatattgcgcgtgtccgatgtagtcggcgacttcaaccaagcggatgctgctgaatttgcccaaactttccgccagcttggcggcgttttctcggcggcgcgccgtccattcgggcaggcgtttgagctggatgcgtccgatgaccgcctgcatttccatcatacgccagtttgtgccgaaactttcgtgcagccagcggaaaccgggcgcgtgttcgtggttgtacacggcatcgtagcttttgccgtggtctttgtacgaccacattttttcccacagggttttgtcgttggtcgtaaccataccgccttcgccgccggtggtcatgattttgtcttggcagaacgaccacgcgccgacgtgtccgatagagccgacggatttgcctttgtattttgcgccgtgcgcttgggcgcagtcttcgattacccaaagattatgttcttttgccaaagccataatgccgtccatttcggcgggcataccggcgaggtggacgacgatgacggctttggtagtcggtgtcagcgcggctttgacggtttccgcgctgatgttttggctgttcaaatccacatcggcaaacacggggtttgcgcccgcgttcacaatgcaggacgcggaagcgaggaaggtgcgcgaggtaacaatcacatcgtcgcccgcgcctatgcccattgctttgagcgcgacatcgagtgccagcgtgccgttggcaagggcgacggcgtaccgcgtgccggcaaaggcggcaaattctttttcaaattcgcggcattcgttgcccgtccagtagttgactttgttggacagcaggactttggaaacggcatcggcttcttcttgggtgaagcagggccacggggaaaggaaagtgttcagcatgatggtttgtccgtcggttttcagacggcatttccgaccctatgccgtctgaaggggggcgtgttccgaagaatcgggcgcgcgccgcaggtgttgtcaaaatcggtctgtacgggggtgtattttaatcgcttatgctgtcgaggtctcggggtttttgcgcggcagcggctttgccggattgcccgcgacggtcatgccgtctgaaacgtcgcgtacgacgactgcgcccgctccaatggttgcgcggctgccgatacggatctgctggcggctgcacgcgcccgtgcctatccagctttcttcgccgatatgcgtgttgcccgacaggtgcgcgcctgggctgatgtggacgaaagcgttaagcaggcagtcgtgatcgacggtggcggcagtgttcacaatcacgccgtctttcaatacgctgcctgcctgtacgacggctttcgccataacgacgctgccttgtccgactgttgcagaaggcgagacggtcgcgtccggatgaaccagaacgggcagggcgaagccgagcgcggcggctttttcggcgatttggcggcggatgcggttgttgccgacggcgacggcgacgtcgtattgttcgggcgataaactgttttcaagcagcagcgtcgtgccgatgacggaaaagccgttgacgctgccttgtgcgcggtcgtccagaaaaacgatttccctgtaccggccgagtgcggcggcaaggtcggcaacgacttttccgtgtccgcccgcaccgacgacggcgagtttgcgttttcctgtgaaagggggcatggtggcttcgccctgtgcggaaatcccttccttgattaatacttttttaaccgtcagcagtaggattttgatgtcgaggcacaggctgaagtggtcgatataccaaacatcgcaggcgaatttttcgtcccacgaaagcgcgttgcgcccgttgacctgcgcccagccggtaatgccgggtttcatttcgtggcggcggttttggaagttgtcgtacagcggcagatattgcatcagcagcgggcgggggccgaccaggctcatctcgccttttaagatattccataattcaggcagttcgtccaaactggcggcacgcagttttttgccgaacggtgtcaggcgttctccgtcgggcagcggaatgccgtctgaatcaagcgcgtcgcgcatggaacggaatttgaccattttaaaaggttttccgtcctttccggggcgttcctgaaagaagaagacgggcgaacctagattcttgcggatgaggtatatcaaaatcaaaaatactggcgagaggaaaatcagtcccgaggcggaggcaacaatgtcaaacaggcgtttgaagaatttactcatttgccaatctttcaatcaggttgacgattttccgataggaaatgtcgcgcctgaagcggcggacgatttcgtcggactgaacggggtcgtttttgcacgccatttggcaatcgatgatatcgtgcccgtgccgcccaagcctgccatagatgtggtcaaaacgattttcataatgggaaaccttgttttttcaaataatgaaacagtttgtgcaaatctttccggtggcgcaggatgcagcctgccagatatgccgcccatacgccggcaaacaggggatagtttgccggcgtgccgaagcaggtgtaggccgccgaggaggtcaggcagaacaatgtgtgcagataaagcggcaggcgtttgagcggctgccacaggcggcaggagctttcggtcttgaaggcaaaaaacagccagaatgaggcggcacaggcaaccgccgcgccgcgcgcgccgccggacggcacggcaagccccagcagcagcaggtttgccgccagcgcgcccaaggtggcgagcgcgatcgggcgcgttttgcggacgacgttcaaaccgatgccgctgatttccgccagcgtgcaaaacagcggcggcagcatacacgatacgacgataaaccggacggcggcgtagttttccggcagcaggagggaggcaaggggcgagaaaatgccggtcaggcagagggcggaggcaagcagggcggcggcggattctgccgttgccgagaggcgggcgggcggggcgttttcttcgattgcgcggaaaatatacggtgtccagaccgttgaaaagatgctttggaacaataatgccgccccgccgaacgaaatacccatcgaataaacgccgagctgttccaggccggcatattttttcaggaacaaacggtcggcggatgccagcccccaataggcgatgctgctcagtgcgatcggtatgccgtagcgcagcccccggtgcaggacggcgggcgaaaacggtgcgtgccggacggccttcagacggcatcggttttgaaacagcaaaaaggcggcggcggcaaggtttgccagcgcgtaaacggcggtcaggacggcggtgttcgctggaaagtgcagcagcccgaccgtcagcggcagcagcagcaggatggcgagcttgggcacgagttgcgcggacgaaaaggcaagggcgcgtccttccatacgcaaaaccagtaagagaaagcggatgggcaggaagctcagttcaaacagcaccagcccgatgccggcggcggcatcgtcgagtgaaaacaggatttcagacggcagggacgggcgggaaagcagcagggcggctatcgcggcggcagacagcagcggcggcaggaacagggttttgaacaaggtgtctttgtcggcggtggcatagtattcgcggacgtatgcctgatccagcccgaggcacaacaccgacaccgtcagccccgccgccgtctgcatcagcacgatgcgcccgatgtcgtcggcggggaaataccacgacagcagcggcaggatgatgacggctaaaaccgcgctgccgatcgagcctgccgcgtagccgaggatttcttttgtgtccatttttgatgtccgggcggcggcgggatgctgcctgtgccgtctgaagcctttcttgatcggaatttgacggctttcagaccgtcgcggctgccggcggggtgcggcagtccgggttgcgttttttcgggcgggcggcggtctgaacggggccgttttttatcggcgttattatatagtgaaacggcgcaaaccctttaaaaggcgttgccgttttttcggaacacggttttgatgttgtgtccgaggatttcgcttgaaacgggtgtccacaagggcggtgcggaaagggcggcgcggttttcgagcagggaaaacaggtctttgccgctgccgaggattttgggcgaacggtacaggacgatttcgtctgccagattttctgccaaaaatgcggatgtgagttcggagcctgcttcgaccatgatttcgccgaaaccttcgtcagcaaggaggcgcatcaggtggtgcaggtcgattttgctgtctgccgtttcagacggcatcaggatgcggacgtgtgcgtgttcccgataggggtgcagtctgtcttcgttgcgttcgagtgtggcgatgtaggtcggagattgtccgtcggtaaccaaatggctgttcgggggcaggcgcaggcggctgtctaaaacgatgcgtgcgggttggcgcaaagttggaaaagcgcggacgttgagccggggattgtccgccaacaccgtgccgatgccggtcagcaccgcgcagctttcggcacgcaaaacctgtacgtcggcacgcgcgtcttcgccggtaatccaaaagctgctgccgtctgaaagggcggttttgccgtccagcgaaacggcgcatttgaggcggacaaaggggcggcggcgttcgatgcgcgacaggaagcctcggttgagttcccttgcctgatgttcgagtaaaccgcattccgtcttgatgcctgctgcttcgagcagggcaagccctttgcctgcaaccagcgggttggggtcgcgcatggcggcaacgacgcgggacacgcccgcccgcaccagtgcttcggcacagggcggtgtgcgcccgtaatggctgcacggttcgagggtaacaaaggcggtcgcgccttgtgccatttcgcccgcctgacgcagggcgtggacttcggcatggggttcgcccgctttgacgtggaagccttgcccgacaatttggctgccgtgtgcgataacgcagccgacgcgcggattgggcgaagtggaaaaacgccccaaagcggcaagtcggagggcgttttccatcatggatatatctgtgtccgaaaacatagggataccgtatcagtatgggttgggggaatcaggctttgccgcctgttttgacggcttgcgccagccacgaggcaaagtctgccggattgtcgaagcgtttgtgcagggcggcgaaacggacggcggcttccgtatcttgtcggagcagttcttttagcaccatgtcggcaagtgcggcagaggggatgtcgcgctgacccgaagtgtagagcctgtgttccgtcaggcggacggtttcgtcgatctgttcgggtgtcagggcggattttcgggcggcggcggtcaggtcgttgcggaggcgttgtgcattaaagggcgagcgttttttgtccggaccgatgacggcgggcattttgagttcggcggtttcgagcgtgccgaagcgtttgccgcagttggggcagtggcggcggcggcgcacggcgttgcgttcttccatcagacgcgaatcggcaacgcgggtgtcggggtgggcgcaaaacgggcatttcatcgggttcgtcctcctatgtcgtctgaagttcagacggcgacgccggcggcgcgggcgatttccagaccttcttcggcactcatatagacggggttttcgggacggtcgtgtcggacgatgttgccttcgcggaacatgaccagttcgtccacggcaagttgggaccatgattcgtcgcgggtcagtggcagggtggcgataacggcgacgcggtcggagggcgtggttacttcggcaaaatcgaccatcacgtcgtcgtcgagcaggcgcgccttgccgaacggggcttggcggacgatgtagtgcagcagcgtgctggcgtgggcaaacagggcaatgccgtctgaaagcataaagttaaacagcccgaacttgcggatttcgtgcgtcagccccgcaatcgcgtcaaacagcgtgtcgtcgtcgggacgggcggcaaagcgggtgcgcaggcggttgaggatgtggcagaacgcgcgttcggaatcggttgtgccgacggggtggaaaaattcgccctgttcggggaaaaaatcaatcaaatgtccgttgtgggcaaacagccagtagccgccccacatttcacgcataaagggatgggtgttcgccagcgaggtttgtccttgcgatgctttgcggatatgtgcgatgacgttttccgatttgatttggtaggcacgcacgaggtcggcgacgggggaatttacgctcggcttgtcgtcgtggaacaggcgcacgcctttgccttcgaaaaagccgataccgaaaccgtcggcatggtggtcggtaatgccgcccctgcggcggaagccttcaaaggaaaacataatatcggtcggcgtattgcagttcatgcccagcagttgacacatggtttgtcccaatgattcagatggtcgcaagtattcggattataccccgaactgaaaatgccgtctgaaatacggcttgttccccattattccctcgaaaacagaaaacagaaaacaaagacggaaacttaagattccgtcattcccgcgcaggcgggaatccgacttgtccggttttggttgtttttcgttccgtaacttttgagccgtcattcccgcgcaggcgggaatctggaatttcaatgcctcaagaatttatcggaaaaaaccaaaacccttccgccgtcattcccacgaaagtgggaatctagaaatgaaaagcaacgggaacttatcggaaacgaccgaaaccgaacggactggattcccgcttttgcgggaatgacggcgacagggttgctgttatagtggatgaacaaaaaccggtacggcgttgtctcgccttagctcaaagagaacgattctctaaggtgctgaagcacgagtgaatcggttccgtaccatctgtactgtctgcggcttcgtcgccttgtcctgatttttgtgaatccactatagaatttcaatgcctcaagaatttatcggaaaaaaccaaaacccttccgccgtcattcccacaaaagtgggaatctagaaatgaaaagcagcaggaatttatcggaaacgaccgaaaccgaacggaccggattcccgcttttgcgggaatgacgaggttttaagttgctgttttggttttctgttttttgtggaaataacgagattctagggttgcagaaacttctccgaaacaacaaaaacctctccgccgtcattcccacgaaagtgggaatctagaaatgaaaagcaacgggaacttatcggaaacgaccgaaaccgaacggactggattcccgcttttgcggagaaagatgatggaaaatcatcatcgtgcgtcaaacccgcgcggcagcacatcggcagaggaaatcagagatacggttgcagggtgcggcggaggatgtccgtgtcggtaatttcggtgatgttggcttcgcccagccggttcagaccgataaagcgcatgatgccgccgctgacttttttatcgtggctcatgtgttccagccatttttcaaaggcaaacacgggtggcgcggacggcagtccggcggcttcgagcagggcggcgagccgcgcggtatctgcggcggaggttttgcccagttgttcggacaaacgcgccgccaacacgcagccggcggcgatggcttctccatgcagccaagtgccgtaacccatctcggtttcaatggcgtgtccgaaggtgtgtccgaggttgagccatgcgcgtatgccctgttcggtttcgtcttgggcgacgatgtctgccttcatttggcagcagcggtacacggcttgggcgagtttttcccgatcgagcgtcatcagttcgggcatatgctgttccagccattcaaaaaagccgatgtcgccgagcgcgccgtatttgatgacttccgccataccggcggacaattcgcgggcgggcagggtgtgcagcgtgtccaagtcggcaagcaccgcctgcggctggtaaaacgcgccaatcatatttttgccgagcgggtggttgatggcggttttgccgcccaccgatgagtcgacctgactcaacagcgtggtcggtatttgaacgaacggtgcgccgcgctggtaggtggcagcggcaaagccgaccatgtcgccgatcacgccgccgcccagtgcgattaatgtggttttgcgttcggcgcggttttgcatcagcccgtcaaagatgaggttgagcgtctgccagtttttgtgcgcctcgccgtcgggcaggatgatgctgaaatgggatacgcctgccgcatccaatgccgtctgaagcgtgccgaggtagagcggggcgacggtttcgttggcgatgatggcggcgcgtttgcccaaatgcggtttgagcaggcttcctgcctgcggcagcagtccgttgccgataaagatggggtagctgtgggacggggtgtgtacggtcagtgttttcattgttgttccttaaagtttgaaccgccggcccgccgggcggggcgcggtttggttttctgggcgcggcgcatatgccggtttatcgggataagcgtttgagcagggtttgcacggtttcccggcagtttgccgattctacggtaaagtcggcggtttggcggtaaacggggtcgcgtgcggcgtagagttcacgtaatttcgccaaaggatcggcaacttgcagcaaaggacggctgttgtcgcagcgcgtgcgttcgagcagggtttcgggcggggcgtgcagatagacgaccgtgccgcttttgcggataagggcgcggttttcttcttttaacaccgcgccgccgccggtggacaggacgatatggggcaggataaccagctttttgagtatggcggtttcgcgcgaacggaatccctgttcgccttccatttcaaatatggtggggatgggaacgccggcggctgcggcgatttcgtgatcgctgtcgtaaaaacggtaatccagccgctgcgccatttgccggcccagcgtggttttgcccgcgcccatcagtccgatgaggatgagtttgccgttaaagtttttcatcacaattccttaatgtttgacaccccgcctttcggggcgacagggttcgggcttgtcgggttacggcggaattttatacgaaatcggcagggcggcggtacgtttggaaaaataacccgaccatcccgaacctttctgattttaaggacaaataaaagaaatcagggaggttttttatttcaggctgtgttttgacaatccgttgatttcacttatttgtcaggaaaaggcaattatctttgcttaggtaaacaattatccaattgaatatattgaagataatatgtttatcaatactatagtggattaacaaaaaccagtacggcgttgcctcgccttggctcaaagagaacgattctctaaggtgctgaaacaccaagtgaatcggttccgtactatttgtactgtctgcggcttcgtcgccttgtcctgatttttgttaatccactataaagaccgttgggcatctgtcgccgtcattcccgcgcaggcggaaatccgaacacgtccgcacggaaacccatatcccgtcattcccacgaaagtgggaatctagaacgcagggttggagaaaccgttttatccgataagttcctgaaccgacagacctagattcccgcctgcgcgggaatgacggggttttaagttgctgtttcgggttgctgttttttgtggaaatgacgaggctttgggttgtgaggatttaccccttccgccgtcattcccacaaaagtgggaatccagaaatgaaaagcaacaggaatttatcggaaatgaccgaaactgaccgaaactgaacggactggattcccgcctgcgcgggaatgacggcatttcggtcgcggcaaaaagcataaagaaagggcatatgccgtaaaacatatgcccttattttgacgcatcaatagcgcaggctgttgccggccgtacccataatcctcggggtaatgaaaatcagcagttcgcggcggtcggtttttttcccgcgtgttttaaagaggttgccgataacggggatgtcgcccaacagggggactttggtcagcgtattgccgttgtcttcttcataaataccgccgacaatcaatgtgccgccgttttcaaccatagcctgcgtattcaggtttttggtcgaaatacacaggatcgtctgattaccggaggcacattgcgcaggcgagtccttgttgattttgacggtcataatgatttggccgtcgggcgtgatgttcggcgtaacggtcagccccaagacggcttttttgagttccgtgttcgtgctgctgccgccgttcgcgattgaggttacggtgaaaggaatttcgtaaccggattcgattttggcctctttgcggttttgggtcagcacgcgcggattggcaagcgttttggtttttgaaagcgattcggatgcggacaattccaaattcaaggcaccggaggaaatcgcgcgcaccagcgaaatgctgtttgcggcagcggtaatcggcaggttgattttggtttcggccccccatttatcgtcgccgccgaagccggagtttaccccccagccgaatgcgcttgtatcatttttcagctttttcttgcctgtcgcgccgaatttaacgcccaaatcgcgcgagaagccgtctgccgcttcgacgatacgcgcctcaatcatcacttgttgcgcgggtacgtccaattcgtcaatcagtttgcggaatttttcgatgacgctgcgggtgtcggtaacaatcagggtgttggtggcgggatcgatcagcacgctgcccctgccgctgataagcgtgttgcggtttccggtcgtgtcggcattgtccaaacgcaggatgctgcggaattcttccacatttttgtatttcaactggaagttttgggaatacagcgcacccaaatcggcaatgtctttttctgcctgtaagagggctttgtctttggcaagcagctcgtcgcggggcgcgatgttgacgatattcccttgctggcgcatatcgaggttgcgcgcctgcataaccaaatccaaagcctgatcccaaggcacatccttgagggagagggtcattttgccgttgacggagtcgctggcaacaatgttcattccggattcttttgccaaaattgcaggatggtgcggatttcgacatcttggaagtcaagggagatttccggcctgtgaaggttttgggcgcattgttcacgccgcctgactcgaggttttgttttttcggcaggacttggaaggtaaagtatccgggcgcggcggatttgttgacgagttcccagttgccggctgttgtgataatcagctgggtgtcgttattgaggcgtttcagcgtaaccttttgaaccggtgttttaaagtctgccacatccaaactgcgttggagcgtggtcggcagggtatggtttttcagcgtaacgatgatgtggtcgtgctgttggctgatgtcgggctgcccggcaaagcccaatgcagccaattcgataatgccggcatttttgccgtctttgcggaaatcgatattggtttgttttgctggtgctgccgcctgttgttttgctggtgctgccgcctgttgttttgctggtgctgccgcctgttgttttgctgatgccgccgcctgttgttttgccgggctgaacggtgcggatacggatactacggactcggtaaacggtgcggcagcctgttgttttgccggggtaaagggttcggatacggatactgcggacttggtagacggtgcggcagcctgttgttttgccggtgcggcaggcgcggcttttacggcggggcgtgcgggggcggacacggtatcgtccgattcgttaatgaatatccaaactttgttcccgcgtacttcggtattgtattggcccggtttgttcagattcagaaccagacgcgcacggctgctgttttgtgcggcactgattttgctcaacagaggatcggcatattcgagtacctgttgatccatggaaatgccggtttgttcaaagtccaaggcgatgcgggccggtgaggaggttacgaagccggtcgggttgacaatctctttgtcaaagctgactttgacgattttctgtttgttgggcagggaggaaactttgatgtctgtaatgtttcctgccgatgctgtctgaaaggcggcggttgcgacaaagagaccggaaatgatttttgtcagtttggtattcataatggagtaatcctcttcttaattttgttctgcggcaggtgctgccgcttgttcggtgtttttgtcggaagaattcaacagcagttctgctttacgggaaacccagttgcccgtgctgtcttctattagctcgttcaggacgatgctgtcgtcggtaatgctttcgattctaccgtagttttgtcccaaatagttgccgacaccgacagtgtagacataaccttcagcctcgatgaagccggagactttctgtccggacttcaaaatgccgacataacgcatattttccaaactgaatttttccagcgtttctttaatacgcttggtgtcgggggcattttccccttttttgtcggtttccatgcggcggaagtcgaatgcgttcggccctgtaagctgcggcgggctgtataccggcgcaaccggcagggtaggtgcttggaaaggtatgatttctgctttggcttcgcgtcgcgtttgtgccatccattcgtttaggtcctcagaaccttgggaacacgcggagagagccagaaagctgatgagtaaggcatagtgtttcatggtttccctaacgtaagttatttttgctcggcattttgtgccgcttctgcggcaagctcttctacggattttgcttggtaggtggtggcaatggcgctgaggttcaggatgctgctcttgccgtcaggattgccgccgttttccggagattgggcgattttcagcgactcaagggtaatgattcgggagaggctgccgacatcgcgggtaaattggctgatctgttcgtaatttccggtaatggaaatggaatagggtaatcttttgatggggccgtcatctacgggaggttggggcataacgctgtccaagcgcagaccgttgctcgaacctgcctgatgaagctcttgaaccagattgggaatttctgcatctgtcggcagctgtttcaacatgatatcgaaggcagagcggattgaggcaagttcgtccctcaggttgttcaggctggccgcgtcgatacttttctgtttgtaggtgtttttcagttcggtttcttttgcttcgtattcctcaagggattccatctggcttttgaacaatccggcataaccgagccccagcacggcggcaacggccagcagggcgataaaaagcctggcaggaaggttgagcaggtgaaggttgttgagatccaagttggttttagatgatttagaagccattcagtttgcctcctgtgcgtttcccgaagccggattctctttggattcggccgcctttacgatgggttgtaatgttgcctgaagggtaaattcttgatgcgaattgtttttcttgatgcttaacaattcgggttgcttgaatatgccggtattgggcatcgccctcatcatggcggcaacgcggttgtcgctggatgtcctgccgctgagccgataagagtcggcggtaacggcatccagcgaggtcaggtaggtgcttccggggacggcctcattcaggctgtcgaggatttttgcggcttggaggcgtttgagctggagctcctcgattttgtttttcttaatcaggaaggcatctttttcctgtttgagcttttgtatttccgacagctcggtatccaagtgtgcgatggaggtttccagcagcgtgtttctttccgactggttattgatcatattgtcgataaacaggtaggttgccgcaacggcggcaacgcccgtcagcacggcaccgtacatcagcgttttaaactgctgctgtttgcgcttgttcatctcttccctgtaggggaggaggttgattttgattaaattgttcataattataatccccgtaccgccaaaccgaacgccctggtcagtgtcggcgcatcaagttcgaattgttgtttgtctgttttgaggttgtccgcaaaataacgcgcgggatggacgcattgtacatctgcattggtttgtgaggcgacggtttgggcgatgccttcctggcgcgccgcttccccggtcagcaggatatgcttgatgtcggtcatatcgtctgcggtctgcgtggtgtaataaaactgcaagaccctttgtatttcttgggtaatctgctggttgaaatagtttgccacgctttcttggtaatcggaaggtttttgcggggagttgatgatttcttccgctttttcttctgttacctgataggtgcgctggatgagttggttgagctgttcttcgctgacggaggtttcctgtttgtataggatttttccgtcttggatgaccaaggcgtaggtctgtgcggcatatacgccgaaaatggcgactttttcggctgcaagctcgggggcgaaatggtttatccatagcgcgtaggcgttgtattgtccgaaaatgtccacatcaagcgcggataatttcataccggcggcgttgaatgcgtcaatcaggggttcgatttcatcctttctcgatgcgacggccaacacagcttcgccggcggccgattgggacaagacctgatagtcgtaattggcttcttcgagcgatatcgagctgacttcggagatggaggactccacgaacccctgcaggtctaattctgcatctttgtctgtgtaggtcaattgttcgatggttgccaaattttgcgggacggacgcgatgatgtttttgcacgaagtacccagtttggcataggcttgttgcaaatatgtaacaagttgatcgtaattttggactttattgccttgaatgatattctttggtaatttggcaatgacgtatttttccaattgaatttggtttaaactacgtcctgacaattggaccattttgatggaatgctggtcgatatcgatgccgattgccgcgcggttattgagtcccgaagattttttagggagcttggcatctgtttttttagggtttttcaagcttttaaacaagcgcatgatgaaagttcctgctttatttgtacagtgagtaaccgtttcggtatccgtaatggattccttgttctttgcacattgaaaccgtgctttgtagaaatcggttgctattttactttatttaataccaataatggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgcgttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggctgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaaagactccgcaaaatgccgtctgaaagacttttcagacggcattttagatttggcagtggcaattttttaaatgtttgcggtcggtcaagtggggggaatacggtttccgtataattggggtcagttttcctctggagaggaagcggcggcatctgctgcgtccaaccagcttccgacagttcggttggcctcgtcaataccttgttttttcaggctggaaaacagctgtacgctgatgttttgcctgtcggaataaggtttgagcagttttttgacttgggacagggtttttatctgttcgtttttggataatttgtcggcttttgacagcaggatgtgaaccggtctgccggtcgtgtggaaaaaatccagcatacggatgtcgagttcttttaaaggatggcgggcatccataatcaaaaccagcccgataagctgtttgcgctgttgcagatagtcgccgagcagattgacccaatgtgcgcgtactgcttcggggacttgggcataaccgtagccgggcaaatcgaccataaaattgccgttctgcagctcgaagaagttgatatgctgcgtccgtccgggtgtttttgaaacgtaggcaagacggacatggttggtcagggtattgatggcactggattttccggcattgctcctgccgacaaaggcaatttcgagaggggtgtcgggcaggtctttaaggtggttgatcgtcgtgaagaatttggcgttttgaaaaaggttcatgggcatatccttgttttccgccgccgtttgtccgacagcaaaaatatgcggttggttttatgtgaaacacagtggtaatttaatgtaaatttagtatagaataacacgtttacagaatcatcggttttaatcgggtcaaaaatcccgtatttgaatataaaaagagcattgttgcgttatccaatgctgtaatcaggagcactccatgaaacgattgactttattggcctttgttttggctgccggtgcggtttccgcctctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacggtaaacgcacccacggttcggcagctgtgatgaaaccggtggtaatgaatttgagcgatcaggatattttgaacgtatccgcattctatgccaaacagcagcccaaatccggtgaagccaatcctaaggaaaatcccgaattgggtgcgaaaatctatcgcggcggtttgagcgataaaaaagtgccggcgtgtatgtcctgccacggtccgagcggtgcgggtatgccgggaggcggaagcgaaattcaggcttatccgcgtttgggcggtcagcatcaggcatatattgttgaacagatgaatgcctacaagtccggtcagcgtaaaaataccatcatggaagatattgcaaaccgtatgtctgaagaagatttgaaagcggtcgccaactttatccaaggtttgcgttaattccgcaatagtctgttttagaggccgtctgaaaagttttcagacggcttcaggcaattctgcgataagttttttcaatcgcaaccgttggaatcgatgcaggctgtcttcattgtcttgaaataaaaagcatcaagacagtagaatcgggacgttgttttctgtttgcccaattctgctttcccatattcctgatggcggaataaacacacaatgagtaaatcccgtagatctcccccacttctttcccgtccgtggttcgcttttttcagctccatgcgctttgcagtcgctttgctcagtctgctgggtattgcatcggttatcggtacggtgttgcagcaaaaccagccgcagacggattatttggtcaaattcggatcgttttgggcgcagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcagggaaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctgaatgccgacaacgggatattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactgaacactataaaacccttccggaacacgagctgctgattcagaagtctttgatcagcaatctgaatctttgggattgggtatttgccgtgctggtttttgcggctacggttttcgtacagacccgttccggtatgcatatggacatttacgaaacggtcatgttgtgggcaagtgccggtattgccgtgtttttgggttggtttttcaaaccgatgcgctggtttgttcctttaagcgtattgcttgcctatgccgccgtcggtttgtacggaggcgacatcaaatcggcagagattttcctgttgcggtatttcctcagcagccagtcggcgatcatgtggcagtgcgcctttgtctttttcgccctgttcgcctatatttcgggcgcggttttggcaagcgtaaaaaatgtgccgaccaacacgctgttgggtatgggaaccgtgtttgcatgggtgtctgccgtagcaggctttaccggtctgctggtacgttggcacgaaagctatctgctccgtcccgatgcggggcatattccggtttccaacctgtatgaagtgttcatcctgtttttggtgattaccgcgctgatgtatctttattatgaaggtaagttcgccatacagaaattgggcggcttcgtgttcggctttatggcggtcgtggttggatttgtcttgtggtacagcgtgtcccgcgaggcgcataccatccagccgctgattcccgcgctccagtcctggtggatgaaaatccacgttccggcaaactttatcggttacggcgcgttttgcatttccgcgatgctcggtattgccgaactggtttccctgcgtgcggaaggaaaaggcggaaaactgtggctgccgccgtcggcattgatcgacgaggtgatgtataaggcgattgccgtcggctttctgttctttaccattgccaccattttgggtgcgctgtgggcggcagatgcttggggacgctattggagttgggatccgaaagagacgtgggcgttcatcgtctggctcaattacgccgtttggctgcacttgcggctggttgccggttggcgcggcaaagtgctggcgtggtgggcgattatcggtttgttcgtaaccgcatttgcctttatcggcgtgaatatgtttttgagcgggctgcattcttacggaacgctttgatacggtgcgacgatgccgtctgaacggtcttcagacggcatgttccgtttttgggatacggcagtcgtgccgaaatccgctaaaatacgtttttcagtttttaacggcatcagaccatgttggtattaggaatcgagtcttcttgcgacgaaacaggtgttgcgctttacgatacggaacgtggattgcgggcgcactgcctgcacactcaaatggcaatgcacgccgaatacggcggggttgtgccggaattggcaagccgcgaccatatccgccgccttgttccgttgacggaaggctgtctggcgcaggcaggcgcatcgtatggcgacattgacgcggttgcctttacgcaggggcccggtttgggcggcgcgctgctggcgggttcgagctacgccaacgcgctggctttagcgttggacaagcctgttattcccgtccatcatttggaaggacatctgctgtcgccgctgttggcggaggaaaaacccgactttccttttgtcgcgctgttggtttcgggcgggcatacgcagattatggcggtcaggggcataggcgactacgcgcttttgggcgagagcgtcgatgatgcggcgggcgaggcattcgacaaaacggcgaaactgctgggcttgctgtatccgggcggtgcgaaactgtcggaacttgcggaatcgggcaggttcgaagcgtttgtttttccgcgcccgatgattcattccgacgatttgcagatgagtttttcaggtttgaaaaccgccgtattgaccgccgtcgagaaagtgcgcgcggaaaacggggcggatgacattcctgagcagacacgcaacgacatctgccgtgcgtttcaagatgcggtagtcgatgtgttggcggcgaaagtgaaaaaagccctgttgcagacagggttcagaaccgtagtggtcgccggcggggtcggtgcaaaccgcaagctccgtgaaactttcggcaacatgacggtgcaaatcccgacccccaaaggcaagccgaaacatccgtccgaaaaagtcagcgtgtttttcccgccgacggcatactgcacggacaacggtgccatgattgcctttgccggtgcgatgcacctgggcaagggcagggaggtcggtgcgttcaatgtccgtccgcgctggccgctgtcggaaatcgtcagatgacaaaatgccgtctgaaattgttcagacggcatttttattttcgttacggcattttgtagcggttgtacataaacagatactgcgtcggaaaacggcgtatccaatattcggcattgcggttgaacacggcggcatcatgggctttgtcgccgttcaattccccttggacggggcggatgtgcaaatcgaaaccttgtccgccaggcaggcgttcgcagcagaaaaacagggttttcacgcctttgacgtgtgccaattttgccgccagcgtcatggtataggcaggtttgccgaagaaatccacccatacgccttccccgccttcttgaggggaggggacgtggtcgggcaggacgatggttgcttcgcccgaacgcagggctttgatgatttgtttgaccccttgtatgctggtaggcgcggtttttcctttgccgcgaaccctgcccgcctgcatgattttgtctatcgctttgattttcggcggtttgtacatggcggtcagcgggaacggaagctgctggctgatgtagcgtccgcccaaatcgtagctgccgatgtgcggcgtgatgaatagcagcccttcgtgtttgtccaaagcctgctgcacatgttcccagccgtgtaccgctttgaacattgtttctatgtcttccggttttctgaaaaacgcgggggcaagttccaaaccgccttttgccgtttccgcaaaaacggctttgaccgttttggggtcggggttcaaacccgcctgccgcatattggcgacgatgcgcgcgcggtcttcctttaaaaggtaaaacgccagatgtccgagccggtttcccagcgtgtgcagacaggaaagcggcagcagggagaggcatttgagcagggcggtcaacaggatgtgcatggcggttcgcaaagggggaaacagcctgaattgtaaacgaaacatgccgtctgaaaaagggaagtattgcggcaatatgccttttctgctacgatgcgtgctgcattaagagttgggaattccatgccaacctgcttttcaaaaggaaaagtaaggtggacggttgaaaagccgatgtggctcaccagagcaatccaaacccgcttgatgcgggaatttttttgcctgtaagaaacgtacgggcagagattccaaagtgctattcaaatgggaatatttctcaactgaatggtatgaatagggaaattttgctatatttcccgctgtcgacattatgttcatacaacatgccgtctgaagaagatggtttgtttttcaaggaaaatctcaatgagcgaatatctgtttacttccgaatcggtatccgaaggccatccggataaagttgccgaccaagtatccgatgcgattttggatgccatcttggcgcaagacccaaaagcacgtgtcgccgcagaaaccttggtcaacacaggcttgtgcgtattggcaggcgaaattaccaccaccgcccaagtagactacatcaaagtcgcacgcgaaaccatcaaacgcatcggctacaactcctccgagctgggctttgatgccaacggctgcgcagtcggcgtgtactacgaccagcaatcccccgacatcgcccaaggcgtgaacgaaggcgaaggcatcgacttgaaccagggcgcgggcgaccaaggtttgatgttcggctatgcctgtgacgaaacccctaccctgatgccgtttgccatctattacagccaccgcctgatgcagcgtcaaagcgaattgcgcaaagacggccgcctgccttggctgcgtcctgatgccaaagcccaactgaccgtggtttacgacagcgaaaccggcaaagtaaaacgcatcgacaccgtcgtcctgtctacccagcacgatccgtccatcgcttacgaagagctgaaaaacgccgtaatcgaacacatcatcaaaccggttctgccgtctgaactgctgaccgacgaaaccaaatacctgatcaacccgaccggccgcttcgttatcggcggcccgcaaggcgactgcggtttgaccggccgtaaaatcatcgtcgatacctacggcggcgcggctccgcacggcggcggcgcattctccggcaaagacccgtccaaagtggaccgttccgccgcttacgcctgccgctatgtcgcaaaaaacatcgtcgccgcaggtttggcaacccaatgccaaatccaagtttcctacgccatcggcgttgccgaaccgacttcgatttccatcgatactttcggcaccggcaaaatcagcgaagaaaaactgattgccttagttcgcgaacatttcgacctgcgccccaaaggcatcgtccaaatgctcgatctcttgcgcccgatttacagtaaatccgccgcttacggacatttcggccgcgaagaacctgagttcacttgggagcgcaccgacaaagctgctgcattgagggcggcagcggggctgtaattccggtttgaaaatcaaaaatgccgtctgaacagttcagacggcatttttatatagtggattaacaaaaatcaggacaaggcgacgaagccgcagacagtacagatagtacggaaccgattcacttggtgcttcagcaccttagagaatcgttctctttgagctaaggtgaggcaacgccgtactggtttaaatttggggctgtcctagataactagggaaattcaaattaagttagagttgcccctatgagaaaaagtcgtctaagccggtataaacaaaataaactcattgaactgtttgtcgcaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaaaacaattagtaaaatcgagtttgtcctagttatctaggacagccccttaaatttaatccactatattttcctgtttcaggctcggcgttctttgcacatcagtttcgcatccagccagccatcgccgccggagatgatgttgttggcaacgaagttgtccaagtctggcagcagggaaacggcgcggccgctgttgatgatgacgaccaccgccatcggtttgtcgcccagccaataacctgcaagggcgcggacattgttgagcgtgccggtttttaagcgcaacagcccgccgctttgtttgaagcggttgcgtaaagttccgtctgtgccggcgatgggtagcgtgtcgatgaaatcttgtgcaaacgggctgaaataagccgtttccaacatttgcgccatcattctcgccgttaccctttcttttctggacaggcccgaaccgttttccaaaaccaaatccgcaacatcgatgcccgatacggcaagttcgcgccggacggcagacgccgcctgttcggaaacggcgggcagtttgccgtcgccgccgagtttgaggaagacggaacgcgcaattagattgtccgaacgcttgttcatgtccgtcaaaatttctttcatcggtttggcgtgtgcaacggcaagtgtctgcgcgccttccggcgtgtcggctatgccgataccgtctgaaatccgtccgccgccgagcagccagtggttggtaaaactttgccggatcagttcgtcaagcgcgaacatccggacaccgacaggcttgcccaaacagctctcgggaatattgccgcgcaatttcagcgtattgtccgaaaaagatgcacgcatcagttttttgatcgaagggcaggcagcttgggaggcggtaattttcaagttgttttgggcgaaaatatgcggcaaaggcggatcggtgaggatgtcggtactgccggcggcattgcgttcggcgcgcaccataaccataccggcagacagcatagttggattggggggcgtcataaacggcgaaccgctgtcggcttcgaaatcgtcggggctgccgacttcgccccacaggctgtggtcgagcatcaggtgtcccgtgatattgagtatgccttgttcgcgcaactgtttttgagcatcaagcaggttttcctgattgaaaacggggtcgccgctgcccgcccaatataggtttccgtcaagcgtgccgtcgtttaccgtaccgttgctyytaaacycggtcgcccagcggtaattgctgccgaaggttttgaaggcggcaaacgcggtaacgagtttcattgtggaggcggggttgacggggacatccgagcggtggtcaatgatgacttttccgctgtcaagctcttggacatatacggcgatttcgttttgcggaatgcggccggtatcgagcgc

SEQ ID NO: 25 - DNA, 26778 bp, Neisseria meningitidis
  misc_feature (25318)..(25318): N is any nucleotide
ggcggcgttgaggccgacggcgacggttttgccgttgtctttgcggcgcagggtcagtgtgccgttgatttcgcctacaccaaaggataagaggtggcggcgggcaaagcgtccctgcattccgatgccgccaaagccggtttcgggggctgcgccggtgaggagttggacgacggacgcggttacgccgaccgtgccttcgtcgcgcgcgccctgcataaaggcttcgatgccgccgcgttcgggcagctcttcgccgtaaagtgctttcagacctttgataaccatcaggtacgcgcccgcgacggtcgggcaggaatgtccgcacaggcgcacggcatcggcgtagcggtaagtgaggatgccgttttcggccgcgccgaggaattcggccaatgcgtcttggacggtaatggtcggggcttggttgaagaatgatgggaaatgttcttgtgtcatatggtttgtcctttcggggcggcggccgttcagacggcatccgtcattttttgtgttttaaaacgagatagaggaaaacgagtccgccggcaaattctactactacgctcaacactgcctgcataccgagcaggtgttcgaacacggtctgtccgccgaccaagaggatgccgccgatacaaaccgtcatcggcaggcggacggaatgtttgaccgacggggaaaagtggttggcaagcgaggcggcgagaagcccgaaaaagcttacggggccgaccacggcggtcgccgtcgccaccaatgcggcaatccaaagcagtatccataaggtgttgcgcgtgtagctgatgcccaaattgacggcttggtcacgccccaaaaggtaaacgtccaagcggtagcgttcgcgccaaacgaccgccgcgctgacgagcagaatcagcgcgcctatgcccaaaagctcgctgtggacggtattgaatccggcaaacatattcgcctgcgcggcggtaaattcttcgggatcgatcatgcgcgaaagcagcgacgacaggctgcggaacaaaatcccgaaaatcacgccgattaaaatcatgcgcgacaaatcgcgtccgccctgtttgatgagcgtgtagaacagcagcagcgagccgcccatcatgacgaccagttcaaagccgaatttgcccgtcaacggcagggaagcatagcccacgccgccgaacgtaaacaccagcaaggtctgcaaaaacacatacagcgaatcgaaacccaaaattgaaggggtcagaatcggattattggtcagcgtttggaagagttgcgtggacacgccgaccgcataggcgaccatcagcagcgcggcaagtttggtcagccgcagttgcaaaacaaaatcccaatcgcctttgacgttgagcgtcataaacaggacgcaggaaaccagcaacagcgcaaaggcgacccacaacgggcggctgcttcctgccataaaaccgatatttttttcagacggcataggcgggtttcctcaacaaaagccacaaaaacaaagccgtacccaatacaccaaaaaccgtagagaccggaatttcaaacggaaacacaatcacgcgtccgataatgtcgcacagcaacaccaaagatgcgcccagcaaggccaccgcaggcaggctttggcgcaacctgtcgcccatcaggcggctgatgatgttcggcacgaccagcccgataaacggaatattgccgaccgtaacgataaccagcgacgtaatcaaagccacaataatcaaacccgaccacaacaccgccgtccggttcaaacccaaattcacgcttaccgtttcgcccagccccaaaatcgtcagccggtcggcaatcagataggcaaacaccgccaaaccgcccgtaatccaaagcagctcgtaccgccccagcagcacgctcgaaaaatcgccctgctgccacacgccgagcatttgcagcatttcgttttcatacgcgataaaggtggctaccgcctcaatcacaccgccgaaaataatcccgaccaaaggcaccatcagttgcgcggtcggcggcaggcggcggatcagcagcataaagaccaacatcccgatcagcgcggcaacggcggcaaccgacattttcgccggcagcggcgcggccggcagcagcagggtcatcagcagcaaacctaaagccgcgctttggcttgcgcccaccatcgacggttcgacaaaacggttgcgcatcaaaatctgcataatcatgccggccaccgccatcgacgcgcccgtcagcacaatcgcaaacgtgcgcggcaggcggctgatgaacatgacctgctggctgtcggacagtgaaaacacatcagaccagcggaaatcggcaacgcccaccgacaggctgacggcaaacaacaccgccagcagcagcaggttggtcaggttgagggaaaaaggtttggcagtcataaacagaagggaaaagcgttaaggcgtagaagattcaaacaaggcagtccgaaccgtcggagcggaaagccttgtttgaagcctccgtatcgggcaatgccgtctgaaacacaggaggcggtttgcatccgtgtttcagacggcatcgaatgccgccgtttcattattttgccgcgttaaaagcgtcggcaacctgtttgcttgcattcagcagctcttgcgcgccaccggctgccaaataagtttcaggaacgaggtacacgacctgtccttttttccaagcggttgtttcggcaaccagcggattatccaacacgtctttcgccgcctgaccctcttcgccgatggccgcgcttcggtcaaggacaaacagccagtcgggatttttctctttcaggtattcaaagctgataggctgaccgtggctgccttctttaattgattcatcgacagcgggaacgccgatgtctttgtgcagccagccgcccaagcgtgaagacgggccgaaagccgacatcttgccgccgttgaccaaaatcaccaaacctttgcccttaccttgtgcggcagttttcgcggcttcaaaagacgcgtcgatttccgccttcagcttgtcggcttccgcctgtttgccgaagatttgcgccagcgcgtcgatgcgctctttggcactttctttgaggttggcggtatcggcggtcatttcgatggtcggcgcgatttcgttcaatttgtcaaacgccttggcggcgcggctgccgatgatgatgagctgcggtttgtaagcgttgagcgtttcgtaatccggctcgaacaaagtgccggcaggttttgtcgttttgaaatattcctctaaatacggcaggcggtttttatcgacggacaaaccggttttcacgcccagtttgctcaaggtgtcgagcatacccaaatcgtaaacggcgatgcgttcggggttttgcggtatttgaacgtcgccgcgcgcggttttgacggtaacggacgcgccttcggtttgtgcggcggaaaccgcctgttctttggcttgtggggcagagtcggaattttgcggcgaacacgcgcccaaagcgagggcggtgcatacggctaaagcagtcaaacgtaacataggtgtctccaaaatggggatattggggcaaagccgccggtcggacaaaccggaacggctttagaaaggataaatgataatctatagtggattaacaaaaatcaggacaaggcgacgaagccgcagacagtacaaatagtacggaactgattcacttggtgcttcagcaccttagagaatcgttctctttgagctaaggcgaggcaacgccgtactggtttttgttaatccgctatattccgccatctctaagatttacagcgatacacgggtaatttaaggaatgcccgaaccgtcattcccatcacttttcgtcattcccatcacttttcgtcattcccaccacttttcgtcattcccgcaacctttcgtcattcccgcgaaagcgggaatctagaatctcggactttcagataatctttgaatattgctgttgttctaaggtctagattcccgcctgcgcgggaatgacggctgcagatgcccgacggtctttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatatcaaattatcagaacagatgccgtctgaaaggctttcagacggcattttttcgggatgtgcgttttagaacttgtagttcacgcccaagcgtacatcacgtcccacgcccggcagggtattggtccatcgttggctgtgcggatagtagaacgtgttgaacacgttgttaaccgaaagattaacattgagcgtgtctttgcccagcggtttccagttggcgaagacatcgttcacaccgaaacctttgcgtacaacgttttccaatttgccgttgcggtctttttgacctgccaccaatatcgaacccacggctttttgaacataacggccgcgccagccgatttccagattcgggttttggaagcggtaggcaagggaagccgtccaagtgcggccgacttgtgcgccaaattcaggattcgcgctcaacagcttgtctttgtgcgtatcgtaaaagcgcggtttgctgtggcttacgccgactttggcagtcaggccgccggtgcggtaggacgcgcccaattcgtaaccgtggtttttgatgtaaccggcattgacggcttcacggacggcgacagagtcgtggcggttttgcggattggcaagcgcgtctttgatggtctgccagaagtagctgccgtttgcggcaaacgtgccgtcgttgtagttgaagccgatttcggtattgcgcgcgcgttcggctttcgtgccgtcggcaatcgagatgatgccgcgtttgccgtgggtttgcagcgcgtcatacaggcgcgggctgcggctggcgtagttgtggctcgcgctgaagctccagtgttcgtgcggctgccaaatcacgccgaaactcgggttaaggttgttgcttgaaacggttttgccgtcgtgggttttcaccttgaagcggtcgtaacgcagcccgccggtcagggtaaagccgtcaatctcgtgaatggcttcgatatacgcgccggtatcggttttggtcgggttggtcagacggtaggctttggcaattttttcattttcacggttcttatttttctcttcatcagttgctttttctttatcttcaattttaaattgtgaattcaaaaacgcttgcggtttgatttcctgatggcggtagttgataccgtatttcagcagggtttgttcggcaaggcggctgtcgaagttgaagttcataccccgagtggtgatttgggtatggttggggccttttacattgcctgcgtaaccggtgccgctgtcatcggcggaatagcgttctttttccaacacataggcgttggcatccagtttttcgacaaagcccaggtttttacccgtgtacgccaaattggtgttggattgtgtggtttcgcggtaagcaggggcttggcgttccatacttattcgctctttatcgccgccgacggtaaattcttcacggacggtacggatgccccggtgctggtctttcatatggctcaatacgatgcggtggtcgccgtcgccgaagcttgttccgattttggcgaggtagctgcgtttgtccagcgcgctgtacggtacggttttgccgccgttgaaattattacggaagcctttacctgcttcgtaatctttttcattgttgcggttgtaagagaacaagccgtcgaagttgccctctttcccgaatacgcttgcgccgtagcttacgccttcgttgctggcaaagccgctgttgaggcgcacgccccagtttttatccaagcctttgagcaggtcttgggcatcgacggttttggtgatgatcgcgccgttggtcgcgccgataccggcagaggcggaacccgcgcctttttgtacggaaacgactttaaccaaagcgggatcgacaataaatctgccttggtggtaaaggatttggctgtcggaataggcgttgtccaccttgatgtcgacagagttttgacccatgccgcgcagcgtcaggaattgggacgtgccgttgccgccgccgaaatcgatggagggctcttcttttaagagttcgcgcatatcggttgcggtgctttcgtctttttgttgcagcgtaacgatgttggtacggattttgctgccttggcggtcgccttttacggtaacggtatccagtacgaccttggcattattttctgccgcatgggcaaaacctgccgccagggtaagcgagagcaggctgagacggaacaatggggtattcattcaatcgtcctcttgagtatgaagggaagtaaatccaaaccgttaagatttggcaggataagaaaaataattaataattatttttatttatattaacagggggggggggatttttgcaaagctgattatcgtttttatttgcgaagtgttgttttttgttgacaggttttgtcggaaatgtaaaaaaacggcgggaatatagtggattaacaaatgcgggaatgacgaagcctgcgcgggaatgacgaagcctgtgcgggaatgacggcggagcggtttctgttttttccgataaattcctaaaacttaaaatttcatcattcccgcaaggacagaaaaccaaaaacagaaacctaaaattcgtcattcccacgaaagtgggaatctagaatcccggactttcagataatctttgaatattgctgttgttctaaggtctagattcccgcctgcgcgggaatgacgatatttctgtttttgattttttgtttttggggaatgacgggatttgagattgcgggcatttatcgggtaaaacggaaattatgcgttacgaaaatttatccgaaatcacggcaacttttccaccgtcattcccacgaaagtgggaatccaggtctgtcggcacggaaacttatcgagaaaaacggtttctttatagtggattaacaaaaatcaggacaaggcgacgaagccgcagacagtacggatagtacggaaccgactcactcggtgcttcagcaccttagagaatcgttctcttcgagctaagtcaaggcaacgctgtactggtttttgttaatccactatagattttacgtcctggattcccgcctgcgcgggaatgacgaatttcaattttctgtttttgattttttgtttttacaggaatgacggtcttttcatatcgaaaaaagttgccgtaccgcaccgataatttccgcctgcgcggaatgaagattcaagcgttgcccgaaattcaaaaaaactatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttttgttaatccactataaaaccaaacggatcggattcccgtttttatgggataacggaatgttcagccggacaccaccacgatgctttcgatccgtttattttccgatacaaaacctcgaaaaaatcacgccgagcaggtcgtccgccgtaaactcgcccgtgatttcgccgcatgcgacctgcgccaagcgcaagtgttcggcaaacagctcgatttgatggttgccgcacaatgccgccagcgacaattcttcctgcgctgctttgagtgcgttgacgtgccgcgtccgcgccaaaaacaacccttcgctttcgccctgccaaccggcctcgcgcaacaacgtccgtttcagcgcgtccaagccgtcgccggttttcgccgacaacgcgatgacggtttccgcgcccgtaccgaacccgcctgccgcgtgtgcgtgcaaatcggatttgctgtggatttcgatgcgtttcaactccggcggcaacgcgtccaaaatcgcccgtgtcttttcattcaaaccctcgcgcggatcgaccaacaccagcgcgacatcggcttcggatacggctttgcggctgcgttcgatgccgatacgctcgaccacgtcgtccgtctcgcgcaaacctgccgtatcgacaatatgcaccggcacgccgtcaatcaggatacgttccctgaccgcgtcgcgcgtcgttccggcaatatcggtaacaatcgccacttcgtcgcccgccaacgcgttcagcaggctggacttgcccacattcggcgcgccgaccaatacgacattcagaccttcgcgcaaaatcgcgccctgctgcgcgttggcaagcacatcatccacggcgcggcgcaagccgtccagtttgccgcgtgcgtctgccgcttcgagaaaatcaatgtcttcctcgggaaaatctaacgtcgcttcgaccagcatccgcaaggtaatcaagtcttcgaccagaccgtgtatccgccgcgaaaaatcgcccttgagcgagcgcaaagccagacgcgccgccgaacggctggatgcgtcaatcaaatccgccacgccttccgcctgtgccaagtccagtttgtcgttcaaaaacgcacgcttcgtaaactcgcccggttcggcaaggcgcgcgcccaattccaaacagcggttcagcagcatatccatcaccaccggcccgccgtgtccctgaagctcgatgacatcttcacccgtaaaacttgccggtgcggcaaaaaacagcaaaagcccgctgtcgattgcctgtccgtccgtgtccgtaaaatcagcataggttgcggtacgcggcttgggcgttttcccgcacaaagcctgcgccatcggcagcaggtttttccccgatatgcgtatcacgcccacgccgccgcgccctggtgcggtagcgactgccgcaatcgttggaacgttatccgacataaaacccccgaaaattcaaaacagccgcgattatagcaaatgccgtctgaagtccgacggtttggctttcagacggtataaaaccgcaaaaatgcttgataaatccgtccgcctgacctaatatataaccatatgaaaaaacgaaacacatacgccctcctgctcggtataggctcgctgctgggtctgttccatcccgcaaaaaccgccatccgccccaatcccgccgacgatctcaaaaacatcggcggcgattttcaacgcgccatagagaaagcgcgaaaatgaccgaaaacgcacaggacaaggcgcggcaggctgtcgaaaccgtcgtcaaatccccggagcttgtcgagcaaatcctgtccgacgagtacgtgcaaataatgatagcccggtgtttccattcgggaccgttgccgccgccgtccgacttggcgcaatacaacgacattatcagcaacggggcagaccgcattatggcaatggcggaaaaagaacaagccgtccggcacgaaaccatacggcaagaccaaaccttcaacaggcgcgggcaactgtacggcttcatcagcgccatcctgatactgctttttgccgtcttcctcgtatggagcggctaccccgcaaccgccgcctcccttgccggcggcacagtgtttgccttggcgggtgctttcgtgattggaagaagccgagaccaaggcaaaaattaatgacaaatcctagggcgtgcttcatatccgcccgaacgccgaaccgcacatataggcacatcccgcgcgccgcccggaagcggaagccgcgccctcccaaacaaacccgaatcccgtcagataaggaaaaataatgaaaacaaccgacaaacggacaaccgaaacacaccgcaaagccccgaaaaccggccgcatccgcttctcgcctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcaacatcgttttacttataaaattgtgaaacggaataattataaagcagggactaaaggccatccttatggcggcgattatcatatgccgcgtttgcataaatttgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtgcgtattcttggctcgttggtggcaatacctttgcacaaaatggatcaggtggtggcacagtcaacttaggtagtgaaaaaattaaacatagcccatatggttttttaccaacaggaggctcatttggcgacagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccaacaccgcacgcctacaatcatttaaacgaccattggtcgcaaaaagagggcattcctcgcggggaaatcgtgtgggacaacgactggatcaaccgcacatttaaagcggaaaacttccaaattaaaggcggacaggcggtggtttcccgcaatgttgccaaagtgaaaggcgattggcatttgagcaatcacgcccaagcagtttttggtgtcgcaccgcatcaaagccacacaatctgtacacgttcggactggacgggtctgacaaattgtgtcgaaaaaaccattaccgacgataaagtgattgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggcacggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatccgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgtcgaaaagacagaaagcgttgccgaaccggcccggcaggcaggcggggaaaatgtcggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaactgcaaccccaaccgcagccccaaccgcagcgcgacctgatcagccgttatgccaatagcggtttgagtgaattttccgccacgctcaacagcgttttcgccgtacaggacgaattagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagcgcgggcgcgggttttagcagcggcagcctttcagacggcatcggaggcaaaatccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaaccgccggatatgccgaaaggggtctgacgatgccaccgtgcgctgtcaaaccctttttctgccgccgccttgtgcctgctccattgtctgataaccgtcaaattgatttttagcccatgtttggtgggtcggggaaatctatatcttcgtccgtgccgaaatagtctgagacctttgcaaaattcctttccctcccgacagccgaaacccaaacacaggttttcgtctattttcgccccaaatacctcctaattctacccaaatacccccttaatcctccacggacacccgataatcaggcatccgggctgctttttaggcggcagcgggcgcacttagcctgttggccgctttcaaaaggttcaaacacatcgccttcagatggctttgcgcactcactttaatcagtccgaaataggctgcccgagcgtagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgacaaataccggttgcgtttggtttgcgtttccgtcagcggacggttgcggcaggctttgcgcataatgccgtcctgcaactgatgttcttccagatgttgccggttttccgcactgtcgtagcctttgtcggcatagacggtcgacctttgggcagtccttccaacaaaggcggcaggtgtttgcactcatgggcattggcgggggtaatgtgcagtttctcgatatagccttccgcatcggtacgggtatgttgtttgtaaccgagtttgtagaggccgtttttctttatccaacgggcatcgctgtccttactcggtgtggtttggccgttgatttgtccttcctcatcgacttctatagcctggcgctgtttgctgccgacggtctgaataatggtggcgtcaacgacggcggcggatgctttctctacttttaagcctttttcggtcagttggcggttaatcagttccaacagttcggacagggtgtcgtcttgcgccagccggttgcggtagcggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcgggacggccgcggtggtctctaaggtaacgggttttttgacggttcaggtactgctcgatcggctgccaatcaatcacctggtccaacttcaatagcgggaaacggtcgatgtgtctggcaatcatggcttgggcggtttgctggaagaaggtgctcatggaaaatcccctaaatgtcttggtgggaatttaaggggttttggggaattttgcaaaggtctcagtctatgcccgatatacaattttgatacacaaacttggaaatatcggtatcgtcgccggagcgatagaatgcggacagtttttcattgaattgcggcatctgcatttcggagatttccaagatgccgcagccccccgccatcatcagaccgttggcaaataaggttgccgttcgtttgttgccgtcccaaaaaacctgctgccgcatacaataaagcataaaacggacggctgcctccgtcgtcgaaccgctttgcagtccgatattttgtaacacgcgggccacttcaatttccttcactggattcggggcatgacgggaaccgtccaatagcgttacgccgaccgaaccggtacggaaatcaccgggtgccaaagaatcgtccttggcaacaatgttgttgatttttttaaggagtgaaatatcgaccggttcgccgtttgaaatatgcgaaatcacatattgataggcacgtttcaggttcaagatggtttggatgtcttccagtgacgcggaggctacatttttgccatggataatttgttcggtctgcaacaaggtcgtctgacaattctcaaaacgactgaggttgtgaatttgggcaaccaatactttctttgccaaaaaaatattttctttcaaactcaacttgtatttgtcgggaaacacgataattccttaaataattaaagcagtacgttaaatcatcatcttatcatcactttcggggtttatgttgcgtgcgtccgttttctaatacggtttcccatcccgcgaaacgaggcggaggcctgtgcaaaaaacctgttcacgaaattttccgcattaacgatacgctgaaaatgcgctaaaaatgactgtgtttgaatatcggttgatttcatccgtttgtgtaacctcgcgccggttttgtcatgattttgcattatagtgaattaaatttaaaccagtacagcgttgcctcgccttaccgtactatctgtactgtctgcggcttcgtcgccttgtcctgatttttgttaattcactatatttttgtcatgcggatatttcacgggatgacaaaacgggcgcaaaaaagcccgattggaaaatccgaatcgggcttttttgtgatgttctgttcgatttgcgtactaactgccggccggagcgtccgcgcccggtttggcaggtcggattctcgaatccgacggctatttgagatggcaggcttttgtcggatacaagtatccgacctacggcttgcttttcgtcattcccgcgaaagcgggaatctagaatctcggactttcagataatctttgaatattgctgttgttctaaggtctagattcccgcctgcgcgggaatgacggttcagttgctacggttattgtcaggtttcggttatgttggaatttcgggaaacttatgaattgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcgaattgtcattcccacgcaggtgggaatctagtctgttcggtttcagttatttccgataaattcctgctgctttttatttctagattcccactttcgtgggaatgacgaaaagttgcgggaatgacggttcgggcattccttaaatcacccgtgtatcgctgtaaatcttagagatggcggaatatagcggattaacaaaaaccagtacagcgttgtctcgccttagctcaaagagaacgattctctaaggtgctgaagcaccaagtgaatcggttccgtactatttgtactgtctgcggcttcgtcgccttgtcctgatttttgttaatccactatactataggaacatttagaaaaaatataccaaaaattaaattttatttaaataaagatagcatataacacctttcaatcaatgtgcctcttcccaattctcccctacgccaacctcagccaccagcggtacatccaataatccgccgtccactttcgccataatctgcggcagtttttctttgacaaaatccagttcggtttcaacgacttccagcaccagttcgtcatgcacctgcataatcagtttgctttgtaagagttcgtcccacggggaggcttcgcactctgaaagccagcgggacacgtctatcatggcgcgtttgatgaggtcggaggcggtgccctgcatgggggcgttgatggcagcgcgttcggctccggcgcgggcgttggcgtttttgttgcggatgtcgggcaggtagagccttctgccgaacagggtttcgacgtagccttgggcggcggcttgttctttggtgcgctgcatgtattcggcgacgccggggtagcgggcgaagtagcggtcgataaagtttttggcggaaaggttgtcgatgcccaatgattttgccaaaccgtattgccccataccgtaaattaagccgaagttgatgcttttggcatagcggcgttgctcggacgagacgttttcgggcgcagtgccgaacacttcggcggcggtgcggcggtgtacgtcttcgccgttttggaacgcggcaatcagggttttgtcgccggagaggtgcgccataatgcgcagctcgatttgggaatagtcggcggaaacgatgacgctgccttgcggtgcggtaaaggcgcggcggactttacgcccttcttcggtacggatggggatattttgcaggttggggttgttgctggcgaggcggccggtaatggcgacggcttgggcgtaggtggtatgcacgcggccgtccttgggggaaatcatttcgggtagtttgtcggtgtaggtggatttgagcttcgccaggctgcggttttgcaggatgattttaggcagggggtagtcgggcgcgagctgttcgagcacggcttcgttggtggaaatgccgcctttggcggtttttttcaggcctttggtggggatgcccattttgtcgaacaggatttcttgcagctgtttgggcgaattgaggttgaacggctggcctgcggcggcataggcttcctgttcgagcttcatcagctcggcgccgagttccgcgctttggcgggcgagttcggcgcggtcgatttgcacgccgttgcgttccatttcaaacaatacctgcgcgacgggcagctccattttttcatacatttcaagctgtttttcgtccatttgcgcgcgcaggtgcgcttcgaggcgcagggcgaaatcggcgtcttgggcggcgtattcggtcgcctgcccgatggcgacatcggcaaaaccgatttgcttcgcgcctttgccgcacagcgattcgtaggtaatggtttccaagccgagccagcgttcggacaattcgtccaagccgtgtccgagatggctctcgatgatgtaggaagcgagcatggcgtcgccggcaatgccgttcagggcgatgccgtagttggcgaaaacgtgttggtcgtatttgaggttttgcccgattttttttagggcggggtttcccaaatgcggtttcagacggcctaatacgtcttgtaaatcaagctgttcaggcgcggcggtcaggctgtgtcctacggggatgtaaaccgcttcgcctgcttggaaagcgatgctgatgccgaccagcgaggcgttcatcgcgtctaatgacgtggtttccgtatcgatgccgattgtgtccgcccgcgacagtttgtccaacaaagcggcaaactgcgcttcggtggtaacggcttgataatccagtttttcgggggcggtggctttttcggcttgtttttcaaacggcatttccgcattcaaagccgcctgctcgccgatgctgtcgctgccgaacaaatcatcggtcgagccggtattcatgtttgattccgcttctttcagccaggtgcggaagccccagcgtttgaaatcgacaaccagctgcgcccatttcggcgtagtacggcgcaggctttcgatgccgtctgaaagctcggcgtgcaagtccacatcggttttaatcgtgaccaaatcatacgacagcggcagttggggcagcgcggcttgcaggttttcgcccactttgcccttgatttccgaagcgtgttccatcacaccagccagcgaaccgtaggcttccagccatttcaccgccgttttcgggccgcatttttccacgcccggcacgttgtccaccttgtcgcccatcagcgcgagataatcgcggatttggtcggggcgcacgccgaattttgccttcacgccttcaatgtccagcgtttcgctgctcatcgtgttcaccagcgtaacgcgctcatccaccaactgcgccatgtccttatcgccggtcgaaacaatgactcgcaaaccatgttccgccccctgtttcgccagcgtgccgatcacatcgtccgcctccacctgcccaatcaccaataccggccagcctgtcaggcgcactaaatccggcagtgcttccgcctgcgggcgcaaatcgtcgggcatcggcgggcgcgtcgccttgtattcttcaaacatttgatggcggaaatttttgcctttcgcatcaaaaaccaccgcgcaataatcgtgcggatattccgaccgcaaacggcgcaacatattcaatacaccatacagcgcacccgtcggcgcgccgtcgggggcggtcaggttttgccccatcgcgtgatacgcacggtagaggtaggacgatccgtcaacgaggaggagtgtaggtctgttggacataaaaaacccgcttaaaaccgataagggacagaaaaaaatagggaaggacgatgccggcttaaaacccgcccccggacaaccccggattataacggaaaaggcaaatgccgtctgaaacccttgttcagacggcatttttggcggattaggcgttcagcagcccttcatccagcgtcagctcttcatttttgttcaccgccactttgcgcgccaacacgttttgcgcgatttgctgcgcttcggcgagcgagtgcatttgataagtgccgcattggtattcgttcaactcggggattttgctttggtctttgacattcaaaacatcctgcatcgaagccagccacgcatcggcgacctgctgttcggaaggcgtgccgataagactcatataaaaaccggtgcggcagcccatcggggaaatgtcgatgatttccacgccgttgccgttcaagtggtcgcgcataaaacctgcgaacaaatgctccagcgtgtgtatgccttttccaggcaggatttctttgttgggaacgcaaaagcgcaggtcaaacacggtaatggtgtcgcctttgggcgtagtcatggttttcgccacgcgtacggcgggggcatgcatacgggtgtgatcgactttgaaactgtctagtaggggcatttgggtatccttttgtgagggttatgtagattttcgggataggattttgtccagcaattcatcatccaagacgcggttttcgactttcacccattcgccgcctgcttcagggaagccgttgcggcaatatcctgcctgttcgacaaaatcatagacggcatgaatgtagtcgttgatacacaatgcggctatggtgcaggcatcatcccataaaatcaagacatgattggggatatgtttgtcggatacatcttcgacattatagatgtgcaaggcatctaaaatcccgtcttgcgaagcggcatagaagtagcctgtgtcgccgtcgtcttcaaagacgacaccataagggatatgtttggaaaatgattctaaaactttaggcgtgccgacagtaaagtctttgatttcagaagtcagatatagcggtaattgtgccattgggtaacgctctctttagtgaattttatattaattttgatattccatagttcactaaaaatccaccaaccactagccataaataagttagtattcctaaaacaaacggttttaatcctgcctttttgattgcgcttgcttgcgtcgttaagccaagcgcagccattgatgaaattaataagaaagaatcgatttcaacgaataatttcacgagttcttttggtaataaatcaaaagaattaaaaatggcaacaccaataaaaagtacagcaaaccaaggaattgtaattttgtgtgatgtattttctgatactccattactacgtgttaataaccaagaaagcattaataaaaagggggcgagcatcatcactcggatcattttggaaatgacggcagtattcgccacgataggatcaatattttccccaatcgcatacacttgagccacttcgtgtacactagaaccaacataaataccgaattgatgggcgttaattaaatgttgtgaccacgtgtagaacaaggggtaagtaaaaatagcaagcgtcccgaaaatgaccactacggcaatcgccactgaaactttatgggattctgctttagtaacaggctctgccgccatcactgctgccgcaccgcaaatgctgcaacctgccccagtgagataaaccaattgtttatccatttttagataacgaatgcctaaaagtgcggtaaaaaagaaggttgaaattagcatgattgcatcagtgacaaccgcatttaatcctacatcggcaatatcgccaaaagtgaggcgaaaaccatacaacacaatgccagtgcgaagaagcgcgcctttggcaaacaaaacgcctttttccacttgtgtcgaaaattgcggataaatggtattgccgattgccattcccagcaagatagcaataattaaagcactgatatgataatgatgggaaaaatcagtgtttcctaaatagttagcaagtatagcgataatcgcgataaatatcagtccgaaataaaagggacgtgtgttcattttttctttccgtgataacacccaaatcacaattccgcaatttccaccgcttcgcccgaagccgcgctcagggcttcgtttaaaacgtcataaaaatcgcgtccgtcgcgcgttgccagccatttgccgttttgctcggcgaaatggtagccgccgctttttgcggcaatccacaattcctgattgggcgtgtggcggttgacgatgatttgggcgccgtctccggcttcgatggtcaggacgtttccggcaaaccggcagtcgaaatcccagccgttttcgtcgatttggtcttcgatgtgttcaaataatgcttcgctcgcgcggataaactcgctttcggtcatcatagctttttgcgtgttttttgtttaagatgccgaatcttgccacattcgcgcttatgaaggaagtttaccgatgaaatacggcgtattttttgcggcggcaaccgccctcctgctctcggcctgcggttacaaaggcgacctctacctgcccaaagaaggcgacaaggcgcgtttcggcgtaatccaaaccggtttgcaacttcaaagcaaaccgcaatccgctccacaaacccaaaaatgaaaacgaaaacatgaccctattttgcgaacaagtcccctacccccgccttgctgaagcattcggcacaccgctttatgtgtacagccaatccgcgctgaccgaagcatttgaacactaccaaaccgcgtttgccgctttgaacccgctcgtctgttacgccgtcaaggcaaacggcaatctgagcattatcaaacacttcgcctcgctgggcagcggttttgacattgtgtccggcggcgaattggcacgcgttttggcggcaggcggcgacgcggcaaaaaccatattttcaggcgtaggcaaaagcgaggcggaaatcgagttcgcgctgaatgcaggcgtgaaatgcttcaatatggaaagcatccccgaaatcgaccgtattcagaaagttgccgcacgtttgggtaaaaccgcgcccgtctccctgcgcatcaaccccgatgtcgatgcaaaaacccatccctacatctccacaggtctgaaagccaacaaattcggcatcgcctacgccgacgcgctcgaagcctaccactatgccgcacaacagcccaatttgaaaatcatcggcatcgactgccacatcggttcgcaactgaccgacttaagcccgctggtcgaagcctgcgagcgcattttgattttggttgacgcgcttgccgccgaaggcattgttttggaacatttagacttaggcggcggcgtcggcattgtttaccaagacgaaaatgtgcctgatttgggcgcgtatgcccaagccgttcaaaaactgatcggcacacgccgtctgaaactcattcttgagcccggccgcagcctggtcggcaacgcaggttcgctgctgacacgcgtcgagtttgtcaaatacggcgaagagaaaaactttgtgatggtcgatgcggcgatgaacgatttgatgcgcccggcgctttatgatgcctatcatcacatcgaggcggtcgaaaccaaagacatcgcgacgctgaccgccaacatcgtcggtccgatttgcgaaaccggcgacttcctcggcaaagaccgcaccatcgcctgcgaagaaggggatttgctgcttatccgcagcgcgggcgcatacggggccagtatggcgagcaattacaacgcgcgcaaccgtgcggcagaggtgttggtggacggcaacgaataccgactcatccgccggcgcgaaaccttggaacagcaaatggcaaacgaactcgcctgcctgcaagccgaacatcaaaatgccgtctgaagcggttcagacggcatttttaacgctctaaaggcttactcgttcggcagccttaacagggaaagcagcagccctccccagattatcacgattgagacaatcatcatcacaatggcggaagtactcatttttcttctccttgttcatgttcgtgttcgtctttgacgttgaaatcctgaccgtgtttccaaggcagcaacgacagcagcagcccgaacacgaccaacgccgccgacatcccccagccgaaaatactgaggaaaccatccggataaccttcgtaatttttctccatcaggccgctggtatctttaaacagcatatagccgagcatcacgacggtaaccacgacgcagaccgtccacaagccgccgatgcggatggaggacaaagcgttcaggtgcttgcgtaattccggcagcctgccgctgatgatgatggcggcaacataaacaaagccggcggcaacaatgccgtaggtgttgacgaatttgtccatcacgtccaaaaccggcagccccgtcgccgtaccgaacagcagcgtggaaacaatgcccatcggaatgcagaccagcagcgtggcgttgacgcgcccgatgttcagcttgtcctgaatcgccgccacaatcacttcaaggatggaaatcatcgacgtaacgccggcgaacaccagcgaaccgaaaaacaatatgccgatcagccagcccatcggtgcctggttgataatggtcggaaaggcgataaacgccaaaccgatgccgcctgaggcaacctcgttgaccgccttaccgcccgcntgcgccataaagcccaatgcggcaaacacgccgatgcccgcgagcagttcaaagctgctgttggcaaaaccgaccaccagccccgttccgcccaagtcggtttttttcttcaaataagaagaataggtaaccataatgccgaagcagatggaaagcgaaaagaaaatctgcccgtatgccgccacccagaccttggaatcggcgagtttcgaccagtcgggcgtaaacaatgcgtccaagccctttgccgcacccggcagggttagtgaaatgccgaccataatcaaaaacatcaccaaaagcagcggcataaagaacgacgaggcgcgcgccacgcccttttgcacgcccaacgccataatggcggcggtaaaaacccacacgcccgccaaaggaccggcgactttgccgacaaaatccaaacccaaggcttccgggcccgccatttgcaggaagtccttaaagaaaaaaccctgcggatccgcaccccaggcggcgttgaccgaataataggtatagcttgccgcccaaccgataattaccgcgtaatagatgcagatgacgatattggtcatcacgttccaccagccgaccggctcaaaccatcgtccgaggcggcggaaagccaagggcgcagaaccacggtaacggtggccgatggcataatcgagcagcagcagcgggatgcccgccgtcagaagcgcgaccagatagggcaggatgaacgcgccgccgccgttttcaaaagcaatataggggaaacgccaaatattgcccaagccgacggcggacccgatggcggcaatcataaacgcgcggcgcgtgccgaatgtggcgcgttctttcgtcttggaatcagacacgttgatacctcttgaattatttattaaaaacaagccattataggcgaaatatatagaaatagcgtctgacagggataatgtcttctgaaaaaacaaaccggcttgtggccgattgtttacaatctatgtgcttatcgtaaaaaaatttaacgctgatggcaagcggtgaaggcttgaaaacgaaaaattttaggggctgtactagattagccctaaatcccacaccaatcccgcaggattttaagctgttgagacggtgtgccgaagttaaatcgaaattcgcattctttcaagaacagcgggaaagatttacgatcgattccattgtattttcgcaagacacgttttgcctgattccaaaaattctcaatgccgttaatgtggttctgacggtctgcaaatccttggaawggktgatgcggtataaatgaaaccgctcactccaacttgtcgcarctgctcagactatcggtataaacaatactgtccggcatgattttcttcttgatgacagggagtaacgtttcagacttggcattatccaccacaacggtatagacccgtccgttgcgtttcagaatgccgaagacaacactt

SEQ ID NO: 26 - DNA, 52253 bp, Neisseria meningitidis
tgctgcacaactgggcgtaaacgaagccgacgtgaaaaacgaatcttccttccaagacgacttgggcgcggattctttggacaccgtggagctggttatggctttggaagaagcattcggctgcgaaatccccgacgaagatgccgaaaaaatcaccaccgtccaactggctatcgactacatcaatgcccacaacggctaaccggtcgtcgcccgacacaacagcctctgctgcaccgcgcaatagaggcttttcccttatatggcaaactgtttgaacccctgccgcaaattacagacggcatctgcacgacagccgcatatgcccccattccgacaaccaacagcgaggttatcatgagtcagagaagagtagtcattacaggcttaggtcaggtttcccctgtcggcaacactgtcgcagaggcttgggacaccctgctcaccggcaaaagcggcatcggcgcgattacccgctttgacacatccgacatcaacagccgtgtcgccggcgaggtgcgcggtttcgacatcggacaatacatcagcgcgaaagaagcgcgccggatggacgtattcatccactacggcattgccgccgcattgcaggcaatcgccgattcgggtttggacgatgtggaaaacctcgacaaagaccgcatcggcgtgaacatcggttccggcatcggcggactgcccggcatcgaggtcaccggcaaagccgtaatcgaaggcggcgcgcgcaaaatcaaccctttctttatccccggttctctgattaatctgatttccggacacgttaccatcctcaaaggctaccgcggcccgagctacgggatggtttccgcctgcaccaccggcgcgcacgccatcggcgattccctccgtatgattaaatacggcgacgcggacataatggttgccggcggcgcggaaggcgcaatcagcactttgggcgtgggcggttttgccgcgatgaaagccctctccacccgcaacgacgaccccgccaccgcttcccgtccgtgggacaaaggccgcgacggcttcgttatcggcgaaggcgcgggcatattggtgttggaagaattggaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctacaaaaccgtcgtcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggcacgctggtcttcaaacgcttcaaaggctgattccgcaaagccgccgccgacatcgaaatgccgtctgaaaccgtttcagacggcatttttatagtgattaacaaaaatcaggacaaggcggcgagccgcagacagtacaaatagtacggaaccgattcacttggtgcttcagcaccttagagaatcgttctctttgagctaaggcggggcaacgccgtaccggtttttgttaatccactataatacgcaggcaaacccaagccttgctgggttacaggatgaaaccctgccgtagcagaccgcatttccaatccatattcaaggtgtccgccttatgaaaatcgtttttatcacaacagtcgcatccagcatttacggtttccgcgcccccgtcattaaaaaattaatcggcaaaaaccatcaggtgtatgcctttgtatcggagttttccgacaatgaattggatattatcagggaaatgggggttacacccgttacctaccgttcaaaccgcagcgggctgaacccgttttcggatataaaatccaccttcctcatctttaaagaactcaaaaaaatatcgccggatttggttttcccttatttcgcaaaacccgtgattttcggcacttttgccgcaaaactggcaggcgtgcccagaatcgtcgggatgctggaaggtttgggattcgcatttaccccgcagccggaaggcataccgttaaaaacaaaaatcataaaggggattttgattgccttataccgcattgccctgccgatgttggaaagcctgattgtattaaaccccgacgacaaagacgaactgacggacaaatacggcatcaaaataaaaaacatccatattttgggcggaatcggtctggatttgcggcaatatccttattccgaggcggatattcccgatgaaaaagaacccgtaaaattcctctttatcggcagatttctgaaagaaaaggggattgatgattttattcgggcggcggaacaggttaaggacaaataccccgatacggtttttaccgctttgggcgcaatcgacaaatcacgcgggggggggggcgatttggaacggcttgccgcccgcgatattatccgtttccccggttttgtgaacaatgtttccgaagtgataaaagaacatcatatattcgtattgccgtcttattatagggaaggcgttccccgaagcactcaggaggcaatggccgtcggcagggcagtgattacgacggatgtccccggatgcagggaaacggtcgccgacaaggtcaacggcttcctgatcgagccttggaatccccgcatcttggccgaaaaaatgatttattttatcgaaaacagggaagccgtccgcctgatggggaatgcaagttatgcgattgccaaagataaattcgatgccgaaaaagtcgatttgaaattgctcgatattttgaaggcgtaaacaaggctgcccgcttttgagtttcggtcatttctgataaacccccgtcattcccgccacacccccgtcattccctcgaaagcgggaattcaggttcgtttagtttcggtcatttccgataaattcttgcaactttgcgtttctagattcccactttcgtgggaatgacggcggagggttgctgttttcctgacaaattcccgccatctaaaatctcgttatccatacaagaaccgaaaatcttgccattctcacaaaaacagaaattcaaaaacagaaatcccaaaccctcgtcattcccgcgaaagcgggaatccaggttcgttgagtttcggtcatttccgataaattcttgcaactttgcgtttctagattcccactttcgtgggaatgacggtaaagattgagacctttgcaataacataggttactaaaattttatgctcaatctcattttcaaaatgcaaaacttttctgatttctcctactttttgctcaatattaggaaggttttaggcaattgaaaattttttggcgcatttttatgcgtcaaatttcgttaacagattatttttgcaaaggtctcagattgctgttttcccgacaaattcccgccatctaaaatctcgttatccatacaagaaccgaaaatcttgccattctcacaaaaacagaaattcaaaaacagaaatcccaaaccctcgtcattcccgccaaacccccgtcattcccgcgaaagcgggaatccaggttcgttgagtttcggtcatttccgataaactcttgcagctttgcgtttctagattccctctttcgcgggaatgacgggatgcaggtttccgcgcggacggattcggcattcccgctttcgcagaaatgccggcttttggtttgttgtctttataagattattcggcaattattctgcggttttgcgtttgtgtgctgccggaatctcaaaggattctctgtatttggcaatggtgcggcgagaaacctccatgccgcggaaagccagcaggttggcgagcgcctcgtcagaatacggcgtgggcgtggacgaggcaaaaccggcggcgggaaagggattgagcgaagcaatgaggtcgagtgcggcttcgagtgtgccgctgtcggtttggggcaggtgtttttttattcgtgcgagggtttggctgcggttgccgtcaatgctgtcgagggcgtttcggacgatatgcagggcggcgggtttggcagcacattcgcccaatctttctatctgcagtatcagcgattcgttcaaatcggcggcggccacgcctgccgggtcgaattttttcaatgcggtcagcgcgtgttgcagcattgcttcatccaacatccactctaagggcgtatggtcgaggatgtcttcgatgctgtcggtcagataaccctgctcgtcaaggaaatcgataaggatgtggacacaggcggcttcttggtcggaaagcgggtgttcgcatacttgcgcgtgcaggtattgcttgaaatcctgctcgccggcgatgttggacagcatatcttcgccttcgtctccgccgatttgacgggcaggcgcagtgtaatggctgaactcggcatcggaaaattcatccgtgtctttgcgttcgagcagggggttgtccgacagccagttttcgacctcgcgttcaagttcgatacccgacatctgcaatacgcgcaaagattgttgcagccgctggttgagctgctgggtctgtttgagctttattccgagtaaggtcatgataatgtggggaaaattgttattttcagcctgtcggcgcaaaaaatgccgcaaagcgtcattgcattataaatggttttaatgagcgggttcggattccgttcgataacaaaaaacaaacgaaaatcaagaaccgattgcttataataatattaaatcgatttcatagttttaatagcgaaaatcttggcgtatagtcgcatccatagtttttacaaaagggaaataaaatgtcgattcaagaaatttattgcaatcaagaaaccggttacgaatacgctttccgccaaatcgtactgtaagccgtttacccccatttgaccaacctgagaaaaggaacaagagcgatgactacctccaaatgccctgtaacccatctgaccatgaacaacggcgcgcctgttgccgacaatcaaaacagcctgaccgccggtcctcgcggccctctgctggcgcaggatttgtggctgaatgaaaaactcgccgacttcgtgcgcgaagtcatccccgaacgccgtatgcacgccaaaggttcgggcgcgttcggtacgtttaccgtaacgcacgacatcaccaaatacacccgcgccaaaatcttcagcgaagtcggcaaaaaaaccgagatgttcgcccgtttcaccaccgtggcaggcgaacgcggcgcagccgatgcagaacgcgacatccgcggttttgccttgaaattttataccgaagaaggcaactgggatgtggtcggcaacaacacgcccgtgttcttcctgcgcgacccgcgtaagttccccgacctgaacaaagccgtcaaacgcgacccgcgcaccaatatgcgctctgccacaaacaactgggacttctggacgctgctgcccgaagcactgcaccaagttaccatcgtgatgagcgaccgcggcatccccgccggctaccgccatatgcacggcttcggttcgcatacctacagcttctggaacgaagcaggcgagcgtttttgggtgaaattccatttccgcacccaacaaggcattaaaaacctgaccaacgaagaagccgccaaaatcatcgccgacgaccgcgaaagccatcagcgcgacttatacgaagccatcgaacgcggcgagtttccgaaatggacgatgtacatccaagtcatgcctgaagcagacgcggaaaaagtaccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtgtcggcgccagcccagataaaatgctgcaagcgcgtttgttcaattacgccgacgcacaacgctaccgtttgggcgtaaacttccgccaaattcccgtcaatcgtccgcgttgccctgttcacagcaaccagcgcgacgggcaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactatttcagccaaccgcgcgccctgttcaacctgatgaacgacgcgcagaaacaggcattgttcggcaacaccgccgccgcaatgggcgacgcgcccgacttcatcaaataccgccatatccgcaactgctaccgttgcgacccggcatacggcgaaggcgtggccaaagcccttggactgactgtcgaagatgcccaagccgcccgcgcgaccgatcccgcactgggtcaggctggtttgctgtaagggggcattatgtggatggaaattgaagaaatcctgtcccgcgccgtccgctatcggaaataaccgggcataaaaatgccgtctgaaacattgtccgaccgtttcagacggcattcccccatcccgccccgccgtttcagcgggcgttttttattaaacgcaaaatatcccgtcattcccacgaaagtgggaatcaaggactcggggttggagaaaccgttttatccgataagtttccgcaccgacaactctggattcccgcctgcgcgggaatgacgggatttctgtttttgattttttgtttttgcgggaatgacgggatgcgggttttcgtgcggcatttttgcatttttttgcttttgctataatccgccctttttgaggacgggtgcggtatgggtttttatgctttgctcttgattgctctggggatgtcgatggatgcgtttgccgtcgcattggcaaagggtgcggcggtcagaatgcctccgcgcaaaattgcggcaacggctttggtgttcggcacggttgaagcgctcacgccgctggcaggctgggtaggcggtttttatgccaagccgtttatcagcgaatgggaccattgggtggctttcgtcctgctgggcgggctgggtctgaaaatgatgcgcgaagggctgtccggcgaggcggaagatgtgcgcgaaagcaaacgggaaagcctatggatgacggttttgactgcttttggaaccagtattgattccatgatagtcggggtgggcttggcgtttatggaggtaaacatcgcctttgccgccgcaatcatcggtatggcgacgacggtgatggtggcggtcgggctgacggcgggaagggctttgggcgtattgttcggcaggtgtgcggaatttgccggaggtttggtgttgattgccatcggcacatggacgctcttgtcgcatttgggtttgattcaatgatgtcggaaaatatagtggattaacaaaaaccagtacgtcgttgcctcgccttggctcaaagagaacgattctctaaggtgctgaagcaccaagtgaatcggttccgtactatttgtactgtctgcggcttcgtcgccttgtcctgatttttgttaatccactataaaatgccgtctgaagcgttgtttgaccgtttcagacggcatttttatcaaattcaaaaatattccgtcattcccgcgaaagcgggaatctagaacgtaaaatctaaagaaaccgttttatccgataagtttccgcaccgacagacctggattcccgcctgcgcgggaatgatgggatttctgtttttgatttttttgtttttggggaatgacgggatttgagattgcgggcatttatcgggtaaaacggaaattaaacgttgcgaaaatttatccggaatcacagcaacttttccgcgtcattcccacgaaagtgggaatctagaacgtaaaatctaaagaaaccgtttttcccgataagtttctgcaccgaccggtctggattcccgcctgcgcgggaatgacggtgcggatgtttttctatcgaatccgccatattttttacttcaaccctgccgtcagaccgcgttgtcgaaaccgctgtggcgcaagagtgcgtctatgctcggttcgcggccgcggaaggctttgaaggattctgccgcgctgcgcgatccgccgacggcgaggatttcctgccaaaagcgtttgcctgtggcggcgacatcgtcgctttcttcaaaggcggcgtatgcgtccgcgctcaatacttccgcccacgcgtagctgtaatagcctgcggaatagccgcctgcgaagatgtggccgaagctcaaggcgaagcggttgtattcgggcggctggatgacggcgacttttttgcgcacgctgtctaaaacctgttgccagtttttcagacggccttcgtcgtcttcgctgtaaatcatcatatcaaagagggcgaactccatttgccggacgaggaacatgccgcgttggaagtttttggcggcgagcattttgtcgaagagttctttcggcaggggaacgccggtttcttcgtgggctgacatttgtgccaagacattgtattcccaaacgaaattttccataaactggctgggcagttcgaccgcgtcccattctacgccgttgatgccggatacgcccagttcgtccacttgggtaagcaggtggtgcagcccgtgtccggtttcgtggaagaggatgaggatttcgtcgtggctcaggcgggcttccctgccgccgacgggtggggcgaagttgcagacgaggtaggcggtgggcagttgcagcgtgccgtctgaaaaacggcggcggcctttgtagtcgttcatccacgcgccgccgcgtttgccttcgcgtgcgtacaaatccatataaacgccgcctatggtttcgccgttttgttgcaattcaaaatagcgcacgtctttgtgccagacggggacggttttttcggtaaatccgatgccgtagagttttttgatttgggcgaacagtccgtttaatactttgccgacggggaagtattttttgacttcggtttcgctgaacgcgtatttggcttcgcgcagtttttcgctggcgtagcccaagtcccacggttgcaaatcggcgaggttcaggctttcgcgggcgaaggctttgacttcggcgaggtctttttcggcgtagggtttggcgcggcgggcgaggtcgtgcaggaagtttaaaacttgttcgggcgtgtccgccattttggttgccagcgacaattcggcgtagtttttgaagccgagcagtttggcggtttgcagggcgtttgcgagcgtgcggtcgatgttggcggtgttgtcgaatttgccgtcgtctgaaagttcgctggcgcgggtaacgtaggcgcggtagatttgttcgcgcagttcgcggttgtcggcgtattggatgacggcgaggtagtgtggaatctgcaagccgattttgtagcctgttttgctttcgctttgcgcggcggcggcaaacatggcgagcgcgtcttcgggaatgccggcaagcggtgcggcatcgtcaaagtaaatgccgaacgcgtcggtcgcgtctaggacgttttgggagaatttggcggaaagttgcgcgccttcggtttgcagttttgccagttctgcctgctgttcgggcggcagttccgcgccgctgaggacgaaatcgcgcagatcgtggttgagtttggttttttgtgcgggggagagggtgtcgaattcgggggaatttttgatggttttgaagcggttgtacagctcgatgtcttgtccgatttcggtgaagaagacggtgatttcgggcatcagttcgttatagacggcgcgcagttcgggcgtgtcggcgacggagttgaggtgcgacaccacgccccaaatcctgccgacgcgttcggtgatgccggtcaggggttcgacagtgtttgcccagccggtgtgcgtttgggctttgatggcggcgatttgttcgcgcgcttcggcgatggcggtttgcagggcgggtttgatgtcttcggttttgatttgatcaaaacggggttcttcgcccaaatggagcagtgcgttgtcagtcataagatgggtttcctttgcgtgttgtgtttcagacagcatatcggcaatatgccgtctgaagccggaaatggggtcggtcggggaaagttaaagtgtttcggagccggcggggtgatttaacaggcggtattgtacgcgcaaaaattcgtccataaccgcctgttggatttccagccgctttgaaacgggggaagcgaagcggacgatgatgcggtatgccttgtcatcgtacggcacgcgggtaacgcgcggtctggcggcgggcgtgataaacagtttttccgcctgcacgttttccaaatsccgttggatggcggggatgtagggcgcgcacaagggctcgagtacggctttcagacggcatacggcttcatccgaatccaaatggatgggaacggggatttcgaccgtatggatgacatagtcgcccaaaatattgtcgcggcgcacggggtggctcaacaacaggctgttggggaaagaaacggtggttcccgcaagctgtccgaccaaggggttcggaccgacctgcatcatcagcgtgttcaacaggttgatgtcgaccacgcgcccgcgcaggccgttgatttcgatatagtcgccgaccgagtattgctgggtggcagaccttaaaatactgcccgacagacacataatcagttccttcgtcgccacgacgaccgccgccgccaccgcaaacatcgacaaagccagcgtttggatttgcgccgaccagataaatgccagcgaaaacagcaccaaaagcagcgttatattgcggctggcaaccaaaaaccgccgcttgctttcgatgccgaaatccggatgccgtttgaagtggatattcaacagaagggcgcgcgccagcagcaaagccgcaaccgccgccacggattcgaccgcctccgcacgtatcgggacggcaccgagccaagtgtccaacatattccatatttccatttccgcgcccctgtccgaaaagtatagggtgtagattttagtggcaaaaaaacgcttttgccactttacgggacaatccccgacctgatgccggaggcaaacgtaccgtttcatcttttcccggcggcacactgatgcggataacgctgaattaggcggcaaaatcggctataatacacaattatatatgtcgtcccgcccgctttttctacaaggtgcggacttgttttggcggcatcgcaaaatcttttcaaaatccggcaaaaaatatgactgaacaaaaacacgaagaatacggcgccgacagcattcaggtgctcgaaggcttggaagcggtacgcaaacgccccggcatgtacatcggcgacacgcaggacggcagcggtctgcaccacatggtgttcgaagtattggacaacgccattgacgaagcactcgccggacattgcgacaaaatcacggtaacgatacacgccgaccattccgtcagcgtcgccgacaacgggcgcggtatgcccaccggcatccacccgaaagaaggacgctccgccgccgaagtcatcatgaccgtattgcacgcgggcggtaaattcgacaacaacagctacaaaatctccggcggcctgcacggcgtgggcgtgtccgtcgtcaacgcgctgtccgactgggtaacgctgaccatctaccgcgacggcaaagaacacttcgtccgcttcgtgcgcggcgaaaccgaagagccgctgaaaattgtcggcgattccgataaaaaaggcacgaccgtgcgcttcctcgccagtacggaaaccttcggcaacgtcgaatacagcttcgacatccttgccaaacgcatccgcgaactttccttcctgaacaacggcgtggacatcgaattgaccgacgagcgcgacggcaaacacgaaagcttcgccctttccggcggcgtggcgggtttcgtgcaatacatgaaccgcaaaaaaacgccgttgcacgaaaaaatcttctacgcgttcggcgaaaaagacggcatgagcgtcgaatgcgcgatgcaatggaatgacagctatcaagaaagcgtgcagtgtttcaccaacaacatcccgcaacgtgatggcggtactcacctgaccgcactgcgccaagtgatgacccgcaccatcaacaactatatcgaagccaacgaagtcgccaaaaaagccaaagtggaaaccgcaggcgacgatatgcgcgagggtttgacctgcgtgttgtccgtcaaactgcccgaccccaaattctcgtcccaaaccaaagacaaactggtttccggcgaaatcggccccgttgtcaacgaagtcatcagccaagccctgaccgacttcctcgaagaaaatccgaacgaagccaaaatcatcaccggcaaaatcgtcgatgccgcccgcgcgcgcgaagccgcccgcaaagcacgcgaaatcacccgccgcaaaggcgtgatggacggcttgggactgcccggcaaactcgccgactgccaagaaaaagaccctgccctgtccgaactctacctcgtcgagggcgactccgcaggcggttccgccatgcaaggccgcgaccgcaaattccaagcgattttgccgctcaaaggtaaaattttgaacgtcgaaaaagcacgttttgaaaaaatgctggccagccaagaagtcgccacgctgattaccgctttgggcgcgggcatcggcaaagaagaattcaatgccgaaaaactgcgttaccaccgcatcatcatcatgaccgatgccgacgtggacggcgcgcacatccgcaccctgctcctgaccttcttctaccgccaaatgcccgagctggtcgagcgcggctacatctatatcgcccagccgcctttgtataaagcgaaatacggcaaacaggaacgttacctcaaggacgagttggaaaaagaccaatggctgctcggtcttgccttggaaaaagccaaaatcatttcagacggccgcaccatcgaaggcgcagaacttgccgacaccgccaaacaattcctgttggcaaaaaccgtcatcgaacaggaaagccgcttcgtagacgaactcgtcctgcgcgccatgctacacgcgtcgcccattgatttgacgtcgtctgaaaacgccgataaagccgttgccgaactttccggtctgcttgacgaaaaagaagtcgccctcgaacgcatcgaaggtcatgaaggacaccggttcatcaaaatcacgcgcaagctgcacggcaacgtcatggtcagctacatcgaacccaagttcctcaacagcaaagcctaccaaaccctcacccaaaccgccgccgcgctcaaaggcatggtcggcgagggtgccaagctttacaaaggcgaaaacgggtacgacgcggacagctttgaaaccgctttggacatcttgatgagcgttgcccaaaaaggtatgtccatccaacgatacaaaggcttgggcgagatgaaccccgagcagctgtgggaaaccacgatggatcccgccgtgcgccgcctgttgaaagtgcgcatcgaagatgccattgccgccgacgaagtgttcgttacgctgatgggcgacgaggtcgagccgcgccgtgcctttatcgaaaacaacgcgctgattgcccaaaatatcgacgcataagtgccgttttaaaaaaggagacgggcatcgtgccgcgtctcctttttggttggtcaaacggaacctgtgccgtctgaaaaaccgtcggagcaaaatatgatcagcattttcgatattttcaaaatcggtatcgggccttccagttcgcatacggtcggcccgatgaaggcagccgccgcctttgcggcaggtttggatgcacaggctgttcgcatcgtcatcgacatttacggctcgctcgcactgaccggatacggacacggtacatttgacgcgctgatgctcggtttggaaggcagcctgccgcacgacatcccgcttgccggcattcccgaacgcctcgaacgcatccgcacgcagcacatcctccggctcaacgggcaagaaatccgcttcatccccgaccgcgacctgaacatactcggcaatcaagtgctgcccaaacaccccaacagcctgcgttttaccgcctatgcttcagacggcacggtattgaatgaacaggtttattattcggtcggcggcggctttgtcgttaccgaagaagattttgaccggcaggcggaaacggaaaaagccgttccctatccctataccagttgcgccgaactgcttgcccgatgccgtctgaaccggctcgacatctccgaagtcgtgttggcaaacgaagccgcgcttgccggatgcggcgaagccgaaatccgccgccgcgccgctgccgttgccgaggttatggaaggctgcatcaaacgcggcttgggtgcggacggcgaactgcccagcggattgaacgtccgccgccgcgccccgcagcttgccgccaagctcaaagtcctgcgcgaaaccgaaatcgtcaacacccagctctggccgatggtgtacgccatggcggtcaacgaagaaaacgccgccggcggacgcgtcgttaccgcaccgaccaacggcgcggcaggcatcattcccgccgtattgcactatttccgcaagttcaatccgcacgccacacaggaacgcgtcgaaaacttcctgctcaccgcaggcgcaatcggcatcctctacaagaccaacgcctccatttccggtgcggatgtcggctgtcagggcgaagtcggcgtagcgtgttcgatggcggcgggcgcatacgccgaagtcatcggcggcacgcccaaacaagtggaaaacgccgccgaaatggcgatggaacaccatttggggctgacttgcgaccccgtcggcggactggtgcaaatcccctgcatcgagcgcaacggcatcgccgccgaaaaagccctcaaactcggcacgctcgcgcttttggaagacggcacggacaaaaaagtctcgctcgacgaagtcatccgaaccatgctgcaaaccggccgggatatgaaggcgacctacaaagaaacctcgcttgccggactcgccgccacgctccggaaaaaagccgtccccgtatccgtgcgcgtggtcgagtgctgaggatggacagaaacgaaaatgccgtctgaaaacagttttttagacggcatttcatttatttcttgcggctttaccgtttcagtgccagcgtcaacacgcccgccgtaaccagccccaagcctatccattcctgcgtgttcgggcgttcgtctaagaaaaccaccgccatcaggaatgcaaaccggcgttgtttgcagcatccggcaagaatttttatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaaaggtcttttctaaaatatgcagaaattcgaatatcgaatttgccttatgattacggttttctgtcttatctgccttaaaacgccggtattccgtttgaaccaaattatatttgccgaaacgctcaaaaatctcccttacctgcccgacagacatcaagccttcgttgttgtagctgagaaaatatattgaaagtccgcatccctaatcaaagcctcaaataccggaatcacatgcgattttgagcaagtccgcgctaaaacacatcgtacagcgcaaaaccggatgggaatggcaaaatccggaaacaaacatttttcaaagcatacaaacaaaaaaataccaaccggaggttggtattccttaacttttggcgcggcggacggggctcgaacccgcgacccccggcgtgacaggccggtactctaaccaactgagctaccaccgcgcatccattgtttgcaacaatgaaagaaaacttggtgggtgatgacggagtcgaaccgccgacattctgcttgtaaggcagacgctctaccaactgagctaatcacccgtgtataaaaaataccgacagagtcagtattttgaaacttggcgcggcggacggggctcgaacccgcgacccccggcgtgacaggccggtactctaaccaactgagctaccaccgcgcatccattgtttgcaacaatgaaagaaaacttggtgggtgatgacggagtcgaaccgccgacattctgcttgtaaggcagacactctaccaactgagctaatcacccttgcgatttgcgaaagcgttattaaaccaaataaccggaaatggcgcaagccttatttcggcatttcatttatattccctgcaaactccagttttcaaaagagataatttcttcttttttgcctgcgaccaccaacacgtcaccgccttccaatgtaaacgaggcatccgggttttcaatccggccggtgcggcggcggacgaacaagagtttgatgccgtaagccgccatcggaagcgtgccgactgttttgccgacggcgtatgcttctgcagccaaaggaaaggcgtgacggacggtttcgccgttttcgccgaatcctgcctcatcatcactaccgacaaacagtccctccaacgcggcataacggctgtggcggatatttgccatcgtctgatagacgtgccgatacgacgcgccgttgcctaacattgcatagcctgccagcacgagtccggtttctttggtgtccgacacggcttcttccgcacctatatcggtaaacgttttcacataatcgtcgttggtggcgcgcacatatacgggcatattgggatacatggacagcacattgtctaaaacgtgttgcgtttcgtgcatattgttgagcgtaaccaccaccattttcgcccgtcccagaccggcggcttccaatacttccctgcgtttcgcatcgccgaacgacaccggttcgcccgcacttctggcaacctgcacccgcgcaatgtccaagtcgagcgcgaaatacggaatatcctcttgggcaaggacgcgtccgaccgtctgcccgcccctgccgaagccgacaatcagcacatggtcggacttgctcatggtttctaccagcatactgtgcagatcgagcgacttcatgtcccagcttgacttgaccaaacgcccgaccagcgcatcgctgccgcccaagaggaagggcgcgataatcatcgacagcagaaccgccgccgtcgccgcctgttcccattctggcgaaaccatatcaagctgcccggcaatggccagcatcacgaagccgaactcgccgccctgcgcgagatacaaagccgttttgaggctgtcgccgaccgaatgtttcattttgaaggcaatggcaaacacaaccagtgccttcaacaccagcagcattgccaacagcatcaatacctgccgccagccgccgatcaatgcctgaatgtccagcttcatgccgaccgtgataaagaaaaagccgagcaaaatatcgcggaacgggcggatgtcgtcttcgacttggaaacggtattccgtttccgaaagcagcatgccggcaacgaatgcgcccaacgccatagacaaaccttccagctcagtcagataagccacacccaaggttaccagcagcacattgatcataaagagttcggacgatttgcgttttgccaccatcctgaaccatcgcgacataattttgctgccgacgaaaaacagcagccccagcgtcagcagcatttttgcaaacgccaaacccaaggccgcccaaatatttccgtcccctccgcccgccagcgcgggaatcagaatcatcagcggcacgacggcgatgtcctgcatcagcagcacgcccatcgccatctgaccgtgcggctgccccaattccgtcttttccgacaaaatccggctcacaatcgccgtggacgacatcgccaacgcgcccgacacggcaaacgcccaattgaacggcacgcccgtcagcatcagtatgcccattaccgacagcatcgtaatgccgacctgcaaaccgcccagaccgaacaccagccgcctcatcgccctcaacttgggcagcgagaactccaaaccgatgctgaacatcaggaacacaatcccgatttcgcccaaataatccgtcgcatggcttttcggaatcaggctgagcataccgggccccgccaaaaagcccaccagcaggtagcccagcatggagggaatgttgaacttgcggcacaggatcaccgtaatgaccgacaccagcaaaacaatcacaataggggcaagcgaaaattcgttcatagaccgtccgaacaggaaaatacagaaaaatgccgtctgaaacggcatacgccgccgcattataacaaaacaccgcgcaccatccgaaacgggcgcggcatacaattctgctaaaatacgccctttcgattttgagccgcacaccgacatgaccgccacagccgccgccatagaccgcctgcttccccaaacccaatgccgcgaatgcggctacgacggctgcctgccctacgcacaggcagtcgcaacaggcgaagcgtacaacctctgcgccccgggcggagaaaccgtcattcgggacatttccgccctgctcggcaaaccctttgtcgcacctgccaaaacccaagccaaagcactcgcccggatagacgaaaccgcctgtatcggctgcaccgcctgcatccgcgcctgccctgccgatgccattatgggcgcgggcaaacttatgcacaccgtcatcgccgacgaatgcaccggctgcggactctgcgtcgccccctgccccgtcgactgcatccatatgcagcccgttgccgacaccgtcctgccccgcgcgcgccgcttcagcctgtccgccgacagccgttttgccgccgccgaacacgcgcgcacgcgctacctcaaacgcaacgaacgcaaacagcgcgaagccgacgaacgcaaggccatgcttgccgaacgcgaagccgccgtccgcaacgcgcgtccgcaaacgcccgacacaccgaaaaaaccgacgtttaaccctgccgacctcatcgccaaagccatggcaaaagcgcaaacccaacaagaccgcctcgccgccgccgacaaccgcaaagactatcaggcgaaacagatagccgaagcccgcgaacgcgccgagttgcgccgcgcccaacgcgatatgaaatacggcagcgacagcgaaaaagccgccgccctcgaatatctcaaacaatacaaagccaaacaggaagccgcacagaataccgcctcctgacccttccctgatatgccgtctgaagccgcttcagacggcattttatcaagctctccgtccgccgcacccgtgccgtccgcatcttaccgcccacccttccggccgcgccgttttcaataaaatattaattacacgccactacaaatttgctataatccgccccgaaaatctacccaaccctcaacaaaggaacaaaccatgggcatcaaagtcgccatcaacggctacggacgcatcggccgccaggttttgcgcgccatctacgattatcagattcaagaccaactccaamtcgtcgccgtcaacgccagcggcagccttgaaaccaacgcccatctgaccaaattcgacaccgtgcacggacgctttgaagccgacgtatcccacgacggcggcaacctcatcgtcaacggcgacaaaatccccttcttctcgacccgcaaccctgccgaactgccgtggaaagaactcggtgtcgatttggtcatggaatgcaccggcgcgttcaccagcaaagaaaaagccaaaatccacctcgaaagcggcgcgaaaaaagtcctcatttccgcaccgggcggcgacgatgtcgatgcaaccgtcgtgtacggcgtgaacgacagcgtcctgaccgccgacatgaccgtcgtttccaacgcttcctgcaccaccaactgcctctcgccggttgccaaagtgttgagcgaaagcgtcggcatcgtcaaaggcgcgatgaccaccatccacgcgctgaccaacgaccaaaccgttaccgacgtgcgccacaaagacctgcgccgcgcccgcagcggcgtggaaaacatgattccgaccaaaaccggcgcggcaaaagccgtcggtttggtactgcccgaattgaaaggcaggctcgacgggcttgccatccgcgtgccgaccgtcaacgtatcattggtagatttgagcttccaagccgcgcgcgacaccacagtcgaagaaatcaacgcactgatgaaagccgcctcggaagcaggcccgctcaaaggcgttttgggctacaacaccctgcccttggtttccatggacttcaaccacactaccgaagccagccacttcgacgcaacactgaccaaagtcgttgacggcaacatggtcaaagtgttcgcttggtatgacaacgaatggggcttcagctgccaaatgctgaacaccgcacgccgtatgttcggacttgaagtgcgcccgctcaaataagcaacaaaccgtcaaacaaaatgccatctgaaacccgatgttttcaagtttcagacggcatttttcattttcaccgtgattttatccggctgtcgtcatttctaattttatagtggattaacaaaaaccagtacggcgttgcctcgccttgccgtactatttgtactgtctgcggcttcgtcgccttgtcctgatttttgttaatccactataatccaccatatttgaacctgaccggagcataagccgccatcaaagccccttgcacgccacttcgcgccgcccgatttcctctttcaacggcacggcgttcaacatccgcagacgttcggcaaaatccgcaaacggcagcagctccgaaccgaaacggcgcatatgttccgtatcctgctggcagtctatcagttccacgcccaaatccgccaaaaacggcacggcgcaggcaaacgcgattttcgacgcatccggttgtaatgcgaacatcgattcgccataaaacaccctgccgatctgaacgccgtaaaagccgcccgccaacctcgtttcaccgctttcatcgggataatggcactcgaaagaatgcgcgtaccccatttcgtgcagcttcaaatatgccgtctgaaactcgggcgcaatccaagttccgtcctgattcgggcgcgccgctgccgcacaatgcgcgaccacttccgcaaaacagccgttgaccgcaacccgatagctgccgttgcgcagcgttttcgccagcgagcgcggaatatgcagcctgtcgggaaacaccaccgcacggggcccgaccgcataccaaaaaaaccacccgtcccgggaaaaccacggaaacacgccgttccgatacgcctcaagcagccgccccgcatccaaatcgccgctcacgccgaccagcccgtcgcaccgggccaaagcataggcaggatcgggaaaggcataattgtcaggggcaagcagcggaatacgcatgacagttctccaaaaacacaggcggcatccaaaatcatgaatgccgtctgaacaacaaaccgtccggatttaacgtttgcccttggcctgacagtcgctgcacacgccgtacatataaagcgcgtgatcgacgatgcggtagccgttttcttccgcgattttgtcttgcagggcttcgatttcgggattgtggaattccgttacctcgccgcacttcacgcagacgatgtggtcatggtggtcgcctttgtccaactcataaaccgccttgcccgtttcaaaatgatggcgttgcaaaatgcccgcctgctcaaactgggtcagcacacggtaaatcgtcgccacaccgatttccacaccctcttccaacaaaatgcggtacacatcttccgcactcaaatgctcttccgcatgcgtctcgaacaaatccaaaatcttcaaacgcgggccggtaaccttcagaccgctgtctttcagttgtgcaatattgttgaatttttccataatattcaatacccctgtaaaacaatagacgttataatacgcaatttcggcctgtttgcccactatcgcaccatagcagtttgcaatagtaaaaccgcaccggcggccgatgcgcggacagggcggataccgcttaatcgtatgattatcgttcgcttttataaaatattcaagcagtgttacactacccatcccgatttgcacagaaaggcatttccgtgaacaaaaccctcatcctcgccctttccgccctcctcggccttgccgcgtgcagtgccgaacgcgtttcactgttcccctcgtacaaactcaaaatcatacagggcaacgaactcgaaccgcgcgccgttgccgccctccgccccggcatgaccaaagaccaagtcctgctcctgctcggcagccccatactgcgcgacgcattccataccgaccgctgggactataccttcaacacctcccgcaacggcatcatcaaagaacgcagcaatctgaccgtctattttgaaaacggcgtactcgtccgcaccgaaggcgacgtcctgcaaaacgctgccgaagccctcaaagaccgccaaaacacagacaaaccataaggaacacacatgacaccgctcaaaatcgccatcgccggcgcaaacggccgtatgggacgcgtattggttgaagccgtcaacaaccatcccgacaccgtcctttccggtgcgcttgaacactcaggctcagaagccctcgggctggacgcaggctacgccgtcggactcaaaaccggcatcgccatttcagacgacgttgacgccgttctcgcacaaagcgacgtactcatcgacttcacccgccccgagcccaccctcaaacacctgcaaaaatgcgttgaaaaacaagtcaacatcatcatcggcacaacaggcttcgacgatacgggcaaagccgctatccacactgccgccgaaaaaacaggcatcgttttcgccgccaacttcagcgtcggcgtcaacctcaccttccacatcctcgacaccgtcgcacgcgtattaaacgaaggctacgacatcgaaatcattgaaggccaccaccgccacaaagtcgatgcccccagcggcaccgcgttacgcatgggcgaagtcatcgccggcgcgctcggcagagacctcaaacaatgcgccgtttacggccgcgaaggccacaccggtccgcgcgatccgtcgaccatcggctttgccaccgtccgcgcaggcgacatcgtcggcgaccacaccgccctcttcgccaccgacggcgagcgcgtggaaatcacccacaaggccagcagccgcatgacctttgccgccggtgccgtccgcgccgcagtttgggtcaacggcaaaacgggtttgtacgatatgcaggacgtactcgggctgaacaaccgttaacccccatacaaaatgccgtctgaaaagatattgttcagacggcattttgccgacaggctccgtatcggcatatcaatgtttcaacacacaggacgacacataaagcgtcgccctatgtgttgccctgattcggaaggggttacgcccctcccaaataaaatctgattctaccgccccgaaggacagatgtccgagtggcggggtttcaaccgaaaaggaaatacgataaagttgcctgctcagcataacaagctacggctcgtttaattgaaactctcctgatctaaaaattctaactctatttcccggcaaactatatctatactaaaaccggtcggaagatcatacctactgcctatcacttccagcgcacctccataatccaagatttcatcatcctgctttaattctccaagttccaatacatttttgatatttttatcttggttcttcgtggcgtatccatagataaatttcagatagctgaactgcttgaatttaatttttacccagtctgtataatttggtgtaggaatctcttgaggaaagtccggataatccacattctggacgatgatatggaattcatcgtttttcaaagtatagtttaatagagtgccctcatatatatacagaaattgataatctttttttggaatggtataagttgtcatattattttaccttttcaaaaacaatgagtttaagattttttgagtccaagttggttctactactcttatgaaatttcagttgtttaaactcttcctttattttaaggaatttttcaactagccgagaacaaactggagcaaaatggacgattgagtttaggaatcaacctgattcagtacatgggcaaagattagaattaaaatttagataaaggttacgttatgaatgtgaagataaaatataatcttttagaatattgtgaatatttaggtggtatttttggtgtttataaaaattatttaaatatggatatcaaagatccaaatttaaaaattagattttttgattttttggaagaacttttatcagatggtgttattgaattatgcgattatcgtgaaaatcctccaaaaatattaactggttcgccaaaaacacaggtagatgaattaagaagaatttggccggatatggaagagatgttgctatattttccagataatccttggttttatgtagaacatttttggtggggagcaacttgccctattgaactgacacaattgcctaaaatagaaatttacgaagaacaaatgaaacaaggtaagtaagcgtattagtataagctataatcataaatcatatataacaaaattaatcagttaactgaccattatattttaaccttaatcccattcgggccagttctgtttcatttggaattcctcttaaatacttattgtttgatgtgccattaatcacaatttctccccctttttttgtaatacgtgctgcttcgggaaaataatccattaaccgctcaacatcccgcctcttccaaaaccgcgcgcgcggccaaatccgccgtatcttttttcaacagcaggtgcaacgccctgaaatcctgttgcagcgcggcaaccttatcggggtgttcgtaccagtccgccaacgccgccgccagtttttccggttttgcttcagattgcaataattccggcacagcctccttacccaacaggatattcggcaggccgacatgcggcactttgattttgcgtttcacataagcataggtcagcggcgaaatcttgtagctgatgaccatcggacgcttacacaacgccacctccaaagttgccgtaccgctcgttaccagcaccgcatccgccgccctgcacactgtttcagactgtctgtcgattaccgtcagcggcaatccggcaaactccggccgctgcaaaacttccgccaaacgccgcttcgtcgcctccgttgcggcaggcagcaggaagcgtgcggcgggatagcgttccaacaacaataatgccgtctgaaaaaacaccggcgccatatagtcgatttcgctgacgcggctgccgggcagcagggcgaatacggggatgccggcatccacgcccaaagtttgccgcgccgtttcacggtcgtcttccaagggcataagctgcgccatcggatgaccgacaaactccgcacgtccgcccgcatcgagataaagctgcggctccatcgggaacaggcacaacacgcggttgacctgatgcacgattttgcccacacgttcccgccgccacgcccacaccgacgggctgacataatgcacggtcggaatccccgaccgtttcagcttttccgccacacccaaattaaaatcgggcgcatcgataccgacaaagacatcaggtttcaacgacagcaaatcccgtaccagccccctgcgtatccgtaaaatttccggcagccgcctgaccacttcgacaaagccgcgcaccgccagccgctcctgatcataaaggctctcgaaaccttccgccttcatcagttcgccgccgataccggtaaaccgcgcctgcggacaacgcttgcggatggcgcgtatcaggtgcgcccccaataggtcgcccgacgcttcgccgacactgacggcaatcaaagggctttttttatcagccatattcgtctgtccccacatactttcacgtcccgatgccgtctgaaggcttcagacggcatcggggttcacattttcgtcccgttttccaacatcaccgcaaactgcgccaagtccggcggcagctccgccttcaacaccagcggctcgcccgtgagcggatggttcaagtgcagctcggacgcgtgcaaaaacatccgcttcaaacccaacttctgcaaacgacggttcgcctgataatcgccgtagcgttcgtcgcccgcaatcggacagccttgagattgcaggtggacgcggatttggtgcgtgcgccccgttttcaacgtcgcccgcaccaaagtcaggtgcgacagcccgacaccgtgcaaaatgccgtctgaaaaacggcttaacacacggaacaccgtatgcgccgactgcccgtccgcactgacgcgcaccatcttttcgccttgtgcgccggtatatttgaacaggggcagtttgacatggaaattgtcgtccggcagtttgcccacccccagcgcaaggtagatttttttggggtggtcgttacggatggcttcgtgaagtttgacgagcgcgctgcgtttcttcgccaccatcaacaagccgctcgtatccttgtccaaacgatgaaccaactccaaatacttcgcctccggacgggcgcggcgcaactgttcgataacgccgaaactcacgccgctgccgccgtggacggcaacgccggacggtttgtcgatgaccaaaagcgcatcgtcttcgtaaacaacgtcaaacgcacgcgccggtacggcggcacgcctttcagacggcatttccttctccgccacgcgcacaggcggaatccgcaccgtatccccctccgcaatacggctgtcgggtttgcagcgtttcttgttcaaccgcacctcgccggcgcggataatgcggtggatatggctcttgggaacacccttgaggatttttatcagatagttatcaaggcgttgacccgcctcatgttcggcaacccctatcaagctgaccgaatctttgcttatttcgtgcgttttcatctataatccgaacatccgtttcagcaaaaagcgcgcccgccgcgcctcctgaaacggtttactttaaaacggaattttatattaaaaacgcactccgcaaagcattttccctgcgcctgttcccagccggcaggcgcagaacgtaatcaagtttgaattgattttgccgtttcggcgcggaagtaagacggcagccgggcccaagtcccaaacgcaaaccgcccaaaacacaggcatcacgataacaagaagaagccggcccccatttttccgaccgcagcgttcggaacgcggcagacaaaccgccgcatcgatctttatagccttctgtatccgacccttccgcacacggttctccggaacgtgcatccctgcggattttcaactcaaaaactgattaccggttttatccgaaaacatcggaaaacccagccttacggaatgccgaaccgggcatgtgccgtctgaacgccgcctgcccacgaggtgatcatgaaaagaatgttatttaacgcaacgcaggccgaagagctgcgcgttgccatcgtcgacggacaaaacctgctggatttggacatcgaaacgctgggcaaagaacagcgcaaaggcaatatctacaaaggcatcattacccgcatcgagccgtcgctggaagcgtgtttcgtggattacggaaccgaccgccacggcttcttgccgtttaaagaagtctcccgctcatacttccaagactacgaaggcggacgcgcgcgcatccaagacgtgctcaaagaaggcatggaagtcatcgtccaagtcgaaaaagacgagcgcggcaacaaaggcgccgcgctgaccaccttcatcagcctcgccggacgctatctggtattgatgccgaacaacccgcgcggcggcggcgtatcccgccgtatcgaaggtgaagagcgtcaagagttgaaagccgccatggcggaactcgacattccgaacggcatgagcatcatcgcccgtaccgccggcatcggccgcagcgcggaagagttggaatgggacttgaactacctcaaacaactctggcaggcgattgaagaagcaggaaaagcgcatcacgacccctacctgctctttatggaaagctcgctgctgatccgagccatccgcgactatttccgccccgacatcggcgagattttggtggacaatcaagaagtttacgaccaagttgccgagttcatgagctacgtcatgccgggcaatataggccgtctgaaactctacgaagaccacacgccgctgttttcccgcttccaaatcgaacaccaaatcgaaagcgcgttttcgcgcagcgtcagcctgccctccggcggcgcgatcgtcatcgaccataccgaagccctcgtctccatcgacgtgaactccgcacgcgccactcgcggcgcagacattgaagacaccgcgttcaaaaccaatatggaagccgccgaagaagtcgcccgacaaatgcgcctgcgcgacttgggcggcttggtcgtcatcgacttcatcgacatggaaaaccccaaacaccagcgcgatgtggaaaacgtcctgcgcgacgcgctcaaaaaagaccgcgcccgcgtgcagatgggcaaactctcccgtttcggacttttagaattgagccgccaacgtttgaaaccggctttgggcgaaagcagccacgtcgcctgtccgcgctgcgccggcaccggcgtgattcggggcatcgaatccaccgccctgcacgttttacgcatcattcaagaagaagcgatgaaggacaacaccggagaagtgcgcgcacaagtgcccgtcgatgtcgccaccttcctgctgaacgaaaaacgcgccgagctgtttgcgatggaagagcgtttggatgtcaacgtcgtcctgattccgaacatccacctcgaaaatccgcactacgaaatcaaccgcatccgcaccgacgacgtagaagaagacggcgaaccgagctacaaacgcgtcgccgagccggaagaagacgaatccgccaaaccgttcggcggcgaaaaagccaaagccgcccgtcccgaacccgccgtcaaaggcgtgcgccacaccagccccgccccgactgccgcccccgagaaaaaaacctcttggtgggacagcttcaaagcatggctcaaacgcattttcggcggcagcgaaacccaagccgcgcccgctgccgaaacctccgaaaaacgcagcacggcaaaccgcagcggcagccgcgccaacaaccgccgccaaaacccgcgccgcagcaaacgcgaaggcagcaaagtagaagtccgcgaagtggcaggcaaaactgccggacaggaagcgcgtgccgacaaagccgaaacgcgcaacaacggcaaccgccgccgcaatgaacgcggcgaccgtgccgccgaacgcgccaacgaagcggaaatccaaagccgcaacgtacagcctgccgcaaccgttgcagatgccgcaccgtccgaaaccgaagtgcaaaccggaaaacgccgccgcaacggcagccgcagcgaacgcggccaaaccgcgccggaaaccgccaccgttgccgaaacaaccgttcagacagcggaaaacacgccgtccgaaccgcataccgcagaagacaaaggcagcaagcccaaatccgaacgcaaccgccgcgaacgcgacagccgagatgccaaagaacgccgcgagcgcaacaatcagcgcgaccgccgtcaaaacggcaaaaaacgcaatattccgtctgccgccaaaatcgagcagtacctgaatattcacgacaccgccgacaaagtccgttccgccgccgcgcacgttttcggcgaaaccgacgcaaacgcgccgattactgtcagcattgccgatccggttgcagaaagggatcttccgacagcatctcccgccgtttcaaacggcgacgcaccggtttatgatgcggcggaaaaaatccgccgtgccaccgccgccatcctgcccgaaggcgcgacaccgaaagccgaagcacaggaaatgccgtctgaaaccgcaacctttacggctgcggcggaacaggcacgggaaaccgcacaaaccggcggactcgtcctgatcgaaaccgaccctgccgcattgaaggcatgggcggcacaacccgaagtccaagccggacgcggtttgcgccgttccgaacagcccaagccgtctgaagtcgcaaccgtccctgccgaagaaatgatccaagtcgaaacccggcaaggctgaaccgacggcggcaaaaagaggttctgttccgcagaacctcttttttacatgggttcggatacctgcaatgccgtctgaaacttcgccattcccgtgattaccgaaacattccgccattcccatgattcccgcaacattccgtcattcccatgattcccgcaacattccgtcattcccatgattcccgcaacattccgtcattcccatgattcccgcaacattccgtcattcccgtgaaaacgggaatctagaacctcaaactttcggataatctttgaatattgccgtcgcccaaaggcctggattcccgcctgcgcgggaatgacggcggagggtggacgatgccgtctgaaacttcgccattcccatgattaccgcaacctttcgtcattcccgccacctttcgtcattcccgtgaaaacgggaatctagaacctcaaactttcggataatctttgaatattgccgctgcccgaaggtctggattcccacaacctttcgtcattcccgtgaaaacgggaatctagaacctcaaactttcagataacctttgaatattgccgctgcccgaaggtctggattcccacaacatttcgtcatttccgtgaaaacgggaatctagaacctctaaactttcagataatctttgaatattgccgtcgcccaaaggcctggattcccgcctgcgcgggaatgacggtttagaagttgcccgaaacctcaaaaaaaaccgaaaccgaacaagccggattcccgcaacattccgtcattcccgtgaaaacgggaatctagaacctctaaactttcagataatctttgaatattgccgctgtccaatggtctggattcccgcctgcgcgggaatgacggtttagaagttgcccgaaacctcaaaaaaaccgaaaccgaacaagccggattcccgcaacattccgtcattcccgtgaaaacgggaatctagaacctcaaactttcagataatctttgaatattgccgctgtccaatggtctggattcccgcctgcgcgggaatgacggtttagaagttgcccgaaacctcaaaaaaaaaaaccgaaaccgaacagaccggattcccgccacctttcgtcattcccgtgaaaacgggaatctagaacctcaaactttcggataatctttgaatattgccgctgtccaatggtctggattcccgcctgcgcgggaatgacgatttggaaattacccgaaacccaaaaacaactgaaaccgaacagaccggattcccgcctgcgcggaaatgacgggtcttttatcatctttaaaggctgccgcgcgccatctcgacggcggtctccacggcagttatcaggctgccggaatccgccctgccggttgccgccaaatcaagcgcggtgccgtgatcgacggaggtgcggataaagggcaggccgagcgtgatgttcacgccctgtccgaagctgtggtatttcaacacgggcagcccttggtcgtggtacatcgccaatacggcatccgcaccttcgagcataaacggctggaacaatgtgtccgccggatacgggccggcaaggtttatcccttcgcggcgcaggttttccaatgcagggataatggtgtcggtttcttcgtgtccgaggtgtccgccttcgccggcgtggggattaagtccggcgacaaggattttgggatttttgatgccgaatttgtgttttaagtcgtgatgcaaaatgcgtgcgacgctttcaatcagcggttgcgtgatggcggcggcaacgtctttcagcggcaggtgggtcgttacgagggcgacgcgcaggcctttgccggcaagcatcatcacgacctgccccgtgccgcttttttccgccagatattcggtgtgtccgctgaaaaaacctgtgcttgcgcgcgcgtcgttgatgatgcctttgtgcagcggcgcggtaacgatgccgtcgaaaatgccgtctgaaatgcctgcgagcgcggtgtccaaaagttgcagcacataggcggcgttggcgggattgagtttgcccgcctcaaccgcttcgacggcagggatgtgcagcacttccagctcgccgtatgccgcgccgcctgattctggatcgaagtcgcgcaggacgacgcttttgcccaaggcttcggcgcgcgcgcgcaataggtttttgtcgcccaataccgcgcagcggcagggcaggcgtgcaaacgccaagtccaaacaaatatcggggccgatgccggcaggctcgccggaagtaacggcaaaaacaggctgtttcatcgtgtttgctccaaacaaaatgcgattctaacgccgcagccgcgcggcgatgtaaatttttctgattttgttgacaatctgctagaatgggcgtttacaaaatttaaaccctgcttgcataccgccaatatgtgcgagtttcaactttaaggaagcgatatgaacgagaactttaccgaatggctgcacggctgggtcggcgccatcaacgatccgatgtggtcatacttggtttatatgcttttgggtacggggcttttcttcaccgtaaccacgggctttgtccaattccgcctgttcgggcgcagcatcaaagaaatgctcggcggccgcaaacagggggacgaccctcacggcatcacgccgtttcaggcatttgtaaccggccttgccagccgcgtgggcgtgggcaatatcgcgggcgtggccatcgccatcaaagtcggcggaccgggcgcggtgttttggatgtgggtaaccgccttaatcggtatgagttcggcgtttgtcgaatcttcgctggcgcagctctttaaagtccgcgactacgacaaccaccatttccggggcggccctgcctactacatcactcaagggctggggcagaaatggctgggcgtgttgttcgccctgagcctgattttctgtttcggctttgtgtttgaagcggttcagaccaataccatcgccgataccgtcaaagcggcatggggttgggagcctcattatgtcggcgtcgccctggtgattttaaccgcgccgattatcttcggcggcatcaggcgcatatctaaagcggcggaaatcgtcgtccccctgatggcggttttgtacctctttatcgcgcttttcatcattttgaccaatattccgatgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaaatcccgcccttaccggagccgcttccccgcgaagcggcttttccctttccgcacactgtaaaaacagggcgaacaagcgtacaatcccaaccctttacttttgaatccatttcgtttttcagacggcatattgaatatagtggtttaacaaaaatcaggacaaggcgacgaagccgcagacagtacaagcagtacgaaaccgattcacttggtgcttcagcaccttagagaatcgttctctttgagctaaggcgaggcaacgctgtactggtttttgttaatccactataaatgccgtctgaaacaccgtcaggcaatacacactatgacccacatgatttaccccaaaacctacgacgttatcgtcgtcggcggcggacacgccggcacggaagccgcactcgccgccgcccgtatgggcgcgcagacgcttttgctctcacacaatatcgaaacgctcggacaaatgtcgtgcaacccctctatcggcggcatcggcaaagggcatttggtgcgcgaactcgacgcgctcggcggcgcgatggcgttggcaaccgacaaatccggtatccagttccgccgcctgaacgccagcaaaggcgcggcagtgcgtgccacgcgcgcgcaggcggaccgcatcctgtacaaagccgccatccgcgaaatgttggaaaaccaagaaaacctcgaccttttccaacaagccgtcgaagacgtaacgctcgacggcgaacgcatcagcggcgtaattaccgcgatgggcgtggagtttaaagcacgcgccgtcgtgttgaccgcaggcacgtttttgtccggcaaaatccacatcggtttggaaaactacgaaggcggacgcgccggcgaccccgccgccaaatcgttgggcggacgtttgcgcgaattgaagctgccgcaaggccgtctgaaaaccggcacgccgccgcgtattgacggacgcacgattgacttctcccaactgaccgaacagcccggcgacacgcccgttcccgtcatgtccgtgcgcggcaacgccgatatgcacccgcgccaagtgtcctgctggattacgcataccaacacgcaaacccacgacatcatccgctcaggcttcgaccgcagcccgatgtttaccggcaaaatcgaaggcgtgggtccgcgttattgtccgtctatcgaagacaaaatcaaccgcttcgccgacaaagacagccaccagattttcctcgaacccgaaggtctgaccacgcacgaatactatcctaacggtatctccaccagcctgccgttcgacatccaaatcgcgctcgtccgcagtatgaaaggtttggaaaacgcccatatcctgcgccccggctacgccatcgaatacgactacttcgatccgcgcaacctcaaagcaagcctcgaaaccaaaaccattgccggattgtttttcgccgggcaaatcaacggtacgaccggctacgaagaagccgccgcgcaaggtttattggcaggcgcgaacgccgtgcaatatgtgcgcggacaagacccgctcctgctgcgccgcgaacaagcctacctcggcgtattggtggacgacctcatcaccaaaggcgtgaacgaaccctaccgaatgttcaccagccgcgccgaataccgcctgcaactcagggaagacaacgccgacatgcgcctgaccgaagacggctacaaaatcggcttggtgtccgaagcgcaatggcgcatgttcaacgaaaaacgcgaagccgtcgaacgcgaaatccaacgtttgaaaacaacgtggtacacgccgcaaaaactcgccgaaggcgaacaaatccgtgtgttcggacaaaaactcagccgcgaagccaacctgcacgacctcctgcgccgcccaaacctcgactacgccgcgctgatgacgctcgaaggcgcgatgccgtctgaaaacctctccgccgaagtcatcgaacaagtcgaaatccaagtcaaataccaaggctatatcgaccgccaaaacgaagaaatcgacagccgccgcgacatcgaaaccttaaaactgcccgacggcatcgattacggcaaagtcaaaggcttgtcggcagaagtgcagcaaaagctcaaccagcacaaacccgaaaccgtcggacaagccagccgcatttccggcgtaacccctgcggcagtggcattgctgatggtgcatttgaagcgcgggtttaaagacgcgaaataaacacatcggcgcgatgccgtctgaaacccttttcagacggcattcccaccatcccgacaggaaacatcatgcacatactgaccgccggcgtggacgaggcaggacgcggacctttagtcggcagcgtgtttgccgccgccgtcatccttccggaaacattcgacctgcccggactgaccgactccaaaaaactcagcgagaaaaaacgcgacgcgcttgccgaaatgataaaaaatcaggcggttgagtggcacgttgccgccgcctcgcccgaagaaatcgccagcctcaacatcctgcacgccaccatgctcgcgatgaaacgcgccgttgacggcttggctgtgcgtcccgaaaaaatattcatcgacggcaaccgcattcctgaacatttgaacatccctgccgaagccgtcgtcaaaggcgacagcaaaatcatcgaaatctccgccgcatccgttttggcaaagaccgcacgcgatgcggaaatgtacgcactggcgcaacgccatccccaatacggtttcgacaaacacaaaggttacggcacgaagcagcatttggaagccctcgaaaaatacggcgtgctgcccgaacaccgccgcgacttcgcccccgtcagaaacctgctcgcgcagcaggccttgttttaaaccggcacaaaaatgccgtctgaagccttcagacggcatttccggcatcgcaactccaaagagaaagaacccaaaccgtcattcccgcgaaaaatagaaaatcaaaaaaaaaacctaaaatccgtcattcccgcgcaggcgggaatccaatccgtccggtttccgttttttttttgaatttcaggtaacttccaaaccgtcattcccgcgaaagcgggaatctagaaactcaaagctgcaagaatttatcaaaaatgactgaagctcaaaaaaccggattcctacgaaaacaggaatccggagtctcagggctggcaaaaccgttttacccgataagtttccgtaccgacagacctagattcccgccttcgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaaaaaccggattcccgcgaaaacaggaatccggagtctcaggtttggaaaaaccgtttttcccgataagtttccgtaccgacagacctagattcccgccttcgcgggaatgacgaaattttaggcttctgttttgattttttgtttttgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaaaaaccggattcccgcgaaaacaggaatccggagtctcagggttggaaaaaccgtttttcccgataagtttccgtaccgacagacctagattcccgcctgcgcgggaatgacgatatttcagttttgtgtttttgatttttttgtttttgcgggaatgacgataaatgacgatataagtatttttattttaatccgccatattatagtggattaacaaaaaccagtacggcgttgcctcgccttagctcaaagagaacgattctctaaggtgctgaagcaccaagtgaatcggttccgtactatttgcactgtctgcggcttcgtcgccttgtcctgatttttgttaatccactataacgcacccggccaaacagcataaaggcacgggcagcccgatttggattgacctatttccccgacaccctcgccgccagctcgtccgccaaggcaagatacgccttggtaccctttgcctgcgcgtcgtaagccatcaccggcataccgtggctcggcgcttccgcaaggcggatattgcgcgggatgacggtttcaaaaagcaaatccccgaaatggctgcgcaactgttcgctgacttcggcaaccagcctgctgcggctgtcgtacatcgtgcgcacgatgcccgtgatgtccaaatcgggattgaccgcctgacggattttgcgcacggtcgcaatcaaatcggaaatcccttccagcgcgtaatattcgcacaacatcggcacaatcacgccgcccgccgccaccagcccgttaagcgtcaacagcgtcagcgaaggcgggcagtcgatcaggataaagtcgtaatcttcttccactgccttgagcgcgtttttcaaacgcacttcccgggcgatttcctgcaccagttcgatttccgcgccggccagcgcgcggttcgcacccaacacagcgtatccgccctctttgctgcgtaccgccgccgactgcacgtccgcatcgcccaataagacctgataaacgccggactgcaaacccgccttgtcgatgccgctgcccgtcgtcgcattgccctgcggatccaaatcgaccaccagcacgcgtttgccgcgcgatgccagcgaagccgccaaatttaccgtcgtcgtcgttttgcccacaccgcccttctgattggcgatggcaaggatgttcgcactcatgtcccgcccgtgtcccgtctgatgttgaaaaaagaaaaacagtgcggaattttacctttatccgcacaaaaaaggtattcatgccgtctgaagtgcgctcaacgcttgctcaggatgacgatatggcgttccgcatccaagcccggcacgtcgagcctttggactttttcaacgcacacatcctgcggcaggcggccgatttcttcctgcggatacacgcccttcatcgccgcccagtagccgccgtctttcaacagatgcaccgtccacgacacaaaatccgccagttctgcaaacgcacggctggtaaccacatcggcacgcacgtccgaaaccgcctccacgcgtccggataccacgcgcacattgtccaaccccaactcgataaccgcctgctgtaaaaaagccgttttcttcgtattcgcatccaaaagggttatttgcacatccggacggcacaccgccgccggaatgccgggctgaccgccgcccgaaccgacatccagcatcgtttgcacaccctcgatatggggcagcagcgtcaggctgtccaaaagatgatggacaatcattttttcctcgtcgcgcagggcggtcagattgtaggttttgttccactttttcaacaaatccacatagaccaaaagcctgtcctgcgccgtttccgaaatatccagccccatcgcggcaatgcctgcacgcaggcgttctttgcgttccatatctgcttcctgtccatattcaggcgtaatgttagcggaaaaacatgccgtctgaaaccgcgtgtcgggtttcagacggcatttcccgttccaacctattttttcctgtgaaacaccaccggctgcaccggcgcgcgcgtcaggcgtttgggcagcgtcagcatcgccaccagccacacggcaaacgcatattccaacaccgcctcccccgcagcccgcccaaagccccactgccaagcagcagctcgaaaatccaagccaccgctgccgccgcgcaagccgccacgcccgacagaaacagtgtgtaacgcgaatgccgccgcatcatctttttgtacgccagtttcgtcagacccgccgacacaaccacattcaaaaacgcaaacacaccgaacacaaaccaaacagtgccgtcccaaccgccacgccagccgaatccgccgtccgacaccgacaccagcaaccccgtccgtccgaacgcaagcgcaaaggcatcatgcaccgccaacgcaaacggcagcgtcaaaaacaccagtcccgcaaacagagccgcataaggatatttctcgttcacaaacatcgccgtccccctcttccgaagcagaccgcattatatagcggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactataccgcgcactgccttgccgcccgcccgaaaagttgcacaaacaaccgttcatatatatcatgacgaaaaaacgccggtgtagctcagtcggtagagcagcgcattcgtaacgcgaaggtcgggggttcgattcccttctccggcaccaataccaagcacagaccctcccttcctcgggaagcctgtgctttttcacatttccgcttcagacggcacaaccgatatgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcagggctgacgatgtgtatgctcatcggcgacaacggcagcgaatggctcgacagcggactcatgcgcgccatgaacgtcctcatcggcgcggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagccgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctgacggtcggacacgatgccgtctgaaacgcctgtcgcttcagacggcatccccaatccgcctaccttgtcgttatgcccgaataacggtactattcgcggttaacggtctttatgccgtctgaacggcttgaaacgcgttcagacggtctcccgcccaccttatcccaccgaaagaacaatatgatcaacgatattcaaaaaacagccgaaggcaagatgcagcgttcggtcgaagtactgaaagaaaatctggcgaaagtgcgtaccggccgcgcgcataccggcctgctcgaccaagtggaagtcgaatactggggcagcatggtccccgtcagccaagttgccaacgtaacgcttctggacgcgcgcaccatcggcgtgaaaccgtttgagggcaatatggcggccaaagtcgagaaagccatccgcgattcaaacttgggactgaacccggcagctgtcggcgacctgatccgcgtgccgatgcccatgctgaccgaggaacgccgcaaagacctgattaaagtcgtacgcggcgaagcggaagaaggccgcgtctctatccgcaacgtgcgccgcgatgccaacgaccacatcaaaaaactcctcaaagacaaagaaatttccgaagacgaggcacgtcgcggcgaagaagcggttcaaaaactgaccgacaaatacattaccgaagccgacaaactcctgactgccaaagaagaagatttgatggcaatttaacctgcacggttcggcgttcagacggcatttgaatgccgaaccgcgaaaggcagacatgaaaagcagcacgcaggccgttttggaacacaccgccattcccaagcatatcgccgtgattatggacggcaacggccgttgggcgaaaaaacgtttcctcccgcgcataatgggacacaaacgcggtttggacgcattggaaaatatggtgaagcattgcgccaaactgggtgtgcaatatctgaccgtgtttgccttttcaaccgaaaactggcgccgccccgaagacgaagtttcgttcctgatggggctgtttttacaggctttgcaaaaacaggtacgccgcctgcacgaaaacaatatgcgcctgaagatattgggcagccgcgaacgcttcaaccggcagattctgcaaggcatcgaagaggcggaagcgttgacggcaaacaataccggcctgaccctgagcattgccgccgattacggcggccgctgggatattttgcaggcggcaaacaaactgattgccgaaggcgtatccgagattacggaagacacgctggcgaaacacttgatgctgggcgatgcaccggaaccggatttgttcatccgcaccggcggcgaaacgcgcatcagcaatttcctgctctggcagatggcatatgcagaactgtatttcaccgatattttgtggcccgattttgacggcaaggctttggacgatgccgtcgcttcgttccaaaaacgcgaacggcggttcggacgcacctccgagcaactgcctatcgaacagcaaaggaactgaatatgctgaaacaacgggtaataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcgccggcaatcagccccggcaaaagctgggaaggtgcaatcggcggcgcggtttgcgtggcagtgtacatgaccgccgtacgaagtgccggctggctggcattcgatacaggctggttcgataccgtgttaatcggtttggtgctgaccgttgtcagcgtatgcggcgaccttttggaaagctggctcaagcgcgcggcaggcatcaaagacagcagcaagctgctgcccggacacggcggcgtgttcgaccgtaccgacagcctgattgccgttatcagcgtctatgcagcgatgatgtcggttttaaattgattctatgccgtctgaaaacgcttcagacggcatccggtataaagttatccccattatgacaccacaagtcctgaccatattaggcagtaccggcagcataggcgaaagcacgctggacgttgtctcccgccaccccgaaaaattccgcgtattcgcgctggcagggcataagcaggtcgagaaattggcggctcaatgtcaaacgttccaccccgaatatgccgtcgttgccgatgcggaacacgccgcccggcttgaagccctgttgaaacgcgacggcacggcgactcaggttttacacggcgcgcaggcattggttgacgttgcctctgccgacgaagtcagcggtgtcatgtgcgccatcgtcggggcggtggggctgccttccgcgctcgcagcggcgcaaaaaggcaaaaccatttatctggcaaacaaagaaacgctggtggtttccggcgcgttgtttatggaaaccgcccgtgcaaacggcgcggcagtgctgcccgtcgacagcgaacacaacgccgttttccaagttttgccgcgcgattacgccggccgtctgaacgaacacggcatcgcttcgattatcctgaccgcttccggcggcccgtttctgaccgccgatttaaacacgttcgaccgcattacgcccgcccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatccgtgatacacagcatggtgcgctaccgcgacggctccgtgctggcgcaactgggcaatcccgatatgcgaacgcccatcgcttattgtttgggtttgcccgagcgcatcgattcgggtgtcggcgacctggatttcgacgcattgtccgcgctgaccttccaaaagcccgactttgaccgcttcccctgcctgaggctcgcctatgaagccatgaacgcaggcggagccgcgccctgcgtattgaacgccgccaacgaagccgccgtcgccgcctttttggacggacagattaagtttaccgacattgccaaaaccgtcgcccactgtcttgcacaagacttttcagacggcataggcgatataggggggctcttggcgcaagatgcccggacacgcgcacaagcgcgagcatttatcggcacactgcgctgatgccatctgaacaccgttatcaaaggaaaaccatttgcacacccttctagcttttatcttcgccatcctgattttggtcagcctgcacgagttcggacactacatcgttgccagattgtgcggcgtcaaagtcgtacgcttttccgtcggcttcggcaaaccgtttttcacccgaaagcgcggcgacaccgaatggtgcctcgccccgattccgttgggcggttacgtcaaaatggtcgatacgcgcgaaggcgaagtatcagaagccgatttaccctacgcttttgacaaacaacaccccgccaagcgcatcgccatcgtcgccgccggcccactgaccaacctcgcactggcggttttgctgtacggactgagcttttccttcggcgtaaccgaactgcgcccctacgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgaactacgaacgcgccggacaaacccataccgccgacatccgccccgatactgtcgaacagtccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccgggccgctgaccattgccgacattgccggacagtccgccgaactcggcttgcaaagttatttggaatttttagcactggtcagcatcagcctcggcgtgctgaacctactgcccgtccctgttttggacggcgggcacctcgtgttttatactgccgaatggatacgcggcaaacctttgggcgaacgcgtccaaaacatcggtttgcgcttcgggctcgccctcatgatgctgatgatggcggtcgccttcttcaacgacgttacccggctgctcggttagattttacgtttcggaatgccgtctgaaaccgcattccgcaccacaaggaactgacaatgaaactgaaacagattgcttccgcactgatgatgttgggcatatcgcctttggcacttgccgacttcaccatccaagacatccgcgtcgaaggcttgcagcgtaccgagccgagtaccgtattcaactacctgcccgtcaaagtcggcgacacctacaacgacacacacggcagtgccatcatcaaaagcctgtacgccaccggtttctttgacgacgtacgcgtcgaaactgcggacgggcagctcctgctgaccgttatcgaacgccccaccatcggctcgctcaacatcaccggcgcaaaaatgctgcaaaacgacgccattaagaaaaacctcgaatcgttcgggctggcgcagtcgcaatactttaatcaggcgacactcaatcaggcagtcgccggcctgaaagaagaatacctcgggcgcggcaaactcaatatccaaatcacgcccaaagtaaccaaactcgcccgcaaccgcgtcgacatcgacatcacgattgacgagggcaaatccgccaaaatcaccgacatcgaatttgaaggcaaccaagtctattccgaccgcaaactgatgcggcaaatgtccctgaccgaaggcggcatttggacatggctgacacgaagcaaccaattcaacgagcagaaatttgcccaagatatggaaaaagtaaccgacttctaccaaaataacggctacttcgatttccgtatcctcgataccgacatccaaaccaacgaagacaaaaccaagcagaccatcaaaatcaccgtccacgaaggcggacgtttccgttggggcaaagtctccatcgaaggcgacaccaacgaagtccccaaagccgaactggaaaaactgctgaccatgaagcccggcaaatggtacgaacgccagcagatgaccgccgttttgggtgagattcagaaccgcatgggctcggcaggctacgcatacagcgaaatcagcgtacagccgctgccgaacgctgaaaccaaaaccgtcgatttcgtcctgcacatcgaaccgggccggaaaatctacgtcaacgaaatacacatcaccggcaacaacaaaacccgcgacgaagtcgtccgccgtgaattacgccaaatggaatccgcaccttacgacacctccaagctgcaacgttccaaagagcgcgtcgagcttttgggctacttcgacaatgtccagtttgatgctgtcccgcttgccggcacgcccgacaaagtcgatttgaacatgagtctgaccgaacgttccaccggttccctggatttgagcgcgggttgggttcaagataccgggttggtcatgtccgcaggcgtttcccaagacaacctgttcggtacgggcaagtcggccgcactgcgcgcctccaggagcaaaaccacgcttaacggctcgctgtcgtttactgacccgtacttcacggcagacggggtcagcctgggctacgatgtttacggaaaagccttcgacccgcgcaaagcatcgaccagcatcaaacaatataaaaccaccacggcaggcgcaggcatccgcatgagcgtgcctgttaccgaatacgaccgcgtgaatttcggtttggtggcagaacacctgaccgtcaacacctacaacaaagcgcccaaacactatgccgactttatcaagaaatacggcaaaaccgacggcacagacggcagcttcaaaggctggctgtacaaaggtaccgtcggctgggggcgcaacaaaaccgacagcgcgttatggccgacgcgcggctacctgacgggcgtgaacgccgaaatcgccctgcctggcagcaaactgcaatactactccgccacccacaaccaaacctggttcttccccctgagcaaaaccttcacgctgatgctcggcggcgaagtcggcattgcgggcggctacggcagaaccaaagaaatccccttctttgaaaacttctacggcggcggcctgggttcggtgcgcggatacgaaagcggcacgctcggtccgaaagtctatgacgaatacggcgaaaaaatcagctacggcggcaacaaaaaagccaacgtctccgccgagctgctcttcccgatgcccggcgcgaaagacgcgcgcaccgtccgcctgagcctgtttgccgacgcaggcagcgtgtgggacggcaaaacctacgacgacaacagcagttccgcgaccggcggcagggttcaaaacatttacggcgccggcaatacccataaatccacctttaccaacgaattgcgctattccgccggcggcgcggttacctggctctcgcctttaggcccgatgaaattcagctacgcctacccgctgaagaaaaaaccggaagacgaaatccaacgcttccaattccaactcggcacgacgttctaatcccgcaaatgccgtctgaagcccttcagacggcatttcgcggcaacattcgaaggagttttaccatgacccgtttgacccgcgcgtttgccgcggctctgatcggtttgtgctgcaccgcaggcgcgcacgccgacaccttccaaaaaatcggctttatcaacaccgagcgcatctacctcgaatccaagcaggcgcgcaagattcaaaaaacgctggacagcgaattttccgctcgtcaggacgaattgcaaaaactgcaacgcgaaggtctggatttggaaaggcagcttgccgaaggcaaactcagaaacgcaaaaaaggcgcaagccgaagaaaaatggcgcgggctggtcgcagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcagaacgtgatttacgtcaacacccaatacgacgttaccgacagcgtcattaaagaaatgaacgcccgctgaccctttcagacggcataccgaacaggaaaaccatgattccggccacctacaccctgtcccaaatcaccgcgcggctcggcggcgaatggcgcggcgaggacatttccgttaccgccgtgcgcccgctcgcagacgcgcaggcggaacacatcagcttccttgccaatccgaaatacaaagccgaagtccacgacagcagcgcgggcgcggtcatcgtttccgccaaagcggcagacggatttgaagggcgcaacctgattgtcgccgacgacccctatctctatttcgccaaagtcgcccgcctgttttcacccgtcgtcaaagcgcgcggcggcatccatccgaccgccgtcgtcgaaccgggcgcgaccgttcccaccagctgcgaaatcggcgcgaacgtctacatcggcgcaaacaccgtgctcggcgaaggctgccgcatcttggcaaacgccgtcgtccaacacgattgcaaactgggcgacgaagtcgtcctgcatcccaacgccgtcgtttattacggctgcacactgggcagacgcgtcgaaatccacagcggcgcggtcatcggcgcggacggtttcggactcgccttcgccgacgattcgtggttcaaaatcccgcaaaccggcgcggtaacgctgggcgacgacgtagaaatcggctcgaacaccaacatcgaccgcggcgcgatgagcgacaccaccgtcggcaacggcaccaaaatcgacaaccaagtccaaatcggacacaactgcaaaatcggttcgcacaccgtcatcgccgccaaaaccggcatctcaggtagcgtaaccataggcagctactgcatcatcggcggcggcgtcggtacggtcggacacatcgaaatcgccgacaaaaccaccatcggcggcggcacgtccgtcacccacagcattaccgaaagcggcaaacacctcgccggcatcttcccgatgtccacccataaagaatgggcgcgcaacgctgtttacatccaccgcttaagcgaaatgaacaaacggctcaaaacactggagcagcagctttcagatgccggtcaagacagcaaataaccaaaccgactttattcaaggaatacgacagacatggacgtacaactccccatcgaagccaaagacatccaaaaactcatcccccaccgctatccgtttctccagctcgaccgcatcaccgccttcgagccgatgaaaaccctgaccgcgattaaaaacgtcaccataaacgaaccccagttccaaggccatttccccgacctgcccgtgatgcccggcgtactcatcatcgaagcgatggcgcaggcgtgcggcacgttggcgattttgagcgaaggcgggcgcaaagaaaacgaattcttcttcttcgccggcatagacgaagcccgtttcaaacgccaagtcatccccggcgaccaactcgtctttgaagtcgagctgctgaccagccggcgcggcatcggcaaattcaacgccgttgccaaagtggacgggcaagttgccgtcgaagccatcatcatgtgtgccaaacgcgtggtttgagtgttcagaaaaaggtcgtctgaaagttttcagacaacctgttgccgtcgcgcatcttcgcggcaacacgacaggaaaggaaaaacatgaccctcatccacccgaccgccgtcatcgaccccaaagccgaactcgactccggcgtcaaagtcggcgcgtacaccgttatcggccccaacgtccaaatcggcgcgaataccgaaatcggtccgcacgccgtcatcaacggccacaccagcatcggcgaaaacaaccgcattttccaatttgccagcctcggcgaaatcccgcaggacaaaaaataccgcgacgagccgaccaagctgattatcggcaacggcaacaccatccgcgaattcaccacctttaatttaggtacggtaaccggcatcggcgaaacccggtatcggcgacgacaactggattatggcgta

SEQ ID NO: 27 - DNA, 69876 bp, Neisseria meningitidis
atttcggcgagccgtagggtgggctgtagggtgggcttcagcccaccaatttcaccgcatcaaaggtttttgggaatacggcggtttcggttttcggtgggaatgggcggaatkgataacattgacggagttgggggaataggtggaaacggtgggattggtgggctgaagcccaccctacagccagccctatgtccacgctgcacatcctacgcccgccttgcgtttcttataagcagcattttacgcaatactttgcgtccgctgaaaaaatttcaaacggtcttttttatcaaatgcgaaaaatataacgtcattcccgcgcaggcgggaatctagtctgtcggtgcggaaacttatcggataaaacggtttctttagattttacgccctagatcccgtctgctcgggaataacgggatttgaggtttctgtttttgattttctgttttcgcgggaataacggtttagaagttacccgaaacctcaaaaaaaccgaaaccgaacggactggattcccgcctgcgcgggaatgacgggtttcgagattacggtgtatcggggatgatggaaaatggcggggattgtgtaaaaaatgccgtctgaagcctttcagacggcatttgcggcgtttggacgtttagaacttcatttccaagctaaatgtgtagttgcgaccgggggcggcatatcggttgtaaacgccgacatttttgtgttggttgactgcgccgccggcagtttgccgcacattttcccaagtaacatagcggtagttgaggaggttgtacacgcccgcacggagggtaaagtgttttttaaccgtgtaataaccggacacgtccacaatataccaagggcgggtacggcgcgcggtggcttttgtattgcggctgttgccgttgagcaaagcccggctgcccaacaactctgtgatttccttggctttggaataagtcagcataccgttcacaccccatttgccttccggttggtcatagcccaagccgacgacatagcgcgagggttggatggcatcaaacagatgtgattgaatatcggtgcggtctgcgcgttttttgatgtcgcggacacggacacgattataggcaaatgtagaataccaaccttcgggcaatttatcccatacgccgttccaatcgattttgcccaaaatattgatgccggtaatccgcgcgctttgggcattgaggtaagccgggtcgcctttggcttcttctttgccgtctttaatttgcgcttcataaccccggacaatcaaatcgcggtaggcattgttgaaccaacttgcctccaagttgccgaaatcgcctttaaacacgatgccggcttctttgttgaacgatttttccggatcgattttgaccgccttgctttgaacacccgcccgccagccgtacatttccgcaaacgagggcaggcggaagccggttgaggtgcggtaagtcaaatccagccagtcggtaggtttgaggacgatgccggcgttccaggacaaggtgcggtgcgtgccggtggaaacgctgccgtcgtccgaatgcgtgctgcggtagtcgtagcgcaagcccgcgccgacatccgcccacctgcccaaacggacattgtcccgaactgccgcgtaatagcttttaccgttgatgctgcgcggcgtgcagtccgtataagtattgttgcccaagcggcagatttgccccgtaacgacatttcccctgcctatggtgacccaataggggctggtttcactgccgttggggctgatttttttgccgttgttttgagggggcgtgttcgacgaataggcgcggttggcatgttgataataataatcctgatggcggagattagagccaaagcggtcaaacccgagattcacgctcaggttgtggcggattttggcggtatcgaaggattttttgaatgccgcctgcaagagcctgtggctttccccgtaaatcacgcgatcggatttgtaataggaaaacggcttgtcggcactcgggcggcaatatttgtccgaaccgtcggcagaacagtgcgtctgctgaaaatgattatccaaaccgatgccctgccggtcgtaagagaggcgggcataatccgcccaagtgtctttatcggcattggtatagacatattccaaaccgtagcggcttttggtgtgcgtctcgtcgtaaaacacgcccgtaccgtattccgcgcccaccagcgcaccgttttcgccgttggtaaacagtccgccgtatttgtggttgcccgcgtatttgccgttaccgggcaaagaacccgcctgttttttatttgcatcaaaaaccgccttggtcaggaatgccggaaccgtcatatcgcgcgtgtcgaaagtttgttgcgtgtgttcgagtatgccgccgatgtagtgccgcttattctcaaaacgaaaacccgggcggaacagccacgaccggctttcgtatgaaagcggatcggcgaggaagcggttgggacccgtgtagtctcgggtggaaaccgtttgacgttcgtctttgccgacaacatcttttttcggattcgctttacacgtttcataactcccgtttttgcattcttctttaacgatgaaataggcgtaattgctgctgtcttcaaccggcaccagcctgttaaagctctgaacgccgcgtcctgcatcttcgtgggcgcggatttcccccgcgcgccgcccggtgtggatcagcaaagcctccgcaccgccgatgcgccccgccagcgcgatggattgggtaagcccccggtttttgccggaataggcggttttactctgaatgccccactgcctgccttccccgataacatcgtcggcggttttggtttgaaatgcgaccgagcccgccaatgcgccgctgccttgttcgaccgagtttgagcctttgctgatttcgacagctttgacgttttcatactcgatttcattgattgcgccgctgctgcccgccgtcctcgtcccgcccaatgccgcctgcgcggtgtaggactgtatttgcgaaacgccgtccaccgttaaggaaacgcggtttttatccatgccgcgtattgaatagccggaacttgcgccccgaccctgttcgaccacggcaatacccggatcataacgggtcaggtctcggatattcaaaacctgttctttacttagcgtatcggaagacttgaccaacttgcccagcccggttacttcgttatcgcggcgggttttctgttttttggcttttacctgtatggtatccaactgtttttcctgtgcttgtccggcttgcacattttctgcataagcgggcagcgcagtcattaaagacaggcataaaatattgaatcggaacaaatgttgctgttgcatagtgtttccctaatcttcgctttcagacggcatcggaaggagcggtgccgtctgaggccttattcttgattgttcggcagccgtgcttatcgcacaggctgttggcgtttcgcaccgaatacgacagttgcactgctattgccggatgcatttgttgcatttttcgtttgtttatcgcccggataggcaaaccatccgcccaactcttcggctttgggcccgtaaaaaccgccctgcaccttggcatctgtgatatatgccttaggcgtgcgggtggtattgctttgatcgagatcaaaacctgactcagcagttttcgccgtaccttcaaagccgttgtccttaatattaccatcaatggtaaaggttgcctcctgcctgttgtcagcggttaacgtaccagtaatttttttatcggcaaaattcacagtaaattccgccctgttgccactcgttgcattggaagcattgccgctccagcttgtgcttttgtcgttggcaatatatccgtaccaagacccccgataaacgatgttttgctcgcttggaatctctttttcatcggtgcgctcgccttggaggaacatactttgttcaacttgttccgttttagcatcagcttgactactgctttctcctgcctgcatcgcggacttgctgtttttgcgcgtcaacattccgtatttcagataattgaggttggaacagcagacttcgacttcataggtttttgttttgccattggtatcacctgccgtatttgaagcggtttgcgccccattcgtctgcgtacctgcttgggcgtcttttttatcactttccggcgtgtggtcaaatttgcgggtaaaggctgttccgccatttgtaccttgattggcttgattgttcccactttcggaagcctcgggcaagagcggaatcataatgccgtcgacaaccagttgggcggcgttgctgaagttgtcgagcttttggacttccttatcgcccaatttcagctcgaccgcatccaaaaccgtggtcagcttaccgttttcagacgacgtgcctgccgcaccgtttgatgctgccgcatctgtgccgcctgaagccgccgcagtattgccatttgcgggtttgtctttggttttcgcgctgccgacaacggcaactttttgatcgtcgctcaaaaagcggaaacccaattcctcaccctgcgggccgaaaaagccgccgctcaaagaagacgaatcggaaacaaagggatgttccttggtttcgctgttttgttggggtttgtcggttgccgttgccttgccgttgaagcggttgcctgttacttgagcctcaaggctgtagtattgcgtggtggtggcttggttgttatcggtattcgcattgttgcgtatcagtttgcccgtcaattttttattatggaaatccacttctaaatttgaggtaaaaccataaccctcttgaccatctgtcagcgtggatttgtttttgttggaatattcttcgccgtcatcgcccgaaaatccgctatacctgtcgccttgactttttgaaggttggataatttcacgaaatttttgacccttttttgtatcggtcgcaaaatgccacacacctttataggtaatttttccagaagcgggaagttgtcgggaaggttctttaccgtgatagaagatataaccgtcgtcgccgttttttgcacttttaggttccacctttaagttaaactctcgtttggcgtgtttgtaaaaccagccggaataaacatatttaaaattttcgtaatcttttgcctgatttttaggttggtttataccgttgccagtgttgccgttttgatggtttgatggtttgagatagggggaagaataaatattgttgtcgctgtctgtttctactttttcgataaccgatttttgccgtttagggagttccttaggttcgtccggcaatcctgtcgcctcccaatcactctcgtccagtttaacctcgtcttcttttgcctgcggataccaattcctccgtttcaacctcattgcaaaaccgtatccgccttggtctttttgggcttgcggtttttcggaaaaaacatcttgatattttggcgcgggacgcggggcttcggtatcgacagaatcaagatcgaaactgccgcctccgcccaaacaagcactcaacaaaaacacaggcagcaccatagcagcctgattcaccaatggattgttcataataaatccaattcaattaaagaatgataaggattattattttatttatttttaacaaatttgcaaatacttttttatttttttagggaatacaccaaaatcccgtcattcccgcgcagtcatgaatccgaacgcgtccgcacggaaacctatatcccgtcattcccacgaacctacattccgtcattcccacgaaagtgggaatccaggacgcaaaatctcaagaaaccgttttacccgataagtttccgcaccgacagacctagattcccgcctgcgcgggaatgacgggattttaagttggggtcatttattggaaaaagcagaaaccgctccgccgtcattcccacgaacctacattccgtcattcccacgaaagtgggaatccagttcgttcggtttcgcttgttttaagtttcgggtaacttccacttcgtcattcccgcgcaggcgggaatccagtgtgttgagtttcagctatttagaataaattttgaaactctaatcgcgtcattcccacaaaagtgggaatccagtttttcgagtttcagtcatttccgataaattgccttagtattgaaggtctagattcccgcctgcgcgggaatgacgaatccatccatacggaaacctgcaccacgtcattcccacgaaagtgggaatccagttttttgagtttcagtcattcccgataaattgccttagcattgaatgtctagattcccgcctgcgcgggaatgacggcggagcggtttctgttcgcgtcattcccacgaaagtgggaatccaggacgaaaaatctcaagaaaccgttttatccgataagtttccgcaccgacagacctagattcccgcctgcgcgggaatgacggcggagcggtttctgttttttccggtaaatacccacaagctgaaatcccattattttcacaaaaacagaaaaccaaaaacagtaacctgaaattcgtcattcccacgaaagtgggaatccggttcgttcggtttcgcttgttttaagtttcgggtaacttccacttcgtcattcccgcgcaggcggaatccagtgcgttgagtttcagctatttagaataaattttgaaactctaatcgcgtcattcccacgaaagtgggaatccaagacgcaaaatctcaagaaaccgttttacccgataagtttccgcaccgacagacctagattcccgcctgcgcgggaatgacgaatccatccatacggaaacctgcaccacgtcattcccacgaacctgcatcccgtcattctcacgaaagtgggaatccagttcgttcggtttcgcttgttttaagtttcgggtaacttccacttcgtcattcccgcgcaggcgggaatccagttttttgagtttcagtcattcccgataaattgccttagcattgcatgtctagattcccgcctgcgcgggaatgacgaatccatccatacggaaacctgcactacgtcattcccacgaacctgcattccgtcattcccacgaacctgcattccgtcattcccacgaaagtgggaatccagttcgttcggtttcgcttgttttaagtttcgggtaacttccacttcgtcattcccgcgcaggcgggaatccagtgcgttgagtttcagctatttagaataaattttgaaactctaatcgcgtcattcccacgaaagtgggaatccagttttttgagtttcagtcattcccgataaattgccttagcattgaatgtctagattcccgcctgcgcgggaatgacgaatccatccatacggaaacctgcaccacgtcattcccacgaacctacattccgtcattcccacgaaagtgggaatccagttttttgagtttcagtcatttccgagaaattgccttagcattgaatgtctagattcccgcctgcgcgggaatgacgggatttgagatttctgtttttgattttctgttttcgtaggaatgacggtttaaaagttacccgaaacctcaaaaaaaaaggctgtgttttaatatagtgttgatagacgtacttggcttccatgtattcaatcgtggaaatctatatcttcgtcctcgccgaaatagtctatgcccgatatacaattttgatacacaaacttggaaatatgggtatcgtcgccggagcgatagaatgcggacagttatatatatacggtttttttagggaagcgggcagatgaagggcgggcggattttgaattaaccccatgcaaattgacttttgcgggcggttttacctcccatatacttacaaaagccaaatttttaaacatatatccttgatatatacacggcgtaaacatatactggaaacatctttaaattttccgaaattttaaatatgagcaactggaaacccaatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactgacgagccgccctttatgcacacaaaccgccatcatggtctgcaacgccatcaagcacccctacgaaatggccatccgcaaaacaggcggcacagccctaaaaggaggcaacagcggaaatgttgtctataccccgcccgaaggagaagaaaccatacgcggcaagctggcaaattgggagcggtttattcacgaaagcggcgatttagacccgcttatcatcatggcggcggcacattaccaatttgaagccatccatccgtttacggacggcaacgggcggacggggcgcatattgaacagcctgctattgattgaaaaagggcttttggatttgcctattttgtatttgagccgctacatcatcgaaaacagggcggactattaccgcctgcttttaggcgtaaccgaacggcaggactgggaaagctggataatctacatcttagacggcgtagctgacaccgccgattggacggtatcgaaaatagatgcgatacgccgcctgttcgagcagacacggcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcagacataggtgtgctgcaagaaatcgtcatcggcagggacaaactattcattcatccgcgcctaatggaactattgcggggagagggcaacagctttacttcattctaaccccctcttcccccccacatgactaacacgaaacagggattttgacacccgaaccgagaccccttgtatttcccccgcgaaaagccggcatccgcccgcgtatcatgggagcaacaaaacccctgcctaaaattttgacttgtgcaaattgggggtatatttgggggtatattgaaaaatggctaaaataaaatgtttaataaacaaaatgttgaaacttaatttcgatagagcatctgcatatcgtattgaggcgttcatggaatttgagaaagctatttttaaataagaaaaggtaactattaaatagctacctttctaaaattaaatatcaacacatcgttaaaacacagcctttatttttaacaaagttgcaaatgtttttttatttttttagggaatacaccaaaatcccgtcatttccgcgcagtcgtgaatccgaacgcgtccgcatggaaacctatatcccgtcattcccacgaaagtgggaatctagttttttgagtttcagtcattcccgataaattgccttagcattgaatgtctagatcccgtctgctcgggaatgacgaatccatccatacggaaacctgcatcccgtcattcccacgaacctacattccgtcattcccacgaaagtgggaatctagttttttgagtttcagtcattcccgataaattgccttagcattgaatgtctagattcccgcctgcgcgggaatgacggcggagcggtttctgttttttccggtaaatacccacaagctgaaatcccgttattttcacaaaaacagaaaaccaaaaacagaaacctgaaattcgtcattcccgcgcaggcgggaatccagtgcgttgagcttcagctatttagaataaattttgaaactctaatcccgtcattcccacgaaagtgggaatctagaacgtaaaatctaaagaaaccgttttatccgataagtttccgcaccgacaggtctagattcccactttcgtgggaatgacgggattttaggtttctgtaatctcgggcagctttccgtcatcgttttaacccaaagacaccatttcaatctgctccatcgtcctgcccagaaaacgctcgccgatggttctgaatttcaaaggaatatcgctgacgtaaaaacggtagtcgggattgttgttgtcggtattgagcaatccttcctgagcaaggacgcgtgcggtttcttcggccgttgtaattgcagaatcaaccaacgcgacattgcccgcctccctgccgattaagggcttgagcaagggaaagtgcgtgcagcccaacaccagcgtatcgatgccgtctgcaagcaatggtttgaggtattcgcatacggtcaggcgggtaacttcgtgttccagccagccctcttccaccaaagggacgagcagcggcgcggcctgcgtgcggacgagcgtgtcggggttgttcctatggatggcgcgcgcataagcattgctgttgactgtcgtattggtggcgataatgccgattttattgttgcgcgtcgttgccagcgcggctttcgcgccggcggaaatcacgtccaaaacgggcatattgccggttttttgacggattttctgccccgccaccgccgcaatcgtattgcacgcgataaccatcgccttgacatcgtgttccaataaaaaatcgacaatctgcatcgagaaattttcgatggtcgccttagatttcgtcccgtaaggcacgcgcgccgtgtcgccgaaataaatgatgttctccatcggcagccgttccatcagcgctcgcacattggtcaaaccgccgattcccgagtcaaaaacgccgatgggtcgctgcctgccgatattttccattctttttccaatccgtcctaaacatacaatccgcgtattgtacacgcgccgctttttcttgacagccgttgccgtctgaaagcagaacgcggatttggctgttataatgctcggacaagaagcatccgcccctcgggtgcaaagtttgcaaaacctgcaaaactgcccataataccctagaccttacaacaaaccgtttccatgtctgatttaccctctatctcccgattccttgccgacgaagccgccacactcgatttgggcgcggcgtggtcttcccgtttaaacgcaccgctggtcatttatctcgaaggggatttgggtgcgggcaaaaccacgctgacacgcggcatcctgcgcggattgggtcatcagggcgcagtcaaaagtccgacctacgccatcgtcgaatcttatccgctggaacgcttcaccctgcaccatttcgacctctaccgcttctcgttccccgaagaatgggaagacgcggggcttgacgaactgtttgccgcaaacagcgtctgcctgatcgaatggccgcaacagggcggggaatttacgccgcccgccgacatcaccgcaacattgacacacgacggcgacggcagaaaatgcctgctgaccgcccataccgaacgaggacgcgaaagcctgccgctatgatcaaactgacacgaagacaaatcatccgccgcaccgccggcacactgttcgccctaagccccatcgcatccgccgttgccaaaacggtacgcgccccgcaattcaccgccgcacggatatggccgtcgcacacctacacccgcctgacgctggaaagcaccgccgcgctcaaataccagcacttcacgctcgacaacccgggcaggctggtcgtcgacatacaaaacgcgaacatcaataccgtattgcacggactgtctcagaaagtcatggcagacgacccctttatccgcagcatacgcgcgggtcagaacacgccgaccaccgtccgcctcgtcatcgatttgaaacagcccacccacgcacaagtcttcgcgcttccgcccgtcggcggctttaagaaccgcctcgtcgtcgacctctatccgcacgggatggatgccgacgatccgatgatggcactgctcaacggtagcctgaataaaaccctgcgcggctctcccgaagccgacctcgcccaaaacaccacgccccaacccgggcgcggcagaaacgggcgcagacccgtcatcatgctcgatccgggacacggcggtgaagaccccggcgccatcagcccgggcggtctacaggaaaaacatgtcgtcctatccattgccagggaaaccaaaaatcagttggaagcattaggttacaatgtatttatgacgcgcaacgaagacgtgttcatcccattgggcgtgcgtgtcgccaaagggcgagcacggcgggcggacgtatttgtctccatccacgccgatgccttcaccagcccctccgcgcgcggcacgggggtttatatgttaaacaccaaaggcgcaaccagctctgccgccaaattcttggaacagacgcaaaacaatgccgacgcggtcggcggcgtaccgaccagcggcaaccgcaatgtcgataccgccctgctcgacatgacccaaaccgccacgctgcgcgacagccgcaaactcggcaaactggtgcttgaagaattgggcaggctcaaccatctgcacaaaggcagggtggacgaagccaatttcgccgttttgcgcgcacccgatatgccgtctatcctggtcgaaaccgccttcctgtccaatcctgccgaagagaagctgctgggcagcgaatccttccgccggcagtgcgcccaatccattgcctcgggtgtccaacgctacatcaatacatccgtattgaagcggggttgattccgaaaaataaatgccgtctgaacatttttcagacggcatttttgtacactttcctcaacggttcgatccttccaccatatcaatcaggaacaggcggcagtcgatgttgccgttataaagcgggattttccgcttgggcgacaggcacatgaatttgggcatttccctatcgccggtaaacattgccgccaaccagcctgcgtaatgttttttcaaccacgtccccaactgcggatacagtgcctgcaaggcgcggacttcctcaaggcgcacgccgtagggcggattggacaccataatgccgttttcgccgttcggtcggacggactgcgcgtcggcaacgctgaaggaaacgatgtcgtccaccccggcgcggcgtgcgttgtccaatgccgtctgaacgatgcggcggtcgttgtcgctgcctgcaatcggggcgcggacggggcgggtttgcgcttcggcgcggcgccgcaaatccgaccacagcgttttatcgaaattttgcagtttttcaaaaccgaaacggcgcatcatacccggcgcgcggcgggcggcaatccaagcggcttcgatagcaatcgtgccgctgccgcaaaacgggtcttgaaacggctgcgtgccgtcgtagcctgccgagagcagcagtccggcggcaaggttttcgcgcagcggggcttcgccggtatccaggcggtagccgcgtttgaacagggcttcgcccgaagtgtcaataaagatttcgacattgcgttcgttcaaaaaggcgtggatgcggacatcgggcgcggctttgtccacgctcggacgtgcgtcgtaaatgtcgcggaaagcgtcgcagacggcatctttgacggtcagtccgacaaattggatgctcttaacgttggcacgctttgcctcgactttgactttgaacgtctgctgtaaagtaaaccaattaaaccagttgatatttttggcgagtttgtagatgtcgcgctcattgcggtatgtccctttggtcaggcgcagcaggatacggctggcagtacgcgaatgcaggttggcggcgtaaacctgttccaatccgccccggcaggaaacgccgccgtcaaacacttgtacatcggtacagccgaggctttcgagttcttgagataaaacggtctccaagccgcgcgggcaggtggcgaaaagtgtatataaagtattcataacgtgtcctttccggacggatgttccggcaatggcggattgaaaggtttattcggcggtaaatgccgtctgaaatgtccgactgccgattgtaatgtccgccgtaaaatcgcgcctgccttcgacacagatgggcaggcggatgcgtactgcctgccaagtccccgacggttgccgctcgaacatatagcggttgaaacccatatccatatttttcatactgaagctgatgctgacctgttccgtgccggcgggcgcgtgttcgatataaatatcaaacggttttttggttgaaacggcggcggcgcggacgcggcttccgtccggcagcgtgcaaccctcggtcaaatcgcattgcgccgccacagcttgcggctgctgcgcctgccaccattgcaacaaaacgagcttgacggcggcaaaggcaatcagcagcagtgcggcaagcagtaatttacggtttttattcatgattcttccctattgtttcatcccttaccaccacgtgcgcccccaatccgagccatagttttccataacgtgcaaccgtctgtccgtttgctgcaagtacgagcggcacggatacgccctgccgcagggcttctgccgcctcttgtgcctgaacatcatcgcacacgcgccaaacgaccgcatccgcgcccttttcctgcgcccgccgccattgttcgcgggtctgcaccaccatccacacgctgtcggcgtgttcgggtctgtcctgccattgcgccgcctccatcaaaacgttcgcaccgcttccctctgccgaacccaaaggcaggacgcggtacgcgcccatactgttttctccgtgcaaacccgttttcaggctgccgtacaaacggcgcgggacggacagcgaacgcaaaagcgcgccgttggcgggcagcatgggggcaacggtaaaatcacccgccttctgccaagaccattcctgcccttcgcgggattgcggtttgcccgtccattggtcggggttgacccataggaatttcaggcagacgcgggcgtgttcgtaggaatggattttggtcaaccaaggcgtggcggcgaggatgcggatgccgagttcttcttcaaactcgcgttgcagggcttggaagtcggtttcgcccgcttcgaccttgccgccggcaaattcccaatatccggcatagggtttgccttcggggcgcgagctgagcaggtagttgccgtctgaatcgagcaaggatgccggcaacgacgcggataaggggtcgggtgtcttgaatcatggcgggtacgcggttggtcggtcggagtgcaaatgagggacgggcaatgccgtcaacgggtttgccgcatttcagacggcattatttttcggcaacgacaaacgccaatacggtgtcttcttcgtcgctcatgctgaggctgacgcggctgatgccttgttcctccagccatttggacagggcggggccgtagaaaaattcgggcttgcccaatgcgtcatgcccgatgccgatgttgcggaaggaaaccgcgccgcgtatgcccgtgccgacggctttggcaaaggcttctttggcggcaaagcgtttggcgaggtagttgacgggtttgcccgcttgcggaaattcaagcagctcttccggagtgaggatgcgcccggcaaacgcctgtccgaattttttgtttaagcggatgatgcgcttgagggaaacaatgtctgtgccgatgccgtaaatcatatttgcgctccttcgcccttggttgcgggtagtgatgaatgtgatgatgaatgccgtcaatttcttggggcgttaaaatggcgtgaatatccacttttggggttttgtcggtaacaattttcactgtaaccttttgcatttgaaattctaaaacatcgtgccaattatttaataaggagttaaggcatttaataatgaattaaagtttgattaaacccgaatgcccgattttcagagccaataccaataaaacaataaaaattaacattttaaaaaaatttgggctaatcttagtccttaaccgaattccaacatacaatccaataacagacaatacggacagtaaaaatattaaaccgtattcactcttatttaataaccaatactggtctcttagcatatatatttgaacaattttcgccaaaagatagcatagattgcttgattttacgatacgatttttattttctgtttcgctaagcaaaaatattaacaatatgggagacatggcattggttgaaccgccgatgatgcctgccaaaaacccaaaaagaaccatattcttattattggcaactacttgaatattttttgcttttgcacatacatttaaaataccattgacagaataatacaatgtaatgattgccatcagtaaaagcagccaagacactggaagtatcaaaagcaacttcacccccaaaatgctgccaacgacgctgccgatagcaagcaatttataggtttttaaataataaacaatctcttgccaaaaaccctttttgttattgctgcatagaaccaacaagctcattaacaggcttggtaatgccaccaaggcaacaaccttagacaatggcatgataaaagccaatgcggttgtaccgagcatcggaaatcccatgcctgtaattccgtgcagtattgcggcagcaacaaaaacgatagattgcattatttcttgcataaccgtcctttatacagtaattcttgctctaatataatgcctgtttttatccgtataatcagttctggcatgcaagccattgacattgtcaataataatcaaaccatcatcttgtgcagaaaattcttgaatatcactcgcattttttataacatttataagataatcaagtgcaagtaccatttcctttgatactttatttctattttcttcaatacctttatagatacaatcacttctaaatctaatcatttgagtattgaccgataagatattaccccatctcacaccttgttttttatcaaatgatgctggtgttttaaatggatataaattgcccgttaatgtttttaagtgttttttaccggtttctgttttagataactgattgacaatatctgatgaacttaaaaatagggaattacctccatcattggctgattttactacatacataaccaaataactttccgggttttcactaaaagatgaatcactatgaagtggacattctccaacatcttccgagaaagttatatcattatttatagtggattaacaaaaaccagtacggcgttgcctcgccttagctcaaagagaacgattctctaaggtgctgaagcaccaagtgaatcggttccgtactatctgtactgtctgcagcttcgtcgccttgtcctgatttttgttaatccactatattacataatcatcgcctcaatatttaatatcccaaaatatagatttaaaaccatcgcctttgtggtttgtcagcattcctaattgagatagaaagtcaaataatttcttgtttctccggctgccatcaagatggtttagattaagacctcgaacaatacaatacccaatactctgtactgtattgtgaatttcttctatcaaactattattgtttgcagataaaatatacttttgattcatatagtgaattaaatttaaaccagtacggcgttggcttgccttgccgtactatttgtactgtctgcggcttcgccgccttgtcctgatttaaatttaatccactataacatatccctgtcgtgaaatgctgtctgaaagggtttgcctgcccttacggcagcagccttgccctgaacatcgcctccttcatttggcgcacggcttcgggcagtccgaggaagagggcttgggcaatcagcgaatgcccgatgttcagttcgcggatggcgaggatttgggcgatgggggtaacgttgtgtatggtcagtccgtgtccggcgttgacgaccaagcccaaatcgccggcgaaatgcgcgccgttttggatgcgctcgaactgcctgatttgttcggcgtggctgcgcgcgtcggcatacgcgcctgtgtgcagctcgacaacgggcgcgccgacatcacgggcggcttggatttgcctgtcgtcggcatcgataaacaaagacacgcgtatgcctgcgtcggtcaggattttggtgaacccggcgattttttcctgttgcgccaatacgtccaaaccgccttcggtcgtgatttcctgacgtttttcaggcacgatgcacacgtcttccggcatcactttcaaagcgttttccaacatttcttccgtcaacgccatttcaaggttcaggcgcgtgcggatggcgtttttgacggcaaacacgtccgcgtctttgatgtggcggcggtcttcgcgcaggtgcatggtaatcaaatccgcaccgtgcgtttcggcaaccagtgccgcctccacggggctgggataagtcgtaccgcgcgcattgcggacggtggcgatgtggtcgatgttgacacctaaaagcataatctttccttttatttctgccttcagacggcatttgaagccgtgccgtccgaagtcgggacggtttcccgggcggtttctttgcggtcaaactgccgtatctgttccaacacctgccgcgatttcagcccctcgggcaacaggtggcggataaaaagccgtgtgattttcaatgcctgttgcaggctttcggcagtgcggaaactgccttcgcgcaaatcgatcaggctctgcccgggggcgacaacgccggcggcgtgcggcggtacggcaaatccttttccgacggggaagacggctgtttccgggcggacaaggtatgtgccgcctgccgcaatcgtcccgccgtccccgtcgcggttcaaatcgggggcaacgcccaacaggttcagcagccgccactcgaaacggcgcaagtcgtcgatataagcggctttgcagcacaccgcctccatcacttccgccaacgcgtcgtataactcgggcaccgggtcttcgcgggcggtcagtttcaacaccaactcgttcacatacaatccgccgaacaacgccctgccctgaggctgccgccaaccgccgacccattcggcgcggtgtagggttttgagttcctgactgccgtaccacgacacgctgacgggcacgaacggcaccaatacgccgcgcagctcgctctgccttttgcgcgcgctgcgcgccagcaaagccacacgcccgtaacggcggctgaatgcttcaacccacaggctgctttcgcgccagggcgaagatgccagcataaaaacgggttcatggttgactcggtattcggacataatcgttggggaaatgccgtctgaacgctgccgccgctacaaaacggcggtcgggtacgaaccgatgactttgacgaacgaagcgcgttcgcccaagcgttccaatgccgtctgaatctgcgcgtcccggcggtgtccttcgatgtcgatgaagaacaggtattcccacaaaacggatttgctcggacggctctcaaacttggtcatggaaatacccgattcggtcagcggttgcagcagcgaggcaaccgcgcctgcccggttgggcgcggaaacggccagcgaagtcttgtcgctgccgcttgcaccggtttcgtgatgtcccatcaccaagaagcgcgtggtgttgttcggttcgtcttcgatgcactcggcaaccatatcgagtccgtagatttccgccgccgtgcgtccggcgatggcggcaaccgtaccgtcgtccgattcggcaaccagccttgcggcttcggcattgctggacacggcaatccgttcggcgttgggcaggtgtctgcccaaccagtcgttgcactgcgccaacgcctgcgcgtgggaaaagactttggcaatgccttcggtgctgccgttgtttttacgcaaaaggttgtggtggatgcgcaaaacgatttcgccgcacgcctgcaacgcggtaacggcaagcaggtctaacgtgcgaccgaccgagccttcggtcgaattttccacgggggcgaccagataatccgcctgacgcgtttcaacctgcttgaagcagtcgtctatggtcggacacgccatggtgtgcgcggcgtgtccgaaatgtttgattgccgcctgctgggtaaacgtgccctgcggccccagataggcgatggtcagcgggcgttcgacggcgaggcactcgctcatcacttcccgaaacaggcgtgctaccgattcgtcgggcagcgggcctttgttcaaatcctgaatgcggcgcaacacggcgacttcgcgttcggggcggtacactgcgcccgtgcctttcagctcgccgatggcgtgggcgtgttgcgcacgttcgttgagcaggcgcaggatttcggcatcgatggtgtcgatggcgttgcggtggggaaggaggagttcgtcgatagtttgggacataatttcgcctgaacagtaatttatcgtgcattctaacatcaaatgccgtctgaaacggtttcagacggcattttccgttaaaggtattcgctttgcccgttttctttccacgcacgatgcgagcagagccacagaagcgcaatgccgcaagaggtggacgcggtcatcgttgccgccatcacggttgccgaaccgtcgtgcaagaaggtcgccgccatacccacccccgcgccgattaaagattggaatacacccaatacggcgtttgcgctgccgccctcttctttgaaataggacataaaacacgcctgcgtgtttgcaccgaccaagccctgcgtaccgacggaaaacatcacgcacgcgaccagcagccaaaacgggggcaacccgaaaaacagcacggcggcgagttgggacaggttggcggcaaactggacgacaatcccccacagcaggatgctttgcggatgcacgccggttttgagccgccacgcggtaacgcggttgaaaaacatcatcgtgatgatgttgagtgcaaacgcccaagcgtattgatgaggcgtaacacggtagagctgctggtacacgaaggaagattcggtcagaaaggcgaacatcgaaccgaagctgaatgcctgaaaaaacagataacccatcgcagcacgggttttcaatacgcgcttgaaccgccccgccaccagcccgaacacgtcccgtccgattttgccgccgacggcgggcttgggcaggaaatactgtaccaaaccgagcagcaccagcgaatacgccgccagaaaaacaaaaatcgcctgccagccacccaagccctgcaacaatgcgccgaccatgggtgcgaccagcggcacaaccatcaaaatgatgccgataagggcaaacatctgggcggctttgcgtccggaataataatcgcgcaccattgcgccgacgatgaccacagtcatgcccgcaccgaatgcctgcacgacgcgcaggttgaggagctgttcggcactcgaaacaaatacgatggcggcaacggcaaggcaatatacaatcaaaccggtcagggcgacgggtttgcgccctttgatgtcggacaccgaaccgccgaccacctgtccgaacgccgtgccgaacataaacaaactcaaactctgttcgatgcggtgaacatccgcgttcagcgattgcgccatttcgggaatcgcgggcaggtaggcatcgatggaaaacggcatcagcgtaaccagcatcgccatcaaaaccgccatcagtttttcgctcatttcaggataatgggcagaaggcataaattctcgtccgattcgcaaacaaaccgcccggcggcggaaaacacaatacgcggaaacggaaaattttaacacaccggcacaaacaggcggcaacaaaagccccggcaaaaccggacgaaccggaacgatatagtggattaacaaaaaccagtacagcgttgccttgccttagctcaaagagaacgattctctaaggtgctgaagcaccaagtgaatcggttccgtactatctgtactgtctgcggctcgccgccttgtcctgatttttgttaatccactataaaatcccgtcattcccgcgcaggcggaaatccggacatccaacgctgcagcaatttgtcggaaataaccgaaactcaaaaaaccggatgcccgcctgcgcgggaatgacgacgcaaagatggtcgttatttcggataaatatccgtcttttcgttccggatacccgctttcgcaggaatggagatggaaagatttcagcctattcggcaatcatcaaataccgcttcccaactttatttttgatgcgacagccggccggcaaccaaggtggcggcgatgacgacaaacacgcccaaggcggacacgggcgacaggtgttcgcccaaaatcaaaaccgccagcagcacgccgacgacgggttcgagcgaaatcaacagtcccgaaacattggcaggaacacggctcatccccttgttccacagccaataggcgtaccagccgcaccccaaacccaaatacagcagcgacaataccatcccgacgctccagtccacggtataactttgcgccaaagcaagcgaaaacggcaggcacatcaacgatgcggcggcaatggaaacagatgtgaatgccggtgcgccgatgcgtgcaatcagcctttgcgtcggacgcatagcggcacaaaagcccgcgcccgccaacaacaccagcaggcagccgaaccagccgacttcgccgccctcttccgcaccgcccgccatcagcagcgcgacaccggcaaatgccgccgcgccgcatatccagtggtaggcacgcgctttgtcgttgaagaaaaagtgtccgacaaacaccatcagcagcggctcgagtccgacaatgaccgatgcgctggcggcggaagtgtatttcaacccgacaaactgaagcagcagggtcagcacatagttgacgaacgacacaatcagcaacggcttccattcctcacgcggaatcttgccgacatgacggcggcaggcgggcagtgcaggcagcgcggcaattagcaggcgcacgccgaccatcaatgcgggatcgatgccgccatagacatatttggcggcaataaacgagctgctccagataatcagggcaaggatttggtaaaacatagtgagtgataaagtcagatggtcatacaaaagtatagcggatgaacaaaaatcaggacaaggcgacgaagccgcagacagtacaaatagtacagaaccgattcacttggtgcttcagcaccttagagaatcgttctctttgagctaaggcgaggcaacgccgtactggtttttgttcatccactataacagcaaccctgtcgccgtcattcccgcaaaagcgggaatccagtccgttcagtttcggtcatttccgataaatgcctgctgcttttcatttctagattcccactttcgtgggaatgacggcggaagggttttggttttttccgataaattcttgaggcattgaaattccaaattcccgcctgcgcgggaatgacgaatccatccgcacggaaacctgcaccacgtcattcctacgaacctacatcccgtcattcccacaaggacagaaaaccaaaatcagaaacctaaaatcccgtcattcccacgaaagtgggaatctagaatctcagactttcagataatcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcgcaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccaatctttgaatattgctgttgttctaaggtctagattcccgcctgcgcgggaatgacgaatccatccgcacggaaacctgcaccacgtcattcctacgaacctacatcccgtcattcccacaaggacagaaaaccaaaatcagaaacctaaaatcccgtcattcccgcgcaggcgggaatctaggtctgtcagtgcaggaacttatcggataaaacggtttcttgagattttacatcctggattcccactttcgtgggaatctagaatctcagactttcagataatctttgaatattgctgttgttctaaggtctagattcccgcctgcgcgggaatgacggctgcagatgcccgacggtctttatagcggattaacaaaaatcaggacaaggcgacgaagccgcagacagtacaaatagtacggaaccgattcactcggtgcttcagcaccttagagaatcgttctctttgagctaaggcgaggcaacgctgtactggtttttgttaatccactatagtacggaaccgattcacttggtgcttgggcaccttagagcatcgttctcttttttgttcatccgctatattgtgttgaaacatcgccccaaacccgatacaatccacccctgcaacatcagtgaaaatctttctttttaatcagttaaaaccgaatacggagtcgaaaatgaatccagcccccaaaaaaccttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgcaagcaaccggtgcaaacaacacaagcacggtaagcgattatttcagaaacatccgtgcgcattccatccacccccgggtgtcggtcggctatgatttcggcggctggagaatagcggcagattatgccagttacagaaaatggaaagaaagtaattcttctactaaaaaagttactgaagagataaacaacaactacaaagaaacccaaacaaaacatcagggaaacggcagcttccacgccgtttcttctctcggcttgtccgccatttacgatttcaaactcaacgataaattcaaaccctatatcggcgcgcgcgtcgcctacggacacgttaaacatcaagttcattcggtggaaacaaaaaccacgactattacctctaaaccaaagaacggctctccacagggaggccctattatacaaactgatcccagcaaacctccctatcacgaaagccacagcatcagcagcgtgggtcttggtgtcatcgccggtgtcggtttcgacatcacgcccaagctgaccttggacaccggataccgttaccacaactggggacgcttggaaaacacccgcttcaaaacccacgaagtctcattgggcatgcgctaccgcttctgattccccggcaccgatgccgtctgaaccttcagacggcatccaaaacccggtatttcaaggcgggcaggcggttgcggacgctgttcaggcggttggcatcgatgtctgccgtaacaacgccttcgccctcgggcaatacgtccaacacgtcgccccacggatcgacaatcatgctgtgtccgaacgtgcgccgtccgttttcgtgcaaaccgccctgtgccgccgccacgacgtaacattggttttcgacggcacgcgcgcgcagcagcagctcccaatgcgccttgcccgtcgtgtgcgtaaacgcagcgggcagcatcaatacgtcaaacggcaactggcgtcggaaaaattcgggaaagcggacatcgtaacaaatgcccgccgccaccggcacgccttctgccgacaagtgcggcacatccccgcccgcgcggatggtatcggcttcggcatagcgttcgcccaaaccggaaaaaccgaagaggtgcattttgtggtacagccccgtccttacgccgtcccgtccgtacaccaacagcgtattcatcactttacccgcctcgcagctttgcagcggcacagtcccgccgaacagcaccacgccgcattctttcgccgtttcgctcaatgccgtctgaaagcgtccgccgcccaaaggctcggcaagcgcgagtttgtcggtatcgtttgcgcccatcagcacccaatattcgggcagcagcacccaatccgcaccctgctccgccgcccgtgcgaccaggcgtttcatggcggcgacgttggtttccggcgacacgcccgacaccatctgcacggcggcaactctgattttgtccatttcttctcctttttcctgccgaccttgcggcatattccgccgataggctaccatgacggtactttgcgaaaaccgtttacacaaatgcccattttgaaccatattgccctcatcggtgtagggctgatcggcggttcgttcgttctcgacctcaaaaggcagggactcgtccgcaccgttaccggtatcgacaccgaccgcgacaacctcgaacgtgcattggaacgcggcgtgattgaccaggcttccgttgccatcgacgcggacagcatcggcggtgcggacttggtactgattgccacgcccgtcgccaccgttcccgccattttgaccgcgctgcgccccgttttgccggaacacacttggatttccgatgtcggcagcaccaaatcttcggtcatcgaagccttccgccgctgtctgcccgaccgcctgcaccactgcatcgccgcccacccaattgccggttcggacagaagcggtgcgcaagccgcgcagttcgggctgttccgccacagaaaactcatcatcacgccacacggcggcgaacattcagacggcattgccttggtagaaaacctgtggcacgcggtcggtgcggaaatttatacgatggacgcgcaacgccacgacgcggttttcgccgccgtctcccatatgccccacctgaccgccttcgcctatgtccaccagattctcgaccaccccgacggacaggaatatctgaaattcgccgccacgggctttcgggacttcacccgcatcgcctccggtcatcccgccgtgtgggcggacatctgccttgccaacaaagacagcctgctgcaactggttcaaggcttgggcaaacagttggacgttttggcaaacatcctgaccaccgacgaccgcgaagccctgtaccgctattttgaagaagccaaaaccacacgcgaccgctggctggacggcaactgaccgccctgccgtctgaaaagcaaaccgcccagacccgaaatctgcggcggtttgtctcaaccgggcctgccgtccgaacgcggacgaatcagccaaggaatatacttccacgcatacaccaaaagcgcgagtgcaaacaaaaccgaagaggtgcggatgctgtgcgtgtaggcagtgccggaagaaaatacggcaaccatacggacggcggttgccgccatcatcagccaaaacgcaacgggaacggctttgggcggcggataaatcggattgcccgtatgaccaagcgcggtacgcgccatcatgcccaaagtcagcacgccgataccgccgaccccgatcagatgcacacccagattgaggaaagcgggtttgaaataagacgcgccgaccgcaatcagccccaatccggtaaacagatagccggcaaacagaatccacagcatcggctctttcaacacgggtttataccaccagcggtacacctgcacggtaaaaatcacacctgccgcaaaggcaaaaacggcagacagccaagccaacacaccgtgcgccatcagcatggcagtcagcatgggcagccacagcgaagcctgcgccacccatttcggactgggaatctgcggcacattcaagcgtttggacgtaaaaaacgaaataatccgcgtaccaatcagaccgataaaacccgacaccatcaccaagcccgactgcaatccgctcaagagtccgcctaggttgccgttgtgcagctggacgtggaacgccgcatgcgtgccgcccaagacgaacagcgcgaacacggcaacatagttgcgttgattctgcgaacggataacgggcaaagccatgcacaccgcgccgtaccagaaaaacagcgtaccgagtatgccgcttgccgacgcaccccaacccgggataaaggcggcaatccgcgcagccagccaaaagatagtcaagccgaccagaacgccgccccgcgtgggcggctgccccgtccaagtggcgacggcggtcagcaggaaggcgatgacgaccagtccggcataaccccaaatcatctcatgcgcgtgccaatagaaaccggacagctcgtgcgttcccgtgtagccgaaaccccacagcaatacggacaatgcgccgtacagagccgccagcgaataaaatgggcggaacgccattgcccagacggggtgcttggtaaatttcatgtgtgttccttgtttatcattaatatatttaccgcaaaacggaatcatgccggcaaaaacggttcggcggcgggaaacagctcgcgttcttcaaagcgcgcgtggtcgcgcagggttgtggcaaaagcggtattccacgccgcgttaccgtattcggggcttgccatcatctgccgcagtcgggcgtggtctttctcgaaacgttgtttcaattcgggggcgacattctgccaaattggggcaaacttggtttcttcttcgcgaaaatgggtttccaattcggaaaaatgcggttcgagttcgtcccgatgcctttcttccggcgtccgcaacagacgcacgcacagggaaagcgaatggtggtggtcacgcgaaagcccgataagggcgggatgtcgtttcaacggtttcatgattttgagttacaataacaaattctcaaacggtagcgcggatgtttcagacggcataccgccgcagacaggctgcattctaccgccccgacggacagggtttcaaccattaaggtattgtccgtgaaccttaaaccgtaccgataagaataacaatccataccgagaaaatcatgtatttgacacaacatacggactacgggctgcgcgtccttatctacactgccatcaacgacgatgcgctggtcaacatcagtaccatcgccgtaacctacggcatttccaaaagccatctgatgaaggtcgttaccgcgctggtcaaaggcggcttcctccacagtgtgcgcggaaaaggcggcggtctgcggcttgccgcaccgcccgaccgcatcaacatcggctcggttgtccgccacctcgaaccgatgcagctggtcgagtgcatgggcgagaacaacgaatgcctgattacaccgtcctgccggctgacgggcatactcggcggcgcgatgaagtcgtttttcacgtatctggacggtttcacgctccaagacctgctcaacaagccgacctacgacctgctctacgaaccgagaattccgattgcggtgcagtaatgcatcaaaatgccgtttcaaacggatattccgaccgagcgcgatacgcgccggcatttcggactgccgccggcaaggcgcgcaatgccgtctgaacagccgatgcttcagacggcatcggtttccctacaaaccgaacaccgccgtatcgccgcaaccttggcgcaccaattccgtgccgtcggtcatatcgacgacggtggtcggctcggttccgcaccagccgccgtcaatcaccaaatcgacggcgtgttccaaacgctcgcggatttcataaggatcggtcaatggttcgccgtcttcgggcagcatcagggtgcagcttaaaagcggctcgcccaattcccccagcagggcttgtgcaatggcattatcgggaatacgcagcccgatggttttgcgtttcgggtgcagcgtgcgcgccggcacatccttcgtcgcctgtaaaataaaagtataaggcccgggtgtggcggctttaagctgacgaaactgtacgttgtcgactttggcgtatgtgcccaactcgctcaaatctgcgcacatcagggtcaggtggtgtttcaaatcgattttgcggatggagagtatgcgttccatcgccgccttatcgccgagtttgcagcccaaggcataacaggaatcggtcggataaacgaccacgccgcctttattgacgatttcaaccgcctgcttgatgaggcgttcttggggattgtcgggatgaatagcgaaaaactgtgccatggtttgtttccttatcgtcatgttttccgtattgtacgcccgaaattcaaaatcccgtcatttccacaaaaacagaaaatcccgtcattcccgcgcaggcgggaatccggttcgttcggtttcggtcatttccaacaaatccctgtcgctttgcgttgctggtttcctgctttcgtagaaatggcggcggagggtttctgttttccgacaaatatttatgtttacaggatgaaattccaccgtccgcacaaaaatgcaagataacaaaaaaatgaacaatgccgtctaaaatcctcatcagcctaatcgggcgtttggggtttcagacggcatttttgcggactcgtcccttttttggctacaagatgccggcaagttcggcagtgtcgcaggcaatcatcagttcttcattggtcgggacaaccaaaacagccggagaagaatcggtcgggctgataatgcccgaattgccgtagcgtttttccatattggctttggtgtcgatgtgcagacccaagaaatcaagataggaaacggttttggcacggatattacgcgagttttcgccgataccgccggtgaacacgagtgcgtcaacgccgccgcagcccacagccatcgaagcgatgtatttggcgaggcggtaggtcatgacttcgagggcgaggcgcgcgccttcgtggccttcgtcggcggcgatttcgagggtgcggcagtcgttggaaagttcggaaataccgagcaaacctgattttttgttcagcatttcatccacttgggcaacatccatcccggcgtgggaagtcagatagctgtatacgcccggatcgatgtcgccgcaacgtgtacccattaccaaaccttcgatcggcgtgaaacccatactggtatcgacggatttgccgtttttgatggcggtaatggatgcgccgttgcctaagtgggcaataatcatgcggatgtcttccagaggtttgcccaagatgcgtgcggcttcaggggcaacgtaacgcatactggtgccgtggaaaccgtagcggcggaaagcgtattttttacgcaactcgcgcggcacggcataagtgtaggcacgctccggcatggtttggtggaacgaagtatccatcacgccgacattgggcagaccggggaaatgttcctgtgcggcaaggatgccgctgatgttggcggggttgtgcagcggcgcaagcggaatgcaggcattgagttcgtccattacggcctggtcgatcaaaacagactcgctgtatttttcgccgccgtgggcgatgcggtggccgatggctttgatgcggtcgtgcagaccgtgtttttccagttcgttcaaaagcatacccaccgcgccggcgtggcaatttcggccgctcaggggaacttggcgtttgttgccgtctttgttgaacgtaatgacggcttcgggcgtggtcaggcgttcgccgaggcagcttaggacgacgctgccgctttttcggtcgataacggcgcctttgagcgatgaactgccgcagttcagaacgaggatgagttggtcggacatgatgtttctccttgtagtttgtggttgtttttttrgtgtggggtcgtctgaaaaaggcagacatcaggcgcaaggtgtttcagacggcctctttgggcaaagcgtatgccgcattttctatcgttattccgtccccgcctacgcgaggacaggctgtggcgggaatccagaatgtagaactcacgaaacctgttttcccctgccaatcctccatattgacaggtctggattcccgcctgcgcgggaatgacggtaatacgggaagctgtcttttatcggggtttccgtgttcttccttgtgatttgccgccttccgccacagggcaagggaaaggaatggtcagtgatttgatgtttacttgtttttcagacgacctttttatggctcgcgggcaaacccatgctacgtcaatttaaaaacaatcctcaggcaccctgacccaaccttccatcatcacgcgtgcgctacggctcatgaccgctttggtggccgtccattgtccgtcctgacattcggcggctgcaccgacgcgcaatgtgccggaaggatgcccgaagcgcacttctttacgcgttccgccgcctgcggcaaggttgaccagcgtaccgggtacggcggcggcggtcgcaatggcaacagaggcggtacccatcatcgcgtggtgcagtttgcccatgctcagggcgcgtaccagcaaatcgatgtcggcggcgttcacggttttgccactggaggcggtgtaatcggcggcgggcgcgacgaaggcgactttcggcgtgtgcgcgcgagcggcagcttcggatacgtcgctgatcagacccattttcagcgcaccgtaagcgcggattttctcgaatttttccaaagccgcggcatcgttgttgatgtcgtcttgcaactctttgcctgtgtagcccaagtcggcggcattcaagaaaacggtcggaatgcccgcgttgatgagcgtggctttcaaacggcctatattcggcacatcaatttcatcgaccaaattgccggttgggaacatactgccttcgccgtcggctggatcaagaaattcgatttgtacttcggctgccgggaacgttacgccgtcgagctcaaaatcgcctgtttccaaaactgcgccgttttgcatcggtacatgggcaataatggttttgccgatgtttttctgccagattttgaccgtgcagatgccgtctgaaggaatcttgcctttatcgaccaagccctgttcgatggagaatgcgcccacggcagcggtgaggttgccgcagttgccgctccaatcgacaaaaggtttgtcgatggaaacttgcccgaaaaggtaatcgacatcgtgatcggcgcgttcggacttgtccaaaatcaccgccttgctggtggacgagctggcgttgcccaaaccgtctatctgcttgccgtagggatccgggctgccgagtacgcgcaagaggattttgtcgcgtgcgcttcccgcttcccgcgccgcctcgggcaggtcggaacgtttgaaaaacacgccttttgatgtaccgccacggtagtaaacggcgggaattttaatttgcggcatttctagattctccttatgtagcgtgggctctgcccacgatttttatagtggattaggctgccactccgaccaaagccgtttgattccgcaaactgtcggggttcgccccaatctacggctactgtgttgtgatacggcagattattaaaccccgtcattcccgcgcaggcgggaatccagatttatccgcacagaaactcatcggataaaaaggtttcctcaattccactttctggattcccgcctgcgcgggaatgacgatttacagtatagtggattaaatttatagtggattaacaaaaaccagtacagcgttgcctcgccttagctcaaagagaacgattctctaaggtgctcaagcaccaagtgaatcggttccgtactatctgtactgtctgcggcttcgccgccttgtcccgatttttgttaatcctctataccatgtcaattcagcctttatttcgcgggcaaagcccacgctacacccactttccagaagtacattaggctgccactccgacaaagccgtttgattccgcaaactgtcggggttcgccacaatctacggctactgtgttgtgatacggcagattattaaaccccgtcattcccgcgcaggcgggaatccaaatttgtccgcacagaaactcatcggataaataaggtttcctcaattccactttctggattcccgcctgcgcgggaatgacgatttacagtagatgcctgccatatcgagaattacgtgaatgagcaaaatgttgaacccgacccacgctacgtcttgcttttcagacgacctctaagccgcgttcccttccaaaaaatcctgtgcaaaccgttgcaacacgccgccggcttcatataccaatacttcttctgcagtatcgaggcagcaggtaacgggaacttcaacggtttcgccgtttttacggtgaatcacgagggtcaggtcgcagcgcggtgtgcgttcgccgaccacgtcgtaggtttccgtaccgtccagttgcagggtatggcggttggtgtcgggtttgaactgcagcggcaacacgcccatgccgataaggttggtgcggtggatacgctcgaagccttcggcaacaatcgcttctacgccggcgaggcgtacgccttttgcagcccagtcgcggcttgagccttgaccatagtccgcaccggcaatgatgatgagcggctgtttgcggttcatataggtttcgatggcttcccacatgcgcatggtttcgccttcgggttcgacgcgggcgaacgagccttggcgcacgctgccgtcttcgtttttcaccatttcgttaaacagtttcggattggcgaaggtagcgcgttgggcggtcaagtggtcgccgcggtgggttgcgtaagagttgaagtcttcttcaggcaaacccattttcgccaaatactcgcctgcggcactgacggccaaaatcgcattggacggcgagaggtggtcggtggtgatgttgtcgggcaaaatcgccagcggacgcatacctcttaatgtgcgttcccctgccagcgcgccttcccagtaaggcggacggcggatgtaggtggacatcggacgccaatcgtacagcggactgggtgctttttgcgctgtgccggtgtcgaacatcggtacatacacatcgcggaactgctgcggtttcacatattcggcaacgacggcatcgatttcttcatcggcaggccaaatgtctttcaggcggatttccttgccgtctgcaacgccgagtacgtcgttttcaatatcgaaacggatactgcctgccagcgcgtaggcaacgaccaacggaggcgaagcgaggaaagcctgtttcgcatacgggtggatacggccgtcgaagttgcggttgcctgataatacggcggtggcgtacaaatcgcggtcgatgatttctttctggattttcggatccagcgcgccactcatgccgttgcaggtggtgcaggcgaaggcgacgataccgaagccgagtttttccatttcgggcaacaggcccgcttctttcaaatagatttcggctacttttgaacccggggcaaacgaagatttcacccaaggtttgcgtttcaagccgagacggttggcattgcgtgccaagagcgcggcggcaacaacgttgcgcgggttggaagtgttggtgcaactggtaatcgcggcgatgatgaccgagccgtcgggcatttggccgtccgaaggctcttcgtaaggcttcgccagccctttcgccgccaaatcggcggtcgcaaaacgggcatgcgggttacttgggcctgccatattgcgcgttacgctgctcaaatcaaatttcaaaacgcgaggataaacggcggttttcaaggcatctgcccacaagcctgcggttttggcgtaggtttccaccaatttcacctgcgcgtcgtcgcgtccggtcagtttcaaataatcaatggtttgctcatcaatagcgaacatcgcggcagtcgcgccgaactccggcgtcatgttggaaatggtcgcgcggtcgccgatagacaggcttctcgcgccctcgccgaagaattcgacaaacgccccgaccacgcgttctttgcgcagaaactcggtcagtgccaacacaatatccgtcgccgtaatgcccgcctgccgtttgccgttcagctcaacgccgacaatatcgggcaggcgcatcatggacgcgcgtcccagcattacggtttccgcttccaatccgcccacgcccacggaaatcacgcccaatgaatcgacgtgcggcgtatgtgagtcagtaccgacgcaggtatcggggaaagccacgccgtttttgacttggacgacgggcgacattttttctagattgatttggtgcatgatgccgttgcccgccggaatcacgtccacattttcaaacgcggtttttgtccagttgatgaagtggaaacggtcttcgttacggcggtcttcgatttcgcggtttttgcggaaggcatcaggatcgtaaccgccgcactccaccgccagagagtggtcgacgatgagctgggtttgcaccaccggattcactttggcaggatcgccgcctttttcggcaatcgcatcgcgcaggcctgccaaatccaccaacgcggtctgccccagaatatcgtggcacaccacccgcgccggataccacggaaagtcgatttcctgcttcccttctatcaactgccccagccagctttgcagcgtcggcaaatcgactttgtccgcgcggttgaccaaattctccgccaaaatgcggctcgtgtaaggcagcttgtcgtaagagccgggcttgatgtcctcacacgccgcacgcgcgtcgtagtattccaaatccgtaccgggcagcggtttgcggtaacgttggttggcagccatgtcggttctcctgtggatctgtttttcttgtggtttgaggtttcagccgacgttttgaaggggtcgtctgaaagggtttaaaacatcgaaacaatcatctgatacagcggatttctctcgtctatcaacaatttcacagccatcgaaatgctgatgacaatcagcagcggcttaatcagcttcgaaccgaagcggacggcaaatctcgcacctaaattcgcaccgacaaacgcaccgaccgccatcgttgccgcaatcgggaaaataatcgaaccgtgcagcaggaataccgatagcgaaccaagattgcaggcaacgttcgccaatttggtgtaagacatcgcgttcaacagcttgcagccgagcaaaacaataaaggcaatcagaaaaaacgagccgacacccggtccgaacacaccgtcgtaaaaacccaaaagcggtgcgaccgtcagcccgaacagaaaaaaagacattctggctttgccttccttactgccgtcgagcttgggcgaaaacacaaaatacagtgcgacaaatatcaacaaaaccggcacgaccgccagcagaatatctttggaaaccaagctgaccgataatgcaccggccacgccgcctacaaacgatgctgcggcaatcgggagacctttcttccaatcaatcaaacctttgcgtgcaaaagaaaccgtagctgaaaacgtagcagcggctgcttgcagcttgttggtggcaattgccgacacgggaggaatacctgccaacaagagtgcgggcagcgtaatcaaaccacccccgcccgcaatcgcatcgataaatccggcaatcatcgcaaccaaacccaaagcgagtattatatataaatcttccatgtttcttatcctgttacttgcgccaatacaggattatcttctcctattagattaaacttatttcagacaacctttccaataaggcaaggtcgtctgaaatccttagctttgcataccgaaattaaagaacaaactgctattgcattcttcaattatcgttcttcaatctccacaaacgccaaatcttcagggcctgtgtagtttgcgctcggacggatgattttgccgtctttgcgttgctcaagaacgtgtgcgctccaaccggttgtacgggaaattacgaacagcggtgtgaacatagcggtcggtacgcccaatttttggtaggaaacggcagagaaccagtccagattcgggaacatttttttctcttcccacatcacgctttccaaacgttcggcaatgtcaaagaggcgcatatcgccggtttctttgctcaaaccgcgtgccacttctttaatgacaacgttgcgagggtcggaaatggtgtacaccggatgaccgaaaccgatcacgatttctttgcggccgatgcgttcgcggatgtcggcttcagcttcgtcggcattgcggtagcgtttttgaatatcgtaagccacttcgttcgcgccgccgtgtttcggacctttcaacgcgccgattgctccggtaatgctggagtacatatcagagcctgtaccggcgatcacgcgggcggtaaaggtagaagcgttgaactcgtgttcggcatacagaatcagtgaaacgtgcatggctttgatgtgtgattcgcttgggcgtttgccgtgcaacagttgcaggaaatgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatccagaatgtcgtaaccgcgatagctcaaatcgttgccggtacggccaacggtacacaaagcggtattaccggccgcaacgccagaaagcgcaacggattttttaggtttgagggtcggggtttgagtagtttcagtcatggtatttctcctttgtgtttttatgggtttcgggttttcagacgaccgatgcggatttgttgaaaggcagtctgaaagcggtaaatcatttttgaaacaatttatccagtttttgctcgaaggcatgatagttcagatgctcgtacagctcggcacgggtttgcatactgtccaccaccgccgcctgagtgccatcgcgcataatcgcttcgtaaacattcagagcggctttgcttgctgcacggaacgatgacagcggatacagcaccagcgacacgccgttttcagccagctcgctttgggtataaagcggagtggaaccaaactcggtaatgttcgccaacacgggcactttcaccgcatctgcaaattggcggtacatgttcaaatcggtcatggcttcagggaaaatcatgtccgcaccggcttcgacacaagcttgggcgcgttcgatagcggcatccaaaccttctaccgccagcgcatcggtacgcgccataatcacgaagttctcatcaacgcgcgcatctacggcagctttgatacggtcgaccatttcatctttagatacaatggctttgttcggacggtggccgcagcgtttttgcgctacctgatcttcgatgtgaaccgctgcaacaccggcgcgttcaaagttgcgaatggtacgggcaatattgaatgcaccgccccaacccacatcgatgtccaccagcagaggcgtatccacgttgtccgtaatgcgtcgtgcgtcgatcagcacatcttccattgtggtaatgcccaaatcagggataccgcaagaacaggctgccacgccgccgccggacagatagatggctttgaaaccgctttgggtggccaatcgtgcaaaataagcattgacgcaaccggcgacggcaagcggattcgattctttcacggcttggcggaaacgtgctccggcagagtgttgactcatcatatttctcctttatagactttttttcagtatggacaggcttccatcacattcggacggcaaaacacagccatccgacgcgtcgggcatcccaatccaatcattaaaaatatatgggaaaaattatcttattgatatttaaaacgaatcaaagaaaaacagcagaccgttcggaattatgcggcaaaaccgcagacaagaagaaaacaaggggattattcagaaaaggggaaaacatctgaattggtttcatagtaatgttcctttgtagtgttatgtagttttatttttcgataatctaaaacacaagactgaaaatgtcaaacatttttaaggagactcattacataattttaatattttattttaattccatgattaaactagattaattttgaattatttgtttcaataaaattgtcaggaaatcaagaaaaatttttgataatcaaaatcctgaaaacttataaaatattttatacataaaaacaatgtattatttttaagcaatccgatgtattttattatgtatttgatttttatataatttaataaaaattaaatatatcggcaaacaaaatgccgtctgaaaacctttcagacggcatttttaatatcgaatcaatcagcccaaataccagaatttcagtgcccacaatacggcaacaatccataccataggcggaacgtctttggtgcggcggcataaaagtttaaccacggcataactgatgaagccgaaagcgatgccgtctgcaatcgaataagtaaacggcatgaaaacaatggtcaggaacgcaggtgcggcttccgtcatatcgtcccaatcaatatccctcgcactgcggagcatctgcgtgccgacataaagcagggcgggcgcggtggcaaaagcgggaacacttttcgccaaaggtgaaaacatcaggcaggcgagcatcaatacgccgacggtaaccgccgtcaggccggtccgtccgcctgccgatacgcccgccgcgctttccacataaggcgtggtggaagaagtacccaaagccgcacctgccacaatggcggtagagtctgcaagcagtgcgcgtttcaggcggggcagcttaccgtccaccagcagcccggcacggtgggatatgccgaccagcgttccggtactgtcaaatagatcgaccaagaagaagacgaaaatcacactgaccatgctgacggtaaacaggccttcaaaatccatctgcataaaagtcggcgcaatgctcggtacttcgccgatgatgccgtgaaattcattcaaacccatcaggctggcaatgacggtaatggtcaagatggtgatgatgattgcgccttgaacgcggaaatgtcccaatacgaccaccatagcaaaaccgaacaatgccaacaacgcggacggctgatgaatatcgcccaaaccgaccaaggttgccggattggcaacgataatgcctgcgcctttcagggaaatcagtgccaaaaacaaaccgataccggcagcaatcgacattttcaaacccataggcagtgcgttgaccagcatttccctgactttaaaaaagctgaacaggataaaaatcagaccggagatgaacaccgcacccaacgcaacctgccaaggcacgcccatacccttaacgacggcaaaggtgaaataggcattcagccccatccccggtgcgagtgcaatcggatagttgccgacaaaacccataacaaaacagccgatggcagacgcgatacaggtagcgacgaataccgcccccatatccatgccggtctcgcccaaaatcagagggttgacgataacgatgtagcacatcgtcaaaaaagttgtcaaacccgccatcaactcggtacgcaccgtcgtaccgtttgccttcagcttaaaaatcccgtccaacagtgtttgttttgaagtgtccatatctgaaagtctgtatcaagtggaaaaatctgaatccgccgaccgcaaaccgtacgaaattgcaacatcttgaaaaacatacctcccaaaccggacaaaccgattcgggaggcagcaggtttacgggcaaacagcacattatttgtctgaattgtgttgacgacgcaaaatcgcagggatttcaaagtcgtcaagtacggactgattgtcgaaatccgcagcggtaaggttcatcgtgcggataccgcgattggtgcggatcataccttcgacattgtggctttgctcctgtttggacggagcaaccgcttctacctcccttgccggaacaaaatcgaccgcgcctttttctttcagaccggtagcgataatggtaatccggatggcatcttcgctcatggtctcgtcttcagccgcaccgaatttgcattccaaatcgggatgcgcgctttggttgacgattttcatgacttcggacaactcggacattttcaagcaacccggagcagtcgtaatattgaccagcacaccgcgcgctccgtccaaggttacatcgtccagcagcggactggaaatggcctggtcggtcgccatacgcgcacggtcgataccttgggcataacccgaacccatcatagcgataccgcggttgctcatcacggttttcacgtcggcaaagtcgaggttgatgatttcgctcgggcaagttaccacttcggaaatgcctgcgaccgcatcgcgcaatacattgtcggcggcacggaaggcttcgcgcatcgttacgtcttcacccaatgcagtcatcagtttgtcgttcgggatgataatcagcgaatcgacgtgttctttcaactgttccaaccctgcctgtgcgacatggacgcgcttaccttcatatgcgaacggtcgggtaaccacggcaacggtcagaatgcccaaagacttggcaatctcagcaacaaccggcgcggaaccggtaccggtaccgccgcccataccggtcgtgataaacagcatattcgcaccgcgaatggcttcttcaatggcttcccggtcttcctgggctgccgcacggccgatatcgggattcgcgcccgcgcccaaaccgcgtgtcagattcgtacccaactggattctcttcgccgcatggttttttgccagagactgcgcatccgtattggcactgataaactccacaccgcgcacattgttggcaaccatgttattgattgcattgcaaccgccgccgcccaagccgattactttaatcaccgcagggctgactgccgattctgccacgtcgtaaacaaattccattcaaaaactcctgctcgccccattcagaggacggtttaaataaattattattcattatataagaagtatcttgctgctggcaaaatacttctcacctgtcaaacggcaatccacctgttcagaagctgttttcaatccaccgtttcaatcttgccaacaaaccgccgcccccttccctctcttgcactgcaccgttttccggctgcggcaagtttccttccagcttgcatgctgcatgaagcagcccgatagcggtagaaaaacgcggtgtgcggacgcggtcggacaaaccgcccatttcttggggtgcaccggtgcgtacaggcaaatcgaagattttttcggcaaattccacaatcccggtcatcatggacacaccgccggtcagaacgatacccgcattcagcacttctttggggaaacccgatttttgcagctcgcccagcactacgccaaaaatctcctgaatccgtgcactgatgattgctgccagaaccttactggaaacctgacgcgatgtccggtcacccacgcccggaacttcaatcatctcacccaagccttccgtatcgcatgatgccacgccataatggattttaatgtactcggcggcatcgagaggtgttctcaacgatttggacaaatctttggtaatcagattaccaccggccggaatgacggacgtatggcggatggcaccgttcatataaacggcaatatcggtcgttccgccaccaatgtcgatgacgcatacgccgaggtctttttcatcttcagtcagcaccgcctgcccgcttgccaacggctgaagcatgatctgatcgcttttcaaaccgcaccgctcgatacatttttggacattctgcactgccgtacttgcaccggtaatgatgtgcacccgcgtatccagacgcacaccgctcataccgatgggctccctcacgccaagttgggtgtcaataatgtagtcttgaaccacggcatcgagaattttttgatcgggcgggatattgattgcctttgccgtttcaatggcgcgatcgatgtctgcctgcgtgacttccccatctttaattttaaccacaccttgcgaattgagactgcggatgtggttgcctgcgatacctgtggtaacgtgagtaattttggtatccgccatcagctcggcatcattgaccgcctgcctgatggcttggacggtggcatcgatattggttaccatgcccgcgcgcaagccccgtgaaggagcctgccccaaaccgacgatgttgattttgtcgtcatcttgaacttccccgatcagtgcgaggactttagacgtaccgatatccagtacgctgatgtatctttgctgctgttccattgttcgtctgctcttaaaactgattgaaatttgcgtcgcaccgtttcagacggcacggccgtaatctgtccgatacctgttcccactattcttcggattctttttcgggtaaaccgtcggaagcatagcggactgaaaatccgtccttatacctcatatccacataggataaccgatttttatttttacgcaacagatgctgccacgcttcggtaaaaagccggaggcgtttcatctcgttttcccgtccgagcctgacggtgatgccgttgtccaaaacgacaatccacgccgaacgtgccgtataggtcatctctttgatgcccaaaccctgttttgccaaaacagtcgaaaattcgtcataacggcggagcatttcggcagacgttccttccgcgcctctgaataccggcattccgggtctgtccaagcgggcttcaaaaacattgccttcgccgtccaccaaggcatggtcgccccaacgcgcgaccggcttgcgctcggtcaggacgacctcaaccgtgtcgggaaaacggcggcgcaccatgaccgacgcaatccacggataccggcggtaggcctcctgtgcgccattgatgtccgtcctcaaaatattcccatggatgtattctttcgccaaactgcccaatgtcttcttatcggaataaaccaggttgcccttcagcgacacctgcttgacgggcagatgattcgaattgtaaaaccaaaccagcccggacgcagcaagcagcatcgccatcatgacaagcagccagcgcgtcagccgttccatcgcttcggcattatcccacatgtgcggtcttcaaaatttcaatacataaatcggcaaaacccacgcccgtaacggcagcggatttcggtactaaactatggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttgacttttaccacgcctacgctgctgccttcggccgccggtttcacaaacatcggcaggcccaatttttcttcgacggcatcgaaatcagtgtcgtcgtgcaggacggcgaactcgggaacgggcaatcccaatgcctgccaaatcagtttgcagcggtatttgtccatgccgatggcggatgcggcgacaccgctgccggtatagggaatgcccaacagttccaatgcaccctgaaccgccccgtcttcgccgtaagtaccgtgaaggatgttgaatgccgtctgaaaaccttgtgccttcaattcagacaatggggtttctttaggatcgaaggcgtatgcgtctatgcctttgctttttaaagcattcaaaatggcggtgccgctgtccagcgagatttctcgttcgctggaaaaaccgcccatcaatacggccactttgccaaaattctgcattgtttttgttctttcctgattgctttatgcttgttgccagaggtcgtctgaaacctgatttgcggtttcagacgatctttatatgatgttccgtctgtcaggcgggtgtgcctcaaatctgtttcgacaatgccagcagcgcggcggggacgcggttgatgcttcccgcgcccatattcaacacgatgtcgccgtcctgcaaaacgttcaacagcatttcgggcagatcggcaacgttttcgcagtaaatcggctcgagtttgcccaacacgcggatggcgcgggcaagagcgcgggaatcggcggcggcaatcggctcttcaccggcggcataaacttcggtcagcaccagcgcgtcaacggtattgaggactttggtaaagtcttcaaacaaatcgcgcgtgcgggtatagcggtgcggctggaaggcgagtaccaaacgtttttccagatacgcgccgcgtgcggcggcaagggtcgccgccatttcgacggggtggtgtccgtagtcgtccaccaagagcgcggtcccgccgtttggcaacttgatgtcgccgtatttttggaagcggcggccgacgccttcaaagccgagcaagcctttttggatcgcttcaaccgatgcgccgacttccagcgccacgccgatggctgccaatgcgttcagcacgttgtgtctgccgggcatattcagcacgacttcaaacgacccctgctcatgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcaggtgcagaaaggatgcatccgactcgtcggcttcggcaacgatgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataaacttgaatgcccaggctgcccaaatgctcggtagcggcatttcgcgcctgatccgaaccggaaactttaaagcccaaattgtgcaagacttcggcgatgccgctcatgccgacgccgccgataccgacaaaatggatgttggtaactcgatttttcatcataatgttgcgttccggtggattttcgatgcgtaaaggcgttattttaaagggctgaccgtttgcgcgccatagttttctgacaaatatatagcggattgaaataaaaaacatccatgccgtctgaacggcttttcagacggcatggttcggcagtttacgccgcacacgcaatcgcggcttccgccacgtcgtccgcactgtgcggcagtgccaacgtacgggcgttttctgcccatttgaggcatttttcgcggtttaagccgccgagaatctcggcgagtttttccgccgtcaactgggtttgcggcaacagcaatcccgcctccgcctgcaccataaaacgcgcgttggcggtttggtgatcgtcaaccgcgtgaggatacggcactaacaacgcacccaatcccgccgccgtcaactcggcaatcgtcagcgcgccggcacggcaaatcaccaaatcggcatcgcggtaggcggacaccatgtcggtaataaattccacgcattcggctttcacgcccagcgcgtcgtaatccgcctgcaagctgcccagcttgccccgtcccgattggtggtacatctgcggacgcgcattgtcgggcagcaaagccaatgcctgcggtacggttttgttcaaaacgtccgcgcccaaactgccgccgaccaccaaaattttcagacggccttcacgcccttggaagcgttcggcaggcacgggcaggttgctaatatcggcgcggacggggttgccgaccaagccgccttcgtggctgaacgctttcggaaaagcgtacaacacccgcttcgcccagcgcgacaggtggcggttggacaaacctgccacggcgttttgctcgtgaatcacaatcggcacgcctaatagcttcgccgccaaaccgccggggaaggtaacgaagccgccgaagccgatgacgcactcgacacggtgtttgcggataatccgctgcgcttcgcggacggtttgatacaaagtaaccggcagcatcagtttgcgtttgatgccgttgccgcgcacgcctttaatcgccagcgtttccaagcgtatgccgtattgcggcacgatacgctcttccatcgaatccttgctgcccagccaaatcacatgatggccgcgcgcgcgcaatgaatccgccaccgccagcgcggggaaaatatgtccgcccgttccgcccgccatcagcataaaggttttaccgcccatgatttactccacccgataaccgcgcattttccggcggttttcataatctatacgcaacagcagcatcatgctgatcagcatgaaaaagactgacgaaccgccataggacatcaacggcagcgtcagacctttkgtcggcaaagcaccgatataggcgttgaaagtcaaacccaaatcgcgcgactgcttgccgatggaaaacgcccgcaccaccagccagccgtaacagaatatcagcacgcacataccgaagaaaccgaattcttcggcgatgatggcaaaaataaaatcggtatgcgcttccggcagaaagccgcgtttgctcaaactcgcacccaaacccataccgaaccactctccgcgcccgattgccatcagagagtgggtaagctggtagccggcaccctgcgggtctttccacgggtccaaaaatgccactacccgctgcacacggtagggagcggcggtaatcatcagcaccatcccgcccaagacgctgcctaccaggacgaaaaaatatttccacggcaatcctgccaaaaacagcattccaacggcaatgacggtaatgacgacaaacgaaccgaaatccggctgtaccattatcagcaccaaaccgaacgccaccagcataatcggcaggatgatcgcccggaaacggccgtacatttctaatgtttcacgacgtgcctgcggattggtggcggacatgatcagattggccgtcccccgccaaatcgactgccaacccaaactttccatgctgcgcaacacttcttcacggcgcgtgaacaggcttgccaaataaaggatgaccgccagcttgaacagctcggtcggctggaaattcaacggacccaaaggtatccaacgggtcgcgccattgatttcgcgcccggcaatcaatacgactaccagcaacaggccggatagggcaaaaatccacggcacaagccgccgccatgtcctcatcctgcaaagaaaccataacaaaccgctcgctatcaagccggcaacgacgaaccccgcctgtctggtcaaatagaaaaactgatcgccgccttcttttgatgccaaatacacagaagccgaataaatcatcagcaggctgaacgccgtcatcagcaccaccatccacaaaagcggcgcgtcgaatttcctgccgtcgcgcacaatcggcctgtcgagcagcagagtgtggacaccgtcgcccacttttaccaatacttccgaaatcttcaaaaaaaccacctgccagtctgtttgcacctgccgcaaagggcaaaaatttcagacggcagacaatgccgtccgaacatacgatacatcccaaatcggtattctaaatctttacttgccgcccaacaatgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgctgccgcctgccgaaaccatctgaccgcttcgacatcgtcttggcgcactccacgtccttcggcatatatcacgcccaaattgtattgggcttggacaaccccctgcgctgccgcctgccgataccatctgaccgcttcggtatcatcttggcgcacgccgcgcccgttggcatacatccagcccaaattgtattgggcttgggctaacccctgttccgccgcctgccgataccatctgaccgcttcagcatcatcccggcgcacgccgcgtcctttgtaatacattgcgcccaaattgtattgggctgctgcatttccctgtgctgccgcctgcaagttttcccgaaaatccgatacgtcatccgcccacaccgctcggttcaagcccaaggcaatcagggcggcggcaagccatttgactgtctgtttcatggttttacttctgttttagtataaggcgggtttcagccaccgttaacgatagggctgggcggattgtcgccgcaggtttattgcgcgttcaaatgccgtctgaaagatgttcagacggcataggttcagcggattttgagggtactcaaaccgatcaacaccaagacgatggtaataatccaaaagcggacgacgacttgggtttctttccagcctttttgttcgtagtggtgatggatgggcgccatcaggaagatgcgttttttggttttcttataccagccaacctgaagcataacggatacggcttctacgacaaataatccgcccataatgacgaggacaaactcttggcggacgataacggcgacggtaccgagcgcggcacccaatgccaatgcaccgacatcgcccataaagacttgcgcgggataggcgttaaaccacaagaaaccgaggcacgcgccgcacatggcggtacagaaaatcaccacttcgtttgcgccggcaacgtaaggtaattgcaggtattgggcaaattgtgagtggccgctggcataggcgaagatggcgaggccggcggcaacgaggacgacggggaaggtcgcaaggccgtccaagccgtcggtgaggttgacggcattggatgtgccgacgatggtcaggtaagacaacaccaaaaagccgaccacgcccagcggcagggcgatttgtttgaagaacgggacaatcaaaatattgttggcggaattggcggcaaggtaaaacaatgccaaactggcgataatggcaacgcttgactgccacaccattttgaatttggcggacacgccgttggggtctttatagacgactttgcgccagtcgtcgtaaaaaccgagtgcgcccgtggcgagcaatacgcccaagagaatccagatatacgggtttgcccagttgccccacaacagggtggacacggtaatggcggtcagaatcagcgaaccgcccatcgtcggcgtgccgtttttgacgaggtgggtttgcggaccgtcggtacgcactgcctgcccgcatttgagcgcggtcagcctgcgtatcgtccacgggccgaacatcagggaaaacgctaaggcggtcaacgccgccatgacggcgcggaatgtggtgtattgaaaaatattcagaccggttaaccagttgctgaaatgtgcgagccataaaaacatggggcttcctttttttgttttgtcgttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatacatcgggcctgcgcccgtttgaggttggcttgccgcccggcaaggtttcggacggcttttgcagattaacgtgcagggactttctcaatcacgcaaattgggtaactccccggatttttaccgccgcccaagtctaaacataaatcttcataaagatacgcctgcgtccgcattccggcataaaacgcgccgaccagcgcggcaatcagcaataaggctttaaaaaaacgtcggcttttcattttcacttatcctccaatgcctcgaccacttcttccatctgcataaagcgcgaacctttcaccaacacggtggcgcgttcgggcaaatcgtggcgcaacacttgaatcaacgggtctttggcggcgaaccacaaaccgtccgcgccaaatttttccgccgcttcgacgctgttgtcgccgacaaaataagccgcttcgatgccttggtcgcgggcatacgcgccgacttcggcgtgcatagcggcggcttcgtcctcgcccagttcgcccagttcgcccatatcgcccatcacgaaaatacgcggcgcaggcatacgcgccaacacgtcaatcgcagctttcatgctgtcagggttcgcattataagtatcgtcaatcagggttgcgcccttgattccggatttgacgttcagacggcctttgatattgctgaagcctttcaaaccttccgccacatcgttcaaactcaaacccgcagccaaagccagcgcggcggcagcggcggcgttgtggacattgtggcggccgggaacaggcagcaccacggcggcgcgctcatcgccgcacaccaaatcaaattcgcacgacaacggtttcagcacaatattttccgcgtgaacatcgccgctatcgatgccgaaagtgcgcgtattcaaattaagcgttgccgttttgaagacagccatattggcatcttcttgaggaatcagtgcaatgccgtctgaacataaaccttggtaaatctcgcttttcgctttggcaatatcgcccactccgtcgaaaccgcagccgacatgggcgcgcatggcgttgttgaccaatgcggcatttggtttggcgatttgcgttaaaaccgccagttcgccgaaatggttcatgcccatttcaatcacggcatagcggtgtttttcgtttaacttcaacaaagtcagcggcaatccgatatggttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaaaaaattaaacgcgctgcgcctcactttaatcatttcgcgccgcgtgtcatcggacgaaattttaaccagcggcacgccgtagctttgacgcttccacgcaccatgtgtcaacgttcgctcgccgcctttaccgacatgcatcaaaccgtggtcggaaaagtaaaccaaagaccagctttctttattttcattcaatatcttaactgtatcttctaaaaatttatcggtttgcgcgatggtggaaacatagcaggatattttttcagtttgatactgaaaccgccgcgcatccttatccaaacgtgtgcaaaaatcactgtgcgaacccatcaggtgcatcacaatcagccgaggcttcgtgcctgcatttcctatcaaaacccgtttgaacgccggcaacaaaaggcggtcgctcaaccccgcgcttttgccataatcacccctttgggtaaaccacggataatcgctgcgtagggcataggtggaaatttcgttggcaaaatgccccaacattccttgattagacagccacgccgtccgaaaacccgcctgcttcgccaagctgacgatgttattgttcggttctcccggcagccccaaagtctgcggcagcgaaagattcgtcgcgtgggcggtcgattggtaaccgtttatcaacagccctttggtctgactcaaaaaaggcgtatcgggcaatgggaaaccgtaaacattcatataatccgaacgcgcgctctcaccgataaccacaacataatttttatacttgggcgcaacatgacggatatgccatgttgacgctttttttgctgcttccaaaatgtgggcgcgcttggcggcatattgtgccggcgcggaagccaaatcgtaatacaggtcgaaaatattcaacaacaggccggcatcaggttctcgcaaatctttatcgctggcgattttatccatcaccgcgcaggacaaaatcaaagtcaataatatagtcagccatattttgctgcggcgtttatagttttttacgtcagcaaatacccccccccgatacacaatatttccaaactgtcaagccaaaaatgaaaaataatgcctgcacaaaataaagcgacccgggaagattgccgacaaattcacgcgcctcggcaggattgctttccaatatcgaaccgactatctgataagacggcgcaccatacagccagccgaccggcaaatatagggcggttgtgccgacgtaaatcagtaaaacaactgaagaaacgcgcgggaaaccgcgtgccaataataataaaaatacaaccgaagccaaagcacccacggcagaataacggtagccgtattcatattccaagtgataacctgatgcgatggccgcgccaaaacaaaaggctaaaagcgcgcaaatgcccaatgtattttttaatgtctgattcatattttttattcgggcggattgtttcatacgatgccgtccgaatatcccattatttacgagttaacaaagcctgtccgacgatttcaagatcggaaaaacggtgcttcacgccttgtacatcctgatagttttcatgccctttgccggcaatcaggatgatgtcgtttgcggcggcttgttcaaccgcataacggacggcggcggcacggtcggcttcgacgcattcgggcgcgggaacggcaggcaggatgtcgttgatgatgtcgtgcggattttccaaacgcgggttgtcgctggtgacgacgactttatccgcgccctgtacggctgccgcgcccatcagcgggcgtttgccgcgatcgcggttgccgccgcaaccgaatacgcaccataaagccgcaccctgcggtttgatttcctgcaaggtggcgagtgctttttccaatgcgtcgggcgtgtgggcataatcgacaacgaccaagggcttgccgctgttcatgatgcagtccatgcgccctgaagcgggacggatttttgccagcacatccaataccttatcaagcggatagccgttggcgcacagcaaggcgatgcaggcggcgaggttttgcgcgttgaaccgtccgagcaggcgcgtgcggcatttcccttcgccccacggggtttggaatacggctgctatgccgtctgaagaggcggtaaagtcggtaatgcggatgtcggcgtgttcgctgaaaccatagctgtaaacggccaaatcgggacagtcttttttcagacgacctacgagttccgcgccgtattcgtcatccacgttgatgactgcgtgtttcaagccgtgccagtaaaacaggcgcgacttgatggcaccgtaggcttccatcgtgccgtggtagtcgaggtggtcgcgggtgaggttggtaaagattgcgctgcggaatgacacgccgttgacgcgcgactggtcaagcccgtggctggagacttccatcgcggcgactgttgcgccttgttgacggaaacggtagagcagggtttggacatcgacgggggcgggtgtggtatgcgtggtttcttccaatgcaccccaaaagccgttgccgaccgtgccgacaatggcggttttttcgcccaacaaatcggcagcttgcgccagccattgtgtgatggaggttttgccgttggttccggctacgccccaaactttgaggccgtctgaaacgttgccgtaaacttgcgccgccaatatgccggcacggtgtttcaaatctttgatgccttgattggggactttccattcgggattccacgcaaatttgccgtcgtcgtcccaaaaaacaaaagccgcgccgttggcaacggcggcggggatataactgcgtccgtcggcatattcgcccggacaggcaacgaaaatatcgccttgtttgatttggcggctgtctgaatgcaacaaacgccctgccgcgtttgcacacgacagagtcgggatgccggtttcagccaaaggggttaacttgctgaacataaaacaatctcgttgatactcggattaagacggtgttttgacggctgcggcggtcagtggcttggtcggggaaatgcccaagatgttcaggctgccgcccataatttttttgaagggcggccctgccactacgccgccgtaataaccgtgggcagtcggttcgtcaatggttaccgccacaatcacacggggatttttggcgggggcaaaaccgataaaggtagcgatgtgtttgttgtcggcataacgcccgttgacgaacttgcgcgccgtgccggttttcgcgccgacatcgaaaccgtccaccgcacccgccgtaccggtgccgcccggctcggttacggaaaccatcagattgcgtacctcgcgcgcggtcgattctttgaatatgcgtttgccttgcggcgcaaccgcctgtttttcaaagctgaccggcagtaaaacgccgtcgtgcgtcagtgcggtataggcgcgcgccaattgcagcaggctcaattgcaggccgtaaccgaaagacatcgtcgcctgttcgataggccgccacctgcgccaatttctcaacaaacctgcagtttcgcccggaaagcccgagtgcatacgcacaccgatgcccaactcatgatagaagtcatacatttcttcggcaccgaaacgcgcagacagtttgcttgtgccgacgttggacgatttctgcatgatgccgcgcacatccaaagaggggtaaacatgggtatcgcgcacgggagacggtccgattttataaggctgcgtattcagccgttcgttcaaatcggttttgcccgcatccaatgccttcgcaatcacaaacggtttgattgccgaaccgggttcgatcatatcggttacggcacggttgcgccgctgttcgctgtctgcccggccgggcctgttgggatcgtaggcgggcgtattggccaaggcgaggatttcccccgtgcgggcatccaaaaccaccaccgttccggcttttgcctgatggtattcgaccgccttgttcaactcttcataggccaaggtctgaatcctctgatcgagggaaaggatgatgtctttgccgtttttcggggctttattgcgcggggagtccaagctgtccacaatattgccctgccggtcccgcaaaacgacttccgcgccgtcttcgccatgcaggctgtcttcaagcgaaagttccaaaccttcctgacctttgccgtcaatatcggtaaatccgatgacgtgtgcaaacaggttgcccatcgggtaatggcgttttaattctttttcaaatacaaagttttccaaacccaaggctttgacctcttcggcaaccttgggatcgagctgccgcttaatccagataaacgacttgcctttctgttcgagcttgttcctcaaaacatcaaccggcacatcgacaagctcggacaggcgttccaattgtgcggcagacggcatttccttcatctctttaggcacggcaaacagggactccgtcggcgcactcaacgccaaaaccgcaccgttccggtccgaaaccgtaccgcgtgtagccggcaatgtttgagtccgcacaatccggttgtcgccctgttctttcaaaaagttatacgttaccgtctgcagatacagtccgcgagcaatcagaccggcaaacaagaccgctattgccatcaggacgaagctgatccgtccgttactggtcatcggctttttgacctgctcttctttgggcagcatccgaggcttatattcgctcttaatcaacatttttacttctcgttattattatcctgacgcaggaatccgattccggcacacaggctgcttctatctttgatgctccaccataaaggtattgcccgaaaccggcggatggaggttttgtttttctgccgccgccctgatcgcttcgtggttcgccaaacgcgcctgttgcagcctcatttgcgcataatcctgctccaaggcgatttcctgttttttcgccttatccaaagctgtgaaattgagcctgtactggttttgctgcatcacaacggaaaaagcggaaacgcacaccgcaagcagcagaaggaaattcaatttgttcattgccattcagacgtttttctctgtgattgttccggtatcggaccggcagtccgctccgccacacgcaaaaccgcacttctcgccctcggattggcggcaatttccgcctcacccggctttaatgccctgcccacgattttcaggggcagctcgggcaaatccgcttccctgaccgccgcccagcgcggcaggggcgcgtgttgcgaatattttttgacaaactgcttcacaatgcgatcttccaacgaatggaaagcaatgaccgccaaacgtccgccctctttcagacgacacatgacctgcggcaatactgcccctacttcttcaagctcgcggttaataaagatgcggaccgcctggaaggtgcgcgtcgcaggatcctgcccccgctcgcgagtacggacgttttgtgccacgatctgcgccagcttgcgggttgtatcgattggactttccgcccgttgcgcaacaatggcgcgcgcaatccggcggctaaaccgctcttcaccataattcttgattacctcgtgcaaatcctgttccgacgcaaccgctatccactctgcggcagacataccgcgcgtcgtatccatacgcatatccaaaggggcatcgaaacggaagctgaaaccgcggctgccgtcatcgatttgcggggacgaaatccccaaatcaaacagcgcaccgtccaccttgccgatacccaaaccgtccaatgccgtctgaaacgaagcaaaaccgccatgcacgacaccgacccgtttgtccgaacgcgccagctcttctgccacagcaatcgcctgcgggtctttgtcgaaaacaatcaaccgccccgcatcgcccaaacgcgacaaaatcagccgggaatgccctcccctgccgaacgtaccgtccacatagacaccgtcttcgcgcacggcaagcgcatccaccgcctcattcagcaagaccgtgatatgccggtaactttctgctccactcacaattgcaaatccgtctgactcaactggaaggcaagttcgtcaggatcgtcatccaaagcctgaaccatctcagcctcccactgctcgcgaccccaaagctccaaacggttggcacgaccgaccaaaacgacttcacggtcgaaatccaccctcttcctcagtccggcagaaaccagcacccggccggcgctgtcccattccaaaatttccgcgttatgcagcaaaagattttgaaaccgccgcaaaacagggttatccgccacttttaagtttaaaagttgcgccgcaaccttttcccactccgcaacagggtacatcaacagcttgtgtttcgactcgagcgttaccactacggcaggcgtatagaggcgcgacagaatgtcacggaatttggcaggaacagccaaccgccccttactgtcgatgcttaattcgtgtgcgccgccgaacatgacatgtcccaagccgaaatcaaaatcacaagggtaaaagagacactttgccccacaattccccaccaatcgacactataagaaattttaaacactcggtcaaatcagggcatgaaaactcattaacatatctgaaatttttattccttttaaaaacaataagataaaaaatgacgacaacggcacggcgggtgcggtacagaataatcgaaccaataaacaactatatatgattaatttaataatataaacacaatatatagtattaagataaagccatgacagcacccgtaccaacgtgtaatatgtcgggaaatccaataaatttacacaagctaacacttatcatgcccctcccctctcccgaagcacggcaattctcgctcaaactgcaaaccctcattgccgaaaaaatcggcaaacacggcaactggattccattttcacgttttatggaattggttttatacgctccgcaatacggctactacaccggcggcagccataaaatcggcaataccggggattttattaccgcaccgaccctcacctctctgtttgcacagacactggcacgccaacttcaagaacttctatcccaaacggcgggcaatatctatgaattcggcgcgggaaccggacagcttgccgccgatttgttgggcagcatttcggacggcatcagccgttactatattattgaaatatcgccggagctggcagcacgtcagaaaaacctgattcaagcacgcgcaccggaagcatctcaaaaagttgtccacttgaccgcacttcccgaagcgtttgacggcatcatcatcggcaacgaagtactcgatgccatgcctgtcgaaatcgtccgtaaaaatgaaggcggctcattcgagcatgtcggcgtttgcctagataatgaccgttttacctattcggcacgaccgctgcacgacttgcagctatctgccttggcttccctctattttcctcaaacagattatccctataccagcgaactacatccgcaacaatatgcctttatccgcacccttgcctcaagactcgaacacggctgcatgatattcatcgactacggttttgatgcagcgcagtattaccaccctcaacgcaatcaaggtactctgatcggacactaccgacatcacattatccacaatccttttgacttcatcggattggccgacctgaccgcacatgtcaactttaccgacattgcacaagcagggacggatgccggattagatttgataggttaccttccccaatcccatttcttattgaacttgggcattaccgagctattggcacagacggggaaaacggattcggcagcctacatctgtgaagctgctgccgttcagaaactgattgaccagcatgaaatgggcgaactgtttaaagtcatcgcattcggaaaaaatatcggcatcgactgggcaggattccgcttcggcgacatctgccacaaactctaaccctcatgccgcctgaatccgcttcagacggcataaactttttaacatttaaaaacagtcaactaattcaaaattaaaaaatacggcttgtcaaaaaaacagaaaaacatataatagcgtcttcacgaaacggcgaattagctcagtcggttagagcagaggaatcataatccttgtgtccggggttcgagtccctgattcgccaccaaattttcgggggtatagctcagttggtagagcgcttgcatggcatgcaagaggtcagcggttcgatcccgcttacctccaccagataaaaaagcacagaccgtaaaaaggtatgtgcttttttattgcctgattgccagcaaataaagaataaaccactgccttcaaaacaggcaatcgactttaaacctatcgccccgcctgtcctgattttatagtgaattaaatttaaaccggtacagcgttggctcgccttgccgtactatctgcggcttcgtcgccttgtcctgatttttgttaattcactatatcagcccgccagacaaacccgacccgaataatgtcttcaggtcgggtttatggtttcattcccaacttatccagcctgacagccacaatataatgatggcaataccaaaaacaatgcggtaataggcaaaaggaatataatttttcttggaaacaaacctcagcaacgcttttaccgctaccaagcctgaaacaaaggcagcaataaagcctatcagaatcaaaccgacatcatgcagggtgaaaaatcggtaatgtttcaggacatcataagccgttgcggcaaccatcatcggcacagccaagaaaaacgagaattctgtcgcagttttccgttcgatgccccaaagcatcccgcccataatcgtactgcccgaacgggacgtacccggaaccagtgcaaacacttgggcaacgccgatcatcaaggcatcaatcggacgcaatgcatcaacatcggcaattttaggctctgctcggctttggcgtttctccacccacaaaataaaaaaaccgcccaaaaccagcatgactgcaacactcaaggggttaaacagatactctttgatttgtttgccgaacaacagccccatcacggcggcaggtataaaagcaatggcaagattaaggacgaagcggttggctttccggtcttttcccaagccgtgcaacacattgctgaaacgttgccggtattcaaacactaccgccaaaactgcaccgagctggatggcaatttcaaaaaccttgtgattgctgtgaaaaccaatcagattgccgaacacaatcaaatgtccggtgctggaaatcggtaaaaattcggtaaaaccttctaccaagcccatcatcagggctttcaggacaatcagaaaatccattgcttgcgcttctttcggatacgggagttcggctatttctgtacagcaggggtctgacgcttgcgttcttccctgactttggcaaccaattctttaatcgtatgaacgccgccgtcaaagccgttattgaagataacgcggtattttccgccgacaataacggtcggcgtgctgtcgatgcggtattgttccgtcagtttctgcatttttaatgcggcggcggcagcttcgggggaatcataggcgcgcatcagttttttgccgtcaaagcctttttgagacaaagcccattttccggcaaccgacctgttttccaagcggattttttgttcgtaaactgctttaaacacagcagggtttgcctgatatttcaaacccgacaaattgacggcagccgccatcctagccaaaccgagcatttcaggctgccagaccacgtgctccgtcctcaaataggcatcagacggcaatgccttgcccagtttcaataacaaaggatcgaaatgatggcaatgtacgcagaaatagccgaaaaattccaaaacctcaattttacccgactgttcttgaggaatgggtttatccaacacaagatagtcttccccttccgtcagggcatatgcctgcgcggacaacactgccgacagcagcagcggcaacagatgtttgagcttcataattatttgctttcgatagaacggatcaggctggcgacttcatgttttttcaactcgtcctgcatttttttcaccgcatcggcagacatattgccgctttgcacccggtaaagcgttttatgtcccgcctgataaccgaccaccttggaagatatgcccaagattgccagtttggcacgctgcccttccgcgctctgacggtcggcatacgcgcccatttgcagataatgcgttgcttccgccttgtcggacgttttcattttctgcacttctttggcggcggcactgcgcgctttttcgatgctgccgctgttgaggatttgttccggggttggtttgggtgcaactttttccttcgccgcctttttctcttcttttgaagcttttttctctgtttctttagacggttttaccgcttgttttttaaccgtttcggcatctttcttctgcgctttttccctgacggtttgttcacgctcttccgtcagcgctttcttacgcactgcctgtccgtccggctcttcccgttccggctcgcccgccttttcttcaacctcgtcggctttatcggcaacgggctgcttgtcggcagctttttccgcatccgactgctctgcctctgtcgcagcatccggttcggacaaggcgttttgatcggccggttcaggttggatgtcttccttaggctggtttttcggtttcaggatttccgtttctgcaggctgcttcgacgaagccgggattttgaacgcattttgaccgctctggttcagataaaacaaaataccggcaataatgaccgtcgccagtatcaaaccgaagaaaaaaccggacagaccttttccggattgggaaaatttgttcataaacataccttaatgtgtttcagacggcattaacgccgtttgcttacgggcggatattctaacaatatcgccatatttgggcaaaacctgcttccattcccattcctataaagcacgacggaaacctatggctttcatgacgtggcttctgccgacttcttcgtcgcccgccaaatccgccaatgtacgcgccacgcgcataatgcggtggaagctgcgggcggaaagggagagtttttccagcaggccgcccaatgcttcctgcgcttctttttgaatgcgggcggatgtgtcgagttcactgacactcaaggcggcattcactttgccttgccgtgcgtattgtttgtctctagcggcgataacgcgttccaaaacggacgcgctgctttcccctgcttcctgctgcatcagttcggcggcggacaggctcgggacttcgatggtcaaatcgatgcggtcgagcagcggcccggaaatcttgctgcggtaacgcgcgacgctttcgggcgtgcagcggcagggtttgacgggatgcccgagataaccgcacgggcaggggttcatggcggcaacaagttggaatttggcaggatagacggcttggcgcgccgcgcgggaaatgtggatttcgccgttttccaacggttcgcgcaaaacttccaaaactttgcggtcaaactcgggcagctcgtccaaaaacaaaacgccgtggtgcgccaatgaaatttcgcccggacgcggatccgaaccgccgccgaccatagccgccgcgctggcgctgtgatgcggactgcggaaaggacggttgctgtcgagttgttgttggtggttgggcaggagcgaacgcaatgcccaaacttctaccaattcgtcttcggtcagcggcggcaggatgccgggcagccgttgggagagcatagacttgcccgttcccggcggacccatcatcaagaggctgtgtccgcctgcggcagcgatttccaaagcaaggcgcgcggtgtgctgacctttcacatcgcacaaatcaggttgtccgccatgttcaaacggcatctgaggaacttggcattcggtttgcgccaaaggttcgatgccgttcaaatgggcggcgacttcgcccaaagagcgcgcgccgtaaacggtaatgccgcgcatcacggcggcttgtcctgcattttcttcaggcaaaacaaatgcacgttttgcctgcataccctgccacgccatcgccaacgcgccacgcacggggcgcaacagccccgacagtgccaattcccccgcaaactcgtattcctccagtttttcgggcgcaacctgccccgatgcggcaaggatgccgattgcaatcggcaaatcgaaacgccccgactctttgggcaggtcggcgggggcgaggttgacggtaatttttttggcggggaattcaaaaccgctttgaataatggcggcacggacacggtcgcgactttcctttacttccatatcgggcagtccgacgatgttgaaatgtggcaggccgttggcaaggtgggcttccacttcgaccaacggcgcattcataccgctcaaggcgcggctgtaaaccaaggcaagcgacatatttcagacgaccttattcgccggcttcggtttgctgcctgatttcggcgacggcttcttcggcagcggcttcagccgcttccaatgctgcccgttcgggattttgcgcggcttcgagtttttccaaacgcgcttccaaagccgccagtttggtacgggttttgattaaaacctgctgctggatgtcgaattcttcgcgcgtaaccagatccatacggttgaacgcgccgcccagcatcgccttaatatttttttccacatctttggcagggctgttggcgatggtttcgctgattttcgagccgacttcctcaaaaagctgcttgccgaacataatctgtatccttcctgaacatatcaaattcaatcggctattgtataaggaaaaatgccgtctgaaaacgggcggcggataatcggcaaaacataccgcgcctcctttgcggttgctaaattacacctcaaaacaccccgcctgaaaacggatttcatattccgcgcaacgcccgattacaagacactacaaaacaatatgctgttttaaatgatttttccgacgcgcatcgtttcaaactcggctttttaagccattaagtgctttgcaaacaacagaaattgggttatcctgaaacggattatttacaatttcatatagttttattacatatcttattgtgattgaagataatttatccgaatccccctttcgggtatccggattttccgttgtacttttattagaaaaacatttcaggcgcaagttgcttgcaatttcaaagccg

SEQ ID NO: 28 - DNA, 13786 bp, Neisseria meningitidis
gagtctgtcaatgaaaacgtcgtgcgcggacaatataccgccgccagaggcatgaacggctatcttgaagaaatcaacgttccgcaagacagctttaccgaaacctacgtcgccattaaagccgaaatcgaaaacgaacgctggaagggcgttcccttctacctgcgtaccggcaaacgcatggcgggcaaagtggcggaaatcgttttgaacttcaaagatttgaacagccatatttttgaaggcagccgcaccgcgcccaaccggctcgttatcgagttgcaaccatatgaatccgtgcgcctctatacgcagatgaaaaccccgggggcaggaaataaggtcgaaaccgtgccgctggcaaccgatttgggcaaagcattggaaggccgccgcgcggaagcttacgagcgcctgctgctggatgtgattaacggcaaactcgctttgtttaaccgccgcgacgaacttgaagccgcgtgggaatatgtgatgccgattttggaaaactggacaaataacaccacgccgccgcacggctacggcgcacactcgtgggggcctgaagccgcgcgcgaactattggcgcgcgacggacacaagtggcacgaagagcagtaatacaataatgcgttcagacggcatggggtttgaaatgccgtctgaacataagtaaagtagtatagtggattaacaaaaatcaggacaaggcgacgaagccgcagacagtacaaatagtacggcaaggcgaggcaacgctgtactggtttaaatttaatccactataaaaagcagtcccgatatttggtatcaaaagcataaacaactgttcggccgacatattgctcaacccgtttccataacggaatatgccgtctgaaataaaaaaaggacacaaatatgtttgtttggcacgaatacgaaaatgcggcagaagcggcgcagtctttggctgacgcagtggcggatgctttgcagggcgcactggacgagaagggcggtgcggtgttggcagtttccggcggacgttcgccgattgcatttttcaacgccctgtcgcaaaaagatttggattggaaaaacgtcggcatcaccttggcagatgaacgcatcgtgccgaccgtccacgccgacagcaataccggtttggtgcgcgaatacctgttgaagaacaaagcggaagcggcaatgtggattcctatggtggaagacggaaaaactgaaaccgaattacatcccgatgctgttgtcgattatgcactgaaacattacaaacagcccgatgttttggttttgggtatgggaaacgacgggcatacggcttcgattttcccgaaagctccgcagtttcagacggcaatcgacggttcggcaggtgtcgcgttggtgcataccacgcccgttaccgcgccgcacgagcgcgtcagtatgaccttggatgcgattgcccatacggggcatgtgtttttggcgatacggggcgaagagaaaaaagccgtgttcgaccaagccgcacaaggcgaaaaccgcgaatatccgatcaacctcgttttgaaccatcaaggagtgaactgccatgtcttctacgccgaataaacaagccggatatccccgactggtcgccgatatcggcgggacgaatgcacgctttgcgctggaaaccgcgccgcgcgtcattgaaaaagccgccgtgcttccgtgtaaagactacgatacggttaccgatgcggtgcgtgcctatctgaatcaaagcggtgcaacagccgtacggcacgcggcatttgccatcgccaacccgattttgggcgactgggtgcagatgaccaaccaccattgggcgttttccatcgaaaccacccgtcagactttggggctggacaccctcatccttttgaacgactttaccgcgcaggcattggcggtaacgcagacttcaagcaaagacctgatgcaggtaggcgggcaaaagcctgtcgaatttgcccccaaagccgttatcggccccggtaccggcctgggcgtgagcggattggtgcacagccacgcaggctgggtggctttggcgggcgagggcgggcataccagtttcccgccgtttgacgatatggaagtgctgatttggcagtacgccaaaaacaaatacggccatgtttccgccgaacgctttttgagcggcgcgggcttgagcttggtttacgaggctttggctgcaaaacagaaagccaaacccgccaaactgatgccgtctgaaatcacggaaaaggctttgagcggcgcgtcgcctttgtgccgtcagactttggacatcttctgcgccatgctcggcacggttgcttccaacctcgccctgacgctgggcgcgcgcggcggcgtgtacctgtgtggcggcattattccccgcgtgttggaatatttcaaaacttccccgttccgcagccgtttcgagaacaagggcaggtttgaagcatatcttgccgcgattcccgtgtatgtcgtcttgagcgagtttcccggaatttccggtgcggctgcggctcttgacaaccatttgagaaacgtttaaccacagcggctccttgcagcggggctgcattatcgaagggcatatcattatgttaagcaaaatcagcgaatcactggcaaacctttccggtgcggaacgcaaagtcgccgaatgtgcattggcggaacccaaatggttcgtccatgccgccgttgccgaaattgccgaacgtgcgtccgtcagccagccgaccgtcatccgattctgccgcagcttgggttataaagggctgcccgagttcaagctcgccttgtccgccagcatcggtcatgagggtatgccctatgtccacgaagaactcaacgccgacgacgatatggcaagcgtggtcgagaaagtgttgggcaatgccgccgcctcgctgttgggcgaacgccgcttcctgaaagagtcggagctggaaaacgccattgccacgctgatgcacgcccgtcgcgtcgagttttacggtgtcggcaattccggcattgtggcacaggacgcgcagcataaatttttccgtttcggcatgtccaccgtcgcctatgtcgatacgcacacgcagctgatggcggcatctgttttgagcgatcaggatgttttggttgccatttccaacacgggttcgtctatcgaacttttggatgcggtcagcatcgccaaagaaaacggcgcgtctgtcatcgcactgacccgcaacgattcgcctctggcgcaacttgccgactgcgtgttgagcgttgccacacaggaaaatgccgaactctacacgcccatggtttcccgcctcttgcagcttgccgtcatcgacattctcgccatcggacttgccctgcgcttgggcgatgctgccagcctgcaattgcagaaaagcaaaaaaagcatacacaacaagcacatcgattacgacaaagattgaccttcagacggcatcccacaaatgccgtctgaaatgccgaacaacggtcgtcggcggcttgcggcagtttccggcagccttttcatcccacaacaaaaaacctcattcaggagcatatagatgaaacaccttcacgacttacccgcatggtcgaaattgtggaatcactttgacgacagcaaaacattgcatatgcgcgaaatgttcgagcaagacccgcagcgtgcggaacgctactggctgcaagtcggcggactgacgctggactactccaaaaaccgcatcaacgacgaaaccatgtcgcttttgttcgagcttgcccgagaagcaggcgtgccggagcggatgcggcagatgttccacggcgaaaaaatcaataccaccgaaaaccgcgccgtcctgcatgtcgcccttcgcaaccgcaccaattcgccgattgtggttgacggtgaagatgtgatgcccaaagtcaaccgcgttttgcaacgtatgggcgaatttgcacacgaagtccgcagcggaagctggctgggctataccaaccaagtcattaccgacgttgtcaacatcggcatcggcggatcggatttgggtccgctgatgatgtgtaccgcgctcaaacctttcggtcatccgcgcctcaatatgcacttcgtctccaacgtggacggctcgcaactgcgcgacgtattgtccaaagtccaccccgaaaccacgttgttcatcatcgcctccaaaacatttaccacgcaggaaacgctgaccaacgcgctgaccgcgcgcgaatggtttttgaatcatgcgggcgacgaagaagccgttgccaaacacttcgccgccgtttccaccaatcaaaaagccgtcgccgaattcggcatcgacaccgccaatatgtttgaattttgggattgggtcggcggtcggtacagcctgtggtccgccatcggattgccgattatgctgtatctcggcgaagaaaacttcattgaaatgctcaacggcgcgcacctgatggaccaacacttcatcaacacaccgctcgagcgcaacctgcccgtcattctcgccctcatcggcatctggtatatcaactactacggcggcggcagccacgtcatcgcgccttacgaccaacatttgcaccgcctgcccaaattcatccagcagctcgatatggaaagtaacggcaaacaggttacgttggacggcaaagcagtcggacacgaaacctcgccgattatctggggcgaaacgggcattaacggccagcacgcctttttccaactgctgcaccaaggcacgcacattacccccatcgacctgattgcctcgcttgaaaaacgcagcaacctgcccggacaccacgaaatcctgcttgccaacgtcttcgcccaagcagaagcctttatgcgcggcaaaacccccgacgaagtccgcgccgaactcaaagcgcagggtatggatgaggtgcgcatcgaagagctggtcccgcacaaaaccttctccggcaaccgcccgaccaacctcattctcatggacaaggtcaacccgcgcaatatgggcagcctgattgccatgtacgaacacaaaaccttcgtacaaggcatcatttggggcatcaacagcttcgaccagtggggcgtggaactcggcaaacaactggctaaaaccattttgggcgaactgaccggcgaaaccgggccgcaaaagcacgacagttcgaccgaacgcctgatcaacctctacctgcagaccaaccgcaaataaaacctgcggaaaaatgccgtctgaacgccgaccgtttcaaacggcatttttatcgaacaggaaaaccgtcggtaaacttgcagagcgtgtgcaatcccgatatgatggtttgcataaatttaaacatatatgttccgcagctatggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggccagggaagcggacaagaaagaactgtcaaagcggctctgaacagcgcggttcaggcactgcccgccgatattgccgaaaccgtcatgcccgagtaccgcaactgacaaaacggtttgaatgccaaatgcgccgacggcgacgaatacggcgtggcacaatctgactgccgtaccagagaaatcaatgcgaaaaccaaagaaatccaaggttatctgattgactgaaacttggatgcgggaatgtcggcggcttttgcgtttttgtcgtttttatagtgaattaaatttaaaccgatacagcgttggctcgccttagctcaaagagaacgattctctaaggtgctgaagcaccaagtgaatcggttccgtactatttgtactgtctgcggcttcgtcgccttgtcctgatttttgttaatccactatatctttttccacttatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttgatgttttaggctgcctgtttgttttttaaggcgaatccacaggtaaagcgtgtttcttgacaagttaaacgttgctgcggtttggctgatgtttttgcattgttcgtaatatagtggattaaatttaaaccagtacggtgttgcctcgccttgccgtactatttgtactgtctgcggcttcgtcgccttgtcctgatttaaatttaatccactatagtttaaagctttgtttcttaagtccgcagagtatgccatggttagaccttcaaagttgaatattgtactattttgtttttggggctgtcctagataactaggataaactcgattttactaattgttttaaaatggaaatttgaacttttatctcactgttgttaaaacgccgttcgtacccctttaaatacagctcaaaatgcgctttgggaatgccgtcaaacttgcgtaaatgacgttttgcccggttccaaaagttctcaattccattgatatggttttgtcgttcagcaaaataactttcatctgcttctacttcgccatcaaacatttccaaatgcggactgttttgataaataagtaatcgtaaacgatgaaaataataggctgcggtacttttattaacgcctactaactctgctgtcgttcttgcagttacacctgcgacaaacagttcaatgagtttatttgtttataccggcttagacgactttttctcataggggcaactctaacttaatttgaatttccctagttatctaggacagccccttgtttttaattgactataatccgctatattgtgagaagctggatgacggatgagggataaaataaatgccgtctgaatcttcagacggcatcgggagatgattttcagttctcgacttccggttcggttacattggaaattacagaagcgtcggagagttcggattcgtcttcggcaacacgttccagcgataccaaggtttcgccttcgtccaagttaatcagtttcacgcctgctgcggcgcggccggtttcgcggatttgttcgactttggtgcggataagtacgccgccgctggtaatcagcatcaaatcgtcggtttcgccgaccaaggttgcggcgaccaaatcgccgtttcgctcgccagtgttaatggcaatattgccttgcccgcctttgtttttgcggctgtaatcggcaatcggggtgcgttttccgtatccgttggcggtggcggttaaaacttgcaaaccgctttcttcggtttcaggggcgaaggtaatcaggctgacgattttgccgtcggcaggcaggcgcataccgcgcaaaccgccgctgccgcgaccggacgggcgaacaccgtgtttgccgctcggcagtgcgttttcgctgtcggcggtttcatcttcgatgccgtctgaaatttcggtttcgatgtcggcatcttccgcttcgtcgttgccggatttttcccagtattcgttgaagcggatggctttacctaagttggagaacagcatgatgtcgtccgcaccgcctgtttgcgcagcgccgacgaggtagtcgccttctttgagcgcgatggctttaatgccttgggcgcggacgtttttaaaggcggaaagttggacttttttcaccattccctgcgcggtggcgaagaagacgtattggtcttcggggaactcgcgtactgccagaatcgcgctgactttttcgccttcttccaactggatgacgttgttaatcggacggccgcggctgttgcgtccgccttcgggcagtttgtaaaccttaatccaatgacacttgcccaaattggtaaagcacatcaaataatcatgcgtgttggcaacaaacagggtttcgataaagtcttcgtctttggtggcagccgcctgtttgccgcgcccgccgcgacgctgcgcctgatagtcggtggtcggctgggttttgatatagccgccatgtgtcagggtaacgaccatttcgcgttgcggaatcaggtcttcatcggcaatgtcgccgccgaacgggttgatttcgctgcggcgttcgtcgccatagttggttttgatttcttccagttcgtcgcggatgatttgggtaatgcgttcgggtttggagaggatatccacaaagtcgatgattttacccatcaggtttttgtagctttcgacaatttcttcttgatcgaggccggtcaggtttcgcaggctcatgcgtaaaatagcatctgcctgaatctcgctcaggtaataaccttgctctttcaagccgatgtttgcagccaatccttccggacgcatcatttccaaatccagaccggaacgcgtcagcatttcttcaacgaggctgctgcgccaagggcgcgcaagcagtttgtctttggcctcggctgcgttgggcgattctttgatgagcttgatgatttcatcgatattggacagtgcgacggctttgccttcggcaatatgcccttcatggcgtgccttcttcagccggaaaagcgtacgtcgggtaacgacttcgcggcggtggcgcaggaattcggagagaatctgtttcaggttcaacaggcgcggttgtccgtcgaccaaaaccaccatattgatgccgaaactgtcttgcagcggagtcagtttgtagagttggtttaagacgacttcggcattttcgttgcgtttcagctcgataacgacgcgcataccggatttgtcggattcgtcgcggagctcggaaatgccttccagtgttttttcccgaaccaaatcgccgattttctcgaccagcttggctttgttgacctgataggggatttcgtcgataacgatggcttcgcgttcgccgtttctgcctatgggttcgatatgggtcttaccgcgcataacgacgcggccgcggcctgttttatagccttcgcgcacgccgctcaagccgtagatggttgccccggtcgggaagtcgggggcttggataatgtcgatcagttcgtcgatttcggtgtcgggtgcatcgagcaggcgcaggcaggcattgacggtatcagaaaggttgtgcggcgggatattggtcgccatgccgacggcgatgccggacgagccgttgacgagcagtgtggggaaacgggtcggcagtacaagcggctcgtgttcgctaccgtcgtagttcgggccgaaattgacggtttcttcctcaatgtctgccagcatttcgtgggaaattttcgccatgcggatttcggtgtagcgcatggctgcggcggcaagcccgtccaccgatccgaagttgccctgtccgtctatcagcacataacgcatagcgaaattttgcgccatacggacgatggtgtcgtatacggcggtatcgccgtgggggtggtatttaccgatgacgtcgccgacaatgcgcgccgattttttgtaggcggcattccagttgtttttcagctcgtgcatcgcgtacagtacgcggcggtgtaccggcttgagaccgtcgcgaacgtccggcagcgcgcgcccgacaatgacgctcatggcgtagtcgagatagcttttgcgcatttcgtcttcaaggcttaccggcagggtttcgagggcgaatttgtggtcgtggcggatggttgcgtcggtcatggtttcaatgtttcgtatggcaaaaaattgttgcttattttagcatattttgacgcggaacggtgcggcggttacgccgtctgaaacacggtgcggattataatgccgaggaaatttcgttgcggagtttgtcgagaaacctgccttggcggacttgttgtgcggctgtgtcgtaatcttgtcgggcaaacgactgtttcagaccgcagaacagtttttcttgttcgtcgcggatttcgttgtcgagatttttcaaggattcaaggtcgttgcctgcccgtgcctccatcagcgtttcgcgccattccatttgctgcataaggaattcgggggcgaaagcggtatgctccggcgcgtcggcatcgatgcccgatgttttcagcaggtaggcggcgcggtcgatggggtttttcaaggtgcggtaggcatcgttgatggtggaagacatcatcactgcctgcttttgctcaaaggcggaagctgaagcgaatttatcgggatggaaacgggcggccaaggcgcggtaggtttgttccaagttttcggtgtcgatatcgaaagcgggttcaatccggaagagggtgaaatattgggacatagtaggatgataaatgtaagattttggcagaaaactgtttttgccttataatctgccgcttcttaaacgaaaggactgaatatgggcggcaaagtgcagcacaataaaggcaaaatacgcgacaatgctttaaaagccttagtgaaatccgatttgttccggcacaaggtggaacggaaaaggaaaggcaaaggcagctacaacaggcaggaagcgaaaaaatggcgggacggttttgatacggtcccgccgtttttatgccttaaacgtggaagctttcgccgcagccgcaggagtctttgacattggggttttcaaatttgaaaccttcctgcaaaccttctttggtgtaatcgacttgcgtgccatccagataaaccaggcttttcggatcgatataaatgcgcgcgccgtgtccttcgaaaatcaggtcgtcgccatcggcttcgtcgacaaattcaaggttgtacgccatccccgagcagccgctggttttcacacccaagcgtacgcccaagcctttgccgcgtttggcgagatagtcattgatgtgttttgcggcattctcggtaagggtaatcatatttcttccttgttgtaccgccccggacggacctgaagcggcgggtggttcggacggcattgcgggatgatgccgtctgaagggctttatctgttttcctgacgtttgcggtagtcggcaacggccgcttttaccgcatcttcagccaagatggagcagtggatttttaccggcggcaattccaactcctcggcgatttcgctgtttttgattgccagcgcgtcatccaggcttttgcctttaacccactcggtaatcaggctggacgaagcgatggccgagccgcagccgtaagttttaaatttcgcatcttcgatgatgccctcgtcgttcactttgatttgcaggcgcatgacgtcgccgcaggcgggcgcgccgaccatgccggtgccgacggaatcgtctcccttgtcgaatgtgccgacgttgcgcggattttcatagtggtcgattactttatcgctgtatgccatgatgtggtttccttaatgttttttgatggtttaagtggtttgtttgccgattttcagacggcctgaagtttagattttgcacgccccgccttcgcagccgtcgtcgttttccgaatcgacgccgccttccacggtaacgccgtcaaaatcttcaagcaggttgtcgagattgtccaaatctaaatcttgttcgttcatattttctcttgattgctttgtttttggaatgccgtctaaaggttcggacggcatgttggtacgctttaatgcgctgcccattcaatcgagttcaaatcaatcccgtctttgaacatttcccacagcggcgacagttcgcgcagtttgccgattttggatttaatcagttcggcggcgaattgcacttcttcttcggtggtcatgcgaccgaaggtgatgcgcagggatgagtgcgccagttcatcgttgcggccgagcgcgcgcaggacgtagctgggttcgagcgaggcggaggtgcaggcggagccgctggatacggcgagttctttcactgccataatcaggctttcgccttcgacgaagttgaagctgacgtttaggttgttcgggacgcgatgttcgaggtcgccgttgatatagacttcttcgatgccttcgatacctttgaggaaaatatcgcgcagtttcaggtagtgtgcagtgtcttgtgccaattcttctttggcaatgcggaaggcttcacccatgccgacgatttgatgggtcggcaatgtgccggaacggaaaccgcgttcgtgaccgccgccgtgcatttgggcttcgaggcggacgcgtggtttacggcgtacatacagggcgccgatgcctttagggccgtatactttgtggccggacatagacagcaaatcaacttttgcggcttcaacatcaacaggcactttgccgcatgcttgtgctgcgtcaacgtggaaaatgattttgcgttcgcggcagatttcgccgatggcaggaatatcttgaaccacgccgatttcgttgtttacccacattacggaaacgaggatggtgtcttcgcggatggcggctttcagtacgtctaaatcaaccaaaccgttttcttgtacgtccagataagttacttcgtaaccttggcgttcgagttcgcgcatggtgtcgagtacggctttgtgttcggtttttacagtgatgaggtgattacctttagatttgtagaagtgcgccgcgcctttgatagcgaggttgttggactcggttgcgccgctggtgaaaacgatttctttagagtcggcgttaatcagggcggcaatgtctgcacgtgctttttctacagcttcttctgcttcccagccgaagctgtggctgttggaggctgggttgccgaaggtttcggtcagatagggaatcattttttcggcaacgcgtttgtcaacggggggggtggcggcgtagtcgaggtaaacgggggttttgacggtcatggtttgctctttctttttcgggtgttatttaatggatgtgtgtaaattggacgacgcggctgccgtcgccgttgtttttctgttcgatgatgctttgcagggtaacgctgccgaggtagtcgttgatggttttgtttaaattctcccaaagatcgtgcgtcaggcagggcgcgccgtggtggcagttggctttgctgccgcattgggttgcgtccagccggtcttcggcggcggcgatgatttgggcgatgttgatgcgtgccgccggtgcggcgaggatgtagccgccgccgggcccgcgcaggctttcaacaagtccggcgcggcggagtttgccgaacaattgctcgagataggagagggatatgttttggcgttcgctgatggcactgagtttgacggcgccggtttgcgcgttcatcgccaaatccagcatagcggtaacggcgaaacgccctttggtggtcagtctcatggtggtggttgcccatgtcggtttttttagg

SEQ ID NO: 29 - DNA, 34827 bp, Neisseria meningitidis
gaagactttgattctttttttcagcatatgaaggaatatcaatatgctattgacaatgaagacattaaatctgcatgtagttcactatgtgaagctatgctctatgttggtaatattaaaaatttttttgagtttctcaaaagcgatatgattagactgttgagaggtgaaagtaaaacaacagactttcaatggccgcaatttgatgaatagcagcaagctgtagcctgcatgaaacctaaaatccatgcgtaaggtgtgtgcttcagcacgcacgcgttccatgatttacggctcaatgccgtctgaaaagctcacaatttttcagacggcatttgttatgcaagtaaatattcagattccctatatactgcccagatgcgtgcgtgctgaagacaccccctacgcttgctatttgaaacagctccaagtcaccaaagacgtcaactggaaccaggtacaactggcgtacgacaaatgggactataaacaggaaggcttaaccggagccggagcagcgattattgcgctggctgttaccgtggttactgcgggcgcgggagccggagccgcactgggcttaaacggcgcggccgcagcggcaaccgatgccgcattcgcctcgctggccagccaggcttccgtatcgctcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaagcagccagtaaaatcaaacagttggatcagcactacattacccacaagattgcccatgccatagcgggctgtgcggctgcggcggcgaataagggcaagtgtcaggatggcgcgataggagcggcggtcggtgaaatcctcggcgaagccctgctggacggcagagacccgggcagcctgaatgtgaaagaccgggcaaaaatcattgctaaggcgaagctggcagcagggacggttgcggcgttgagtaagggggatgtgaatgctgcggcgaatgcggctgctgtggcggtagagagtaatgcgcttagcaaggaaagaatggataaattgacaaaatgcctttccggtaaaacttgttctactacgatggaaaaagtaaatgccatcaaaaaggatgaacaatttagcaaagtaattgatacggaaattcaaaaagtctgttctaggaacccattgggcgatggttgcagaaacggcattaatatgtctattaaatatattgccatgcctgctgcgtggaagtatatgcctacggatgtatcacgggttgccaaagaagtttttggctatttatataactcacaaggggcatctacaagatttgacaagtatttcaacaccattgacaatcgtgcagatttctttgctgccagcaatctttatgagcaaaatttgggttcaaaagcacgatggtttggtggagctgattttgtatcgcgtgctgctataactgggttaggggcagacggagaagcttcttatataacttttgcggcaggtaaagttgttggtaatcctccaatttatgaatggagggctgcgtcaggcaatgcactgatagtaaatggattttataattttagagacttgttcaataaaaaaactaatcctagggagtgggatattcaacagttgaaaagcgagcaaaagttattacagcctattcaccaaaaatatttgagtaatgagaaggattatttgtcattgattaaaggggtaacatcaaataagatattttcaataattccaaatcctttagatgagaggaaaaaaatagaggatggaattaatatgttagattacaaatctagaattaaatatggttgtaagcttatgggatattctgagaaacagggatgcaagccatgaataaaaattatttattttatcttattcaaaatattaaatctattttcttaataggtggagtattttttggccttttaattttttcaggtttatggggtaatgattttaaactatcttttttaggggtaatagattttatatttgggatggtagggggtgggtttatagttatgttatggtttctaattccagtgatattatcaactttattcagatgggtatttcaaaatcaacttgctgtatctgtcatattaaccttcattgttttttatacatatgggtacttttctttatttaattcatctgaaagagtcggtagtttttggtatttggtaatcccaaccataatgtttattggactgtctgaatggtttatctataaatctagcgtgcatagtttaggtgaaaatgtaactccacgttccaattgaagaaaaagattgtctgaaaactaaatttaatttcagatgaccttagattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatccggtggtgtttgcacaggtaggcgcatacttgttcgggactgagtttgcggcggataagggtgtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccaccgtccaaaatgctctttgggaatgctattggattatagaccttacaacagaaaaaaaggtcggaaagtagaaagactgctttttaaattcaaacggccaagcaagtaaagacttggccaacaaatgggacaaaatccgactgttttaaattgccagtcaaatactggaaaacttgcgtaaatggctaaattcactgacatcaagtacatcataactacgaaaggtatccgtatacacaatgccatcagacttaactttctctcggataatcggcaataatgttgctgattgcgcattagggacaacgacggtataaaccttgccatttcgttcgaatgggatttttaaccgttatctagtaaagtccctaatttaataaacaaatggcagtaaaatggcggtaattgactcgccaaaatccttgatctagaatggtcagactatccaattttttctaataactctataaaaatcaaataactgaaatcatgaataaaactctctatcgtgtaattttcaaccgcaaacgtggggctgtggtagccgttgctgaaactaccaagcgcgaaggtaaaagctgtgccgatagtgattcaggcagcgctcatgtgaaatctgttccttttggtactactcatgcacctgtttgtcgttcaaatatcttttctttttctttattgggcttttctttatgtttggctgtaggtacggccaatattgcttttgctgatggcattattgctgataaagctgctcctaaaactcaacaagccacgattctgcaaacaggtaacggcataccgcaagtcaatattcaaacccctacttcggcaggggtttctgttaatcaatacgcccagtttgatgtgggtaatcgcggggcgattttaaacaacagccgcagcaacacccaaacacagctaggcggttggattcaaggtaatccttggttggcaaggggcgaagcacgtgtggttgtaaaccaaatcaacagcagccattcttcacaaatgaatggctatattgaagtgggcggacgacgtgcagaagtcgttattgccaatccggcagggattgcagtcaatggtggtggttttatcaatgcttcccgtgccactttgacgacaggccaaccgcaatatcaagcaggagaccttagcggctttaagataaggcaaggcaatgttgtaatcgccggacacggtttggatgcccgtgataccgatttcacacgtattctcagttatcattccaaaattgatgcacccgtatggggacaagatgttcgtgtcgtcgcgggacaaaacgatgtggtcgcaacaggtaatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggccgagcaagcaggcattcgtaatcaagggcagttgtttgcttcttccggtaatgtggcgattgatgcaaatggccgtttagtcaatagtggcacgatggctgccgccaatgcgaaagatacggataatacagcggaacacaaagtcaatatccgcagtcagggcgttgaaaacagcggtacggcggtatcgcaacaaggcactcaaattcacagtcagtcgattcaaaacactggcacattattgtcctcaggcgaaatattgattcacaattcgggcagcctgaaaaatgaaacatcaggcaccattgaagccgctcgtttggctattgataccgacacacttaataatcaaggcaaactctctcaaacaggttcacaaaaactccatattgatgcacaaggcaaaatggataaccgtggccgcatgggtttacaagataccgcaccaaccgcgtcaaatggttcaagcaatcaaaccggcaatagttacaatgcatctttccattcatccactaccacaccaacaacggcaacaggtacgggtactgcaaccgtttctatatcaaacataactgcgcctacctttgctgatgggacaattcgcactcatggtgcactggataattcaggcagtattattgccaatggtcaaacagatgttagtgcgcaacaaggtttaaataatgcaggacaaatagacattcatcagttaaatgcaaaaggttcggcgtttgacaatcacaatggaacaattatcagtgatgcggtccacattcaagccggcagcctgaataatcaaaatggcaacatcacaacacgccaacagttagagattgaaaccgatcaactggataacgctcatggcaagttattatcagcagaaatagcggatttagccgtttcaggcagcctgaacaatcaaaatggcgaaatagcgaccaatcaacaactgattattcacgatggtcagcaatctaccgctgtcattgataatacgaatggcacgatacaatcaggccgtgatgttgctattcaggcaaaatcgttatccaacaacggcacacttgccgctgataataaactggatattgcgttacaagatgatttttatgtagaacgcaatatcgtggcgggcaatgaattgtcgctcagtacacgaggcagcctgaaaaattcacatactttgcaagcaggaaaacgcattcggattaaagcaaataaccttgataatgcagcacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgtgaaaacctgaatttaggcatcggacaattaaacaaccgtgaaaacagtctgatttacagcggtaacgatatggcggttggcggcgcattagataccaatggccaagccacaggcaaagcccaaaggatacacaatgccggcgcaaccattgaagctgcaggcaaaatgcgtttaggtgtagaaaagctgcacaataccaatgagcatttgaaaacgcagttggtagaaacagggcgcgagcatattgttgattacgaagcatttggacgacacgaattattgcgagaaggcacgcaacatgaattaggctggtctgtctataacgatgaatcagaccacttacgcacccctgatggagcggcgcatgaaaattggcataaatacgattatgaaaaagtcacccaaaaaacccaagttacccaaactgcgccagccaaaatcatttcaggtaatgatttaaccattgatggtaaagaagtatttaataccgatagccaaatcattgctggtggcaatctcattgtacaaacagaaaaagacggtttgcataacgagcaaacctttggcgaaaagaaagtattcagtgaaaatggcaaattacacagctattggcgtgagaaacataaaggacgagactcaacgggacatagcgaacaaaattacactttgccggaggaaatcacacgcaacatttcactgggttcatttgcctatgaatcgcatcgcaaagcattaagccatcatgcgcccagccaaggcactgagttgccgcaaagcaacggtatttcgctaccctatacgtccaattcttttaccccattacccagcagcagcttatacattatcaatcctgtcaataaaggctatcttgttgaaaccgatccacgctttgccaactaccgtcaatggttgggtagtgactatatgctggacagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagtagcgcaactgaccagcgatattgtttggttggtacaaaaagaagttaagcttcctgatggcggcacacaaaccgtattggtgccacaggtttatgtacgcgttaaaaatggcgacatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcatgctttctgccgaacagacattattgctcaacgcaggcaacaacatcaacagccaaagcaccaccgccagcagtcaaaatacacaaggcagcagcacctacctagaccgaatggcaggtatttatatcacaggcaaagaaaaaggtgttttagcagcgcaggcaggaaaagacatcaacatcattgccggtcaaatcagcaatcaatcagagcaagggcaaacccggctgcaagcagggcgcgacattaacctagatacggtacaaaccagcaaacatcaagcaacccattttgatgccgataaccatgttattcgcggttcaacgaacgaagtcggcagcagcattcaaacaaaaggcgatgttaccctattgtcagggaataacctcaatgccaaagctgccgaagtcagcagcgcaaacggtacactcgctgtgtctgccaaaaatgacatcaacatcagcgcaggcatcaacacgacccatgttgatgatgcgtccaaacacacaggcagaagcggtggtggcaataaattagtcattaccgataaagcccaaagtcatcacgaaaccgcccaaagcagcacctttgaaggcaagcaagttgtattgcaggcaggaaacgatgccaacatccttggcagcaatgttatttccgataatggcacccagattcaagcaggcaatcatgttcgcattggtacaacccaaactcaaagccaaagcgaaacctatcatcaaacccagaaatcaggattgatgagtgcaggtatcggcttcactattggcagcaagacaaacacacaagaaaaccaatcccaaagcaacgaacatacaggcagtaccgtaggcagcttgaaaggcgataccaccattgttgcaggcaaacactacgaacaaatcggcagtaccgtttccagcccggaaggcaacaataccatctatgcccaaagcatagacattcaagcggcacacaacaaattaaacagtaataccacccaaacctatgaacaaaaaggcctaacggtggcattcagttcgcccgttaccgatttggcacaacaagcgattgccgtagcacaaagcagcaaacaagtcggacaaagcaaaaacgaccgcgttaatgccatggcggctgccaatgcaggctggcaagcctatcaaacaggtaagagtgcacaaaacttagccaatggtacaaccaatgccaaacaagtcagcatctccataacctacggcgaacagcaaaaccgacaaaccacccaagttcaagccaatcaagcccaagcgagtcaaattcaagcaggtggtaaaaccacattaatcgccacaggcgcagcagaacaatccaatatcaacatcgcaggctcagatgttgccggcaaagcaggcacaatcctgattgccgataacgacatcacactccaatcagccgagcaaagcaataccgaacgcggccaaaacaaatcggcaggctggaacgcaggtgctgccgtatcattcggacaaggaggctggtcattaggcgttaccgcaggcggcaatgtcggcaaaggctacggcaatggcgacagcatcacccaccgccatagccatatcggcgacaaaggcagccaaacccttatccaaagcggtggcgacactaccatcaaaggcgcgcaagtacgcggcaaaggcgtacaagtcaatgccaaaaacctaagtattcaaagcgtacaagatagagaaacctatcaaagcaaacaacaaaacgccagtgcacaagttaccgtaggttatggcttcagtgccggtggcgattacagccaaagcaaaatccgagccgaccatgtttcagtaaccgagcaaagcggtatttatgccggagaagacggctatcaaatcaaggtcggaaaccatacagacctcaaaggcggcatcatcaccagtacccaaagcgcagaagacaagggtaaaaaccgctttcagacggccaccctcacccatagcgacatcaaaaaccacagccaatacaaaggcgaaagttttggattgggcgcaagtgcgtccataagcggcaaaacactgggacagggcgcacaaaataaacctcaaaacaaacacctgacaagcgtagccgataaaaacagcgcaagttcatcagtgggttatggcagcgacagcgacagtcaaagcagcatcacaaaaagcggcatcaacacccgcaacattcaaatcaccgacgaagccgcacaaatccggctgacaggcaaaacagcggcacaaaccaaagccgatattgatacaaacgtaaccacagacaccgccgaacgacattcgggcagcttgaagaacaccttcaacaaagaagcggtgcaaagtgaactggatttacaaagaaccgtcagccaagattttagtaaaaatgttcaacaagccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgcgccgacccaaagcggagcgggcatcgctgcggctaccgcatcgccagccgtatcgtatgcgattggacagcactttaaagatttagccggtcaaaacgcgaatggtaaactaaccgccagtcaagaaaccgcacacgttcttgcccacgcggtattaggagcagcggttgccgcagtaggagacaacaatgctctagcaggagcattgagtgcgggcgggtcggaagcggctgcgccttacatcagcaaatggttatacggcaaagaaaaaggaagcgacttaacggcggaagagaaagagactgtaacagcgattacaaatgtattgggtacggctacgggtgcggcagtcggcaacagcgcaacagatgcagcgcaaggcagcctgaatgcgcaaagtgcggtggagaataatgatactgtagagcaagtgaaatttgctcttaggcaccctagaattgctattgcaattggatctgtacataaagatcctggctctacattagagcctaatatttcaacaattgcttcaacttttcaattaaatttatttcctaatagtgaatttggtggtgaaggtggagttggcaatgcattcaggcacgttttatggcaagcaaccatcacacgagaatttggcaaagatattgctgttaaagtaggaaatagtcatgaaagtggggaaaaaattaattattctataagacgtaatctttcattagataaagcagatgaaatgattgatcaactaaataacgaaataggaagagaaatagcattaaataccaataggttaaacacaaaagagttagttggattaattctggaaacttataaaaataatggtttttatcaagcagaaagaaacagtaatggaaattatgatgttgtaagaaaaagattatctgaaaaagattaccagaatacaagcaatatattgattcacttagataatactggtgccggatttaaaattcagcagaggagaaaacaaatcagagcacaaatttcagccagacaatggagaagataaaagatgaataaaaatatactttatatattttctttattaatcactattgttattttctttatatttgaaaagaatgtaataagaaaaataagttttaattataataaaaaagaattcttaattagtgatataacgaattttaattgggattatgtaaaactgtatataatcaattcagatttccaaaaaattgttttttatcataaaagtaagatagtttttgaggaattaatagaactagataaggaagggaatgttttacctcaatatctatttgattcagatttgaaaaatgttgaatattacgaatgtgattacaagaatggcaagatgcaacttttaaaaaaagaaaaatcacatttttttgatggatatttttattattataaacctataaattgtaggccgaaacttttgtaaaactatccttcgtcattaccgcctaggattcaggattaggactcgtttggggagcagggagttctgatatggcttggagtatgtttgccacaacccaagccgatagagcggtaaggtctgcaactgcacctaaagaaatgtggttccataagaagataatagatgaaaaaacaggtaaagtatcctttgataccagacaaatttggtcattgaatgatttaagcaaggaagaactggcaagcattcaagacacaaatggcaaagttattactgtgtctaatcctggtattttcaataatcgagaagattcattaagcaacgcagcaaaacaaaatcgtaatagtacaaacggtagtggtgttattgcagtcatgaatcctccaacagggaaatataaatctgattctaataacaaaataaaagattttttatggctcggttcaagtcttgtttctgaactgatgtatgtcggttacgaccaattaaataataaagtgttccaaggctatttacccaaaaccaattcagaaaaactgaatcaagatatttatcgagaggttcaaaaaatgggtaacggctggtcggttgataccagtaatcacagtcgtgggggaattacagcaagcgtttccttaaaagattgggtaaacaatcaaaaacaaaatggcattgccccaatcagaaaagcacgtttctatggtacagccacaaatgtgcagaatgattacgccgatgttttacagaaaaacggctatacctatacgggtgcagacggcaaaacttataacagcggatcctactcaatcgtgcatgataaagattttgtggggaacaaatggatacctttcttgctaggaaccaatgacaccacacaaggtacatgtaaggggttgtgctattcgcatagcagttattttgcggaggtgccaaaagcaggtacaaaagaatttgatgactatgtaaaaatatggggtgaagttgaatatgacgctcaaggtaagccaattaacaaatctaaacccatactggtagaaccaaacaaaacaaaagataatgaaaaatatgaaaaagaagctttctaaatattctctgtttctttcatctgttttttgtctaacagcttgcgctactaccttattaggtactgtcgtagtcggtacagccttgtacggtactagtagtaactggacaactactgataaggaacaccaagaaattatgaattgccttgataaggcattagtaaaactgaatatctattttgagaatgatgaagaaaagtacaaaaacaaaacagtaatggatatttactatcagtgcattaaaaatcctaattatgttgtaacacacaataacttataaaggagagagatatgaagaaaaccctttctaatttagtgctaatatcattctgctcaacaatgctaacagcttgccctttttggggtagttgtgcagactggaattgctccaaacttaatccacgctgggagaaagccgttgacacatgtgaaactgaaaatctcacctttgttttgcatgaattaggcaatcaattaggatataaatctattaccgaagtctcatttagtgaaattgggcaacatatttcttatcagtgtattcaccatggcggtggatacaatattcgtaaagataagcagtatggtcatttgtttgtgcaataaccagcgtagcctgtgcaattaatgcgaactgttacatggtagggtgggcaactcgttgcccacgcagttcagtctcatgtgctaaaactatgttttaacgtgaaatatttcatttcaggctgaaaccattttttgttttaaccaacacgaaccctaacttaaaatatgcccatcactccacccttaaacatcatctctcctaaactctaccccaatgaacaatggaacgaaagcgaagcactcggtgccatcacttggctatggtatcagtcgcctacgcatcgccaagtacctattgtggagatgatgacgtatatattgcctgtgttaaaaaacgggcagttcgctttgttttgcaagggtacccaaccaatcggttatatctcatgggcttattttgatgaagtggcgcaggcgcattatttagaatctgaccgccatttgcgtgacaacagcgattggaactgtggcgacaatatttggctgattcaatggtttgcgccattgggacacagtcatcaaatgcgctcagctgtgcgccagttatttcctagtacgacagtacgcgccttgtatcataaagggagcgataagggtttgagaattttaacttttaaaacttgatgcaatcgtgtattgaatgcccattgatgattttattgattttgcgaccatgccatgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaagtggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggcaagcttcaattaaccctgataccgagctatctgcgctccatacgaatcgatcggtctaacgatgatcaaacccatgcaggacgtattgcagcattccagaacaaatttcccacccgctcgaacgatctgttgaatctgcgtgatttggaacaaggactggaaaatctcaaacgtctcccgactgcggaagccgatctccaaatcgttcccgtagagggagaaccaaaccaaagtgatgtcgtggtgcaatggcggcaacgtctgctgccctaccgtgtgagtgtggggatggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaaaacggcatagtcaaatcaacggtaactatagatatagcttttcataataaaacacctatcatgattatggtaagagatggctgtgttttgatattagattgacacaggaatttaagaaggaatcatgaaatacatgattccttctcgtttgcctacattaaacatataggccgccaactcaatcaatagagtgatttaccagttttccaatcttcccagtatatctcctaccgaatacgattcttctaatttctcggtttcaaacaccataagatgaagtgattttcagggtgaaagtagaccggccatctctgacagcggcagctaccggaatgtaaacggtagaccttcttcattttcatccgggataaaatgccacttctgcgccaaccattcattctcacgcaatacatccgagtatttaacaagaacctgttctttagcttgaacgattgtatctatcataaaggatgcatcttctcttcccaaatcgcaatatttctcagcaaaatccaacaatgtattcttggaaggatatgttttcttaccgtggttagtcaggtttaatgccagcgtatcgtcataagcatcaaaaattccttgtgttccaaccctgtatattgatgtatccaatacatcatagacaggtgcaagacgaacatcgtattcgtcatgatagagtactgaaaaatttttgaggtgtgcatcgccgtttttcaatatgcaactggcagcaagctgattaaagaaatggattaaatcttcatctggtctgccggatatctgtcggataatctgtgcaatagccgcataactgcctttatatttatcttctaccgaatactggcgcagactggtaaagtcttccatccctaaaaaataaccctgttcactgacatcaaaccgacgtaccaataagactgatgaatcttccgacaggctggtctgtgcaacggcaatgccggcttgtttgatggtctgcatgcataaaaattcattggcagccaagcaaggatattcggatgcatcaaaacctttggcaatatatgaggcagtttgcttggtatttctgcggatggcatctaaggacatcttctgctgtatcccggatacactgacgaaacggccgtgatggaagatttctgccatatattgctgaaaaacctgtcgggcatttatgcccagcaaatcccgttcagtcaatattcttggatttttcatctccaacccgtcaatccattcattaaaaagcgggtcattacagcgcacatgtatccgacccaaagtctctctgcacagaattgccaagcgcagcatctcattgtcttcaaaaggcgcatcatgaaaagcatatttgcttgtgatgtgtgcatccaaaaagccttccggaaaatactgtgcaaagatatgcggcatattgttgctgatatataccttgcttctgtcttgataatgcaggcccagcaacgaagaattgggattgtcgtatgcgaaccgatacatggcccccttttccaaagtaccgattctttcatcgtttgcccaaacatccaaataggtgattctgggtttacgcatacgatttccggatacggtgaggatagacttcatcatgaaaaattctttcaaacgggaacagcggtacgtttagacacatctgctgatttaattgtacatggcgtattgcggatgaaattcagtaataccgcttctcgtgccttttatctcgttcggttagcattacattattgggtttttgcgtttccatagctgtaaattctcccattcttgagtattcaagtgcggttcgatttggttaagtaagtcataaactgattgcttgtcttcatcgcttggaaaccaatcatctaaaatcacccgaccgattgagccagtttgtaacactgctgtgtaaagataatccacgcaagcacgggggtgatctgcgagccaaactgggatgttttcagggaaataacccattttgttcagtcgatccgtcccatcaataatgccattatcaccaaataaatgattggtatttcgctcttgattttcaccgtaaatataaaatttttcagggtaagcccgatcactcaatgcctttgcactatgccagtcgcctgtaccgttaggactatgcacgtttaaggctacaatactgctaacatatcgaacaggttccgttggggggtatatgtaacataaagattccttaaaatttagcagagcaaaagtggtttccacgttttaggacatattttacaggatagtcaccccaataatgtaaggctgtgttttagtaatctgttgatttcaattacttgcaagggaaaagacaattattttccggttaggaataaacctatcctgttgaataccttaaagccaaacacgcctatcaacatcatattaaaacacagccaataattaaaagtatcgaattttctaaccctgcttgcttggaaagcaaaattgctacaatcttggttaaatcagctacaaagatcatttgtagagcaaaaagcaagcagtccgcagcttctttttgaaggtgcggactgtattgattttgactcggttaaagctgcattctgggctagcaaactattttttttctaacctttccaataaatcctgaggagcaacatactctaaagcatttcctgatttgaacggcactaggaatctatattctcccagtttactcaaatcgctacgggcagtattcagggagatgccgtattggttggcaatttcttgtgcagtaaagatttttccgctttcttccactgctttttgcaggataccaatttgccgttggttcaactttcctatcttttcagtatattgggcaatcgctgctttgaattcctgttggtgtttttgtttgtcggaaatgtagtgctccaaatcggcaaccgcccgcttgataatatcgcattggtaatagatgaaataggttaaatctaaatcgtcagtttccgcatacaaataggatttggcgtattgggcaggagcgtttttcagaagacggctgatggatatgtattcaaatagccagtagccgtttttgagcataaaccaatagaacaaagcccgcgctgtccgcccgttgccatcaccaaatgggtggatgtagccgatgaggaaatgcaagataatagcttggacaaccggatggataaacggattttccacgccgtcataggtattattggcaaacgcacacacctcttccatcagcgtatgaacctgtccgtgcggcggtggttgatacaggctgttaccattgatatcggcgataaagatttcgtcatcctgcctgaattgtccgggctcggccttgttttcaatagcgttactggtagcaatgcggtgcaaatccaaaatcatttcaacacttaacggcgtatttttcaattctaccgcttttttcatcaagtgatagttgttcactatcatgatttcgtcttttgttttgggtttacgctgcgatttgagcatatccttggccactttacgcgtggtagccgcaccttccagttgggcggatgtaatcgcttcttccataatcagagacttgagcaagaatctgttttgctcgcttctgccgaagccacccaagctagacgtgccgatagaactgccgcagcttttgtcaatcaaatgaagccgtgcctgcaaagagtcgggaatgcagaaccaaaactgatgttcaaacgggaaatcaattggtttttggatttttttgcggctttccttaacggcgcgccatttcatccgcgtatcttccgtgtgaatccggcggaatttgtcccaatgcaggtaggttccattttcatctgtcacggaaaattctgaataatctttgatttcagtaagaaaatcgggaatgtctatatcaggattgtttgcggaagaattcagcagcttggcaatttgcgtcattctttcagtgagatgctgcatatattcctgttgcaacagggtaaattccggaggtctggaaattttcatgataaataccaaaatcgcgcaattttttataattgagctattctagtcaatttttatagaaatagaaagcattaaaatacgaatctgaaagaaacgatcaccttcataaatagggaaagattgtgtctactatattaaaaaaggctgtgttttaatatggtgttgataggcgtatttggctttaaggtattcaacaggataggtttattcctaaccggaaaataattgtcttttcccttgcaaataattgaaatcaatagattactaaaacacagcctaatgtaaaaacaaattggtacaaatggcgaagataacatttggctcaaacgtaccgagcggctacgcattgaatggtaaaatacctaccgcaaattgaaagctgcaagacgacagctctactatacgttcgcaaacagaattgccgaacaaagccggataatctgtatcaaaaaattgaatctgctcaacctacagtgcatacagattaaagtcaacaaactccaccagaagatagttgcctcatccctactgctgcatatgctgaaagaaggtgcagctaaaaatggagttcatatcgaagagattaaagccaatgctaccagccaatcatgttactcttgtggtcgcttgaacaaacggataggtgttgctgccacaagaaccaatatggtttgtgagagttttggtcggcattacgacactgatgaaaatgcctcctccaatattcgaaaatagggagctgaaaagctaggcacatagagtagcagttgaccgtaaaatcataaacgcttcggaataaaaagatgtagtgatcgcatccttgcattcctttttatgttttgttgctttagcagttttacagtttagcaactgtacattttggcatttttaacttttcatatacgaaccaacatttttaaatactgcaaatattttgtacaaaatatattcattatgcctttttgatttctcatcattaatatctcgtttatattaatattgcaaataatttaaacaaattttaggaaaggaaactaattgcggtaatatctaaaatccaaagaactgcttctttcttttttaccttcttgctggttttatgcttcaacagttgtacagttttactccatgcaaaccaaacaacaaaaaaagaccgacgaagaagtcttctgcttagaatttaaagaatactggagtaggggactcccgttttccgcgacatcatttccaaatagacacggggtacgctcagcatttcatctgaaccatatccatctttttccccagttttaaccttgtgaaacatccagtcctttttcaaatcttcagacagaaaagaaatactttcctgtttgattgacttgaagagaaccatcctaccatcactcttgtaagaaaaggcagtatctaatacctatcttctagagtcgatatactcccttgacgaaaaaaatgatgatattacggataccaaaactaaggtcgtatccgcccccccctactctccctaagcaaagagatgaaacagcgtatcgactccctgccggttgaattttccgaaaaaacgcgacgtaaccagcatcaacatatataagaacagcacaaatagcatcaatacatcaggcaacgaaaatgcagaataatgcacttaatggtgtttggatatctgttgttttgtgctgttagtaattcttctttctgtgtttacagtttagcagttgtacagttttatagtaatgtttaaacaatgactgatttattttaaatgcagatattgtagaggataaaaatggccaaagtcctttcagtaacatttttgattttttagcgagccttctcatttccccagcgagatcggcaatggcagcggtactttggccgccgatatgcttaagttcagtaaccttagtgcgtaaatccagtaaccttaagttacgtaaaccattagctggcagggtgtgagttcgatttgagcaagcattattttgtctcctgttgtacggtttcagacggcatcggtttgccacgtttgtaccaagtggcgcgggaaatgccgagactctcccacggtttatcgcagctgcaattttaaactcctaaaataagtttgccttttttgtactaattactgcttggatagtttagattagacttaagtaaatttcgagtgagttgtttcacaccctacccgaagctctaaaacgcacagaaatcgccgcagcgcgccaaaaactgacagagctgcggcggatgttggtgagtaaaggaggttaatttaatttcaggttaggactttccaattcaaatttctgtttttccagaacctgattgatttgctcatcagacaatccagcttctgttagggatatacgaagttgttcaacacgttgaaggaaagcctgtttggcttgatacacaccatcagcgataaattgtgcgttcaaatcactttcaaggcggtaaaacttaatgtttgaaatacaggagtaaaaccaatcaaaccgagcggtcagttcctgaatggctattgttccgtgtgcttcactgatgccttcacggcctagataaacactgccctgaatgttctcaaatccatgtctagccaagatggttttaatatcggagtaggcattggtatagttatttccgtggtaattgtctttcaggcagttggtatccatatcaaaggtaatcaggtaacggctcattatttttctcctgttgcgtttcagacagcatcggtttcccgcgatagtaccaagtgcggcggctgataacgagcttttcccacggtttatcgcggctgatagtgttttcggcgaggtagtcggcacgtgtttgagaccaccagcgagtgattgtgctttcagctacaataattttgctgcttgccctatgtttaaaaatctatccatattggatagtttagattagacttaagtagatttcaagtgagctgtttaacccttagctagcaagggttttggtggcgtaaggttactgaacttaagcatatcggcggccaaagtaccgctgccattgccgatctcgccggggaaatgagaaggctcgctaaaaaatcaaaaatgttactgaaaggactttggccatttttatcctctacaatatctgcatttaaaataaatcagtcattgtttaaacattactgtaaaactgtacaactgctaaactgtaaacacagaaagaagaattactaacagcacaaaacaacagatatccaaacaccattaagtgcattattctgcattttcgttgcctgatgtattgatgctatttgtgctgttcttatatatgttgatgctggttacgtcgcgttttttcggaaaattcaaccggcagggagccgatacgctgtttcatctctttgcttagggagagtaggggggcggatacgaccttagttttggtatccgtaatatcatcatttttttcgtcaagggaatatacacggaggatgattcaaaaccggcaggcaaaaaaagaccgcttctgaactgcatcccaaaagttggacaccttaccgactttagggggtgcagttttttatggcaaaatattcagatgaattccgacttgccgtcgttcaatactatttggcagggaacagcagaccatctttctatttccgattcattggtacgcagatgggtgacaaaatacagattacacggagagagtggcatcaaacgtagaaagcatacgacaaaatattcggtcgaatacaaacttgaggcaatccgcctggtggcggggtagggaatgtcccaaaaagctgccgcagaccaactgaatttgcccgactgctccatcttgctgcaatggttgcgcctctaccatttgaatggtattaacggtttaaagcccaaaccctaaacccaaaggaagaaagcccgtgaaaaaacagcatccgccggaaacgaaaaagccgactatctgaaaaccaaggaagaactgcttgcggaattggcttgccttaaagcggaaatggctgccctaaaaaagctcgatgccttaatctatgggaaagaagtgcggtagaaagaacgcaactcgtcgcagggttaaggcaatgccatccgttgaactgctgttggtgattgtcggactgccacgcggcaccttctattaccaattggttgtccaatcggcagaagacaaatatgccgatttgaaacggcatatccatgatatttatcaaaagcagttgaaagacaacggtctggttcagagtatgtcccgcaagggaaactgcttggacaatgcggcaatggaaagtttcttcggaacgttgaaatcggaatgtttccatacgtgcaaatatgattccgttaccgaattggaagctgtactgcacgaatatatccgttactacaacaacgatagaatcaagttgaaattaaaaggactgagccctgttcagtacagaattcagtccctgaaagccgcttgattaaactgtccaacttttgggggtcagttaatatcggttccaccaatagtcgtcagggttgtagttgggggtctgcctgtatgcctatgccgataagctgagcacctttgagggtggtatccccgccgcttcggatggtggtttgtccggccgtactgccgacatgggtgtggcggtgggttgcttttgtctgattgctgtggtggcttgttgaaaaaaagatagtgtatttcacggtcaaataactttacatttcttgaagttgcaagaatgcgcaccccgactttttcgggatgtttgtttcgttttgaatggatttgatgttttaatttatactttattttcaataaattgaaaatcaccggcgaaagcccagtttaattttttatttatatctttccacttggaaatcttggccgttttgcaaaatcgtaaacgctattaccgccagtttccgcatgatggcaattaatatcaattttatatgcttccctttatttttcagacgccctacaaattcagggaaggcattacaacgatatgcaacaagtgcaggcatataaaggcttttccttatttccgaacttcctatttttgatattctgctttttccgttcacgcttgttcctgattgaaattttctagggtctaggcctagataagccgtgaactgtcttgcatttttaaattcatgtcttttataggttgatagcaatactgctgtcgcttgctcgcctatgcctgttattgttttcagccttttgcgtagattgttataacttggattgtctttgtagaactggagtaattgctttttgactatctgtatttgtgctgtcaggtttgaaatagttgtttgaatatgggatttgatatagtcgggtgcttcgtgttgtttagctttttctgttgcgcgttgctgtttcagatagtctaaatatcgggcgatttcctgtaattgcttctgttcttttgtcggcggtttccatgcttttaatttgtgctttcggtcttggcaatattgggctatcaactttgcgtcttgtgtatctgtttttgatcgttgtagttctgctatcgcatatccttttatctttcgtggattctctacggtaattgtatatcttgaataaagatattcggctaatgcttcgtaatatgtgcctgttgcttcgcacacgcaatggagcttatcgtttactttatgactttgtagccaatttattaattgttcaaatcctcctttgttgttctgaaacttcttttgataattttgaccgtctacaatcaaacagcaatctattgtgagctttgaaacgtctattcctaagtacatggtttaaccttattaattcgggctttttgccctagatagtgttcaaacttaagatgtacgaaagcccacgcttctatctttcttacaagctgtacgctttggccgtactttcgaagtcgtgggctttacttggtgtttcgtcaaacgccaagccctcaatgggctgatttactcattcagggcttgaagcttatcgcctttgccgtatctgattttattggggtcgcaggttttggtaaaggtttctgttgcgacccgaatgtctgattttttttgggcgtatctcagtctggaatcactccgttcgggggtttccggtattgaaaaacagttcataaaaaaggaaaagggggtattcataaagattgggtaaaaagcgcgcccaatctttacaaagcttcccccttttccttttttctgccctattttcctgcacctacaacccccgaacgaagcgattccagactgagacactttaaaaaaaacagccattctagcaattaacccccttcactcagctcaagccatcctgaggggtagggattgaactttctgctttacgactccgccgccaattccttcaaacggttttccgcgctcttcagttgtcgtacatgagattttgctacggctttccgcccattacgagaacttgcggcttgtccgctttcgcggactgttccacctgttccgtcctttgctgttcgtccttataaggattgaaaggcaacccgtttttcacatattctttacacattatctttgttatttctttcaagggtgttccttgatttgaatagcatgtgcaatctgattttccgccgtctatacatccggcgatttgctcaaaggtttttacttgtcggactgtgttataaataggcttgctttcgggcttttcgggtaaagtcggcacaaagtcttcaggtttcaaattgtctgaattttttaaaggcatttcctctgatgatgcaggctgctccgtcatcgtctgcacaacgctttctttttgcgcttcctgctcaatccggctgtctgtggctttgctgtaaactttaaaaatgccgtaacttttccagcctacaaaccctacaatcgcaatcaacgcccaaaccgcccaaggtacttttttcttgaacttttggtgctggcttgctgatttatagtatttaaaggcttctttcggcggtttccaacttgcgacttctacgccgcttacgcctgcgggattgtccaacgaggttacgcatttataccaataatactgtttcattccgattgccttgcgttcaaggtgtacatgctttgaaacaaggttgcggacgaatatatcaagttggctcgggtgctgcgtcatcaaaataacggtatgcccgtgatggcggagttctgtcagttcctgaatataaggcggaacgggacggcctgccgcgcgtaccggataagtgtagtgcgcttcgtcaacaatcagcactgcgccttccggtatgacatcacgaagcggggcggacatgatttgctcttccgtcagttcgtgggctttaaactgccgtttatccaatccgtcgatatggcagaaataaagcggtctgtctacctctgtgccgtcttccaatttcattttgaacaatccgtcttcgttgttcaaaatcatagagacgacgcgggaggttttgcctgtccccatgtttcctgtaaacagataaatcatgcttctacctcatcctggaaagacaaacgtcagttttttgaatgcgtgcataccaatgaagaacgagaatgcgccgaacaggtagcccaacccctgaccgaatcccgaaattaaaagaaggttcagtatgtcggaaggcatggaattgatcgcatttgacgtgtagtctttgaacttttccagcgcgatgagatacccggcataggttacaaatgtcagacctgttgcaaggattattctgacaatcagcattttcagaagtatgcctaaaagtggaatcagaccggcaagtaatggcatttatttccccttcaacgaaccgaaaacgacaaaagccgacataatgataaaggcgagcagtacggcaaaacggattttttcggcaaacacgcataacggctcatagcttgcctgatattgcctaccgaaaacatgaaaggttttcggctgcggacatacgccgttagacggtaaaaagttatgtgaagaccatgttttatcgtctataacctgcggtatgcttatatcgtgaaacatgccgtctgaaggtttgcccatctcctgacaggctaggatttccggaaaataatcgcacaaaagcccgccgtcttcgccttctttcctttctttgcgatgcctaccgtttgggcggtccggaacggcgggggaatcgggtcttgtgccgggctgtccgtccgtatcgggatttgcatcgggattcaaatcggggtcgggttcgggattggggctcgtgccggggttctcattggggttcgggttgtttgcggggttttcggcgggcgatacttcgggcagcggctgtgcgttcggtgcttccgcgcttccgggggtcaagtcgggacgcgggattacttgaacatccaccgtggtgttgccttgcgaatccctgccgaatgttgcgacaacctgaacgggattcccgttcctgtccgtgacgggacccatattcacttttgttccgggtgcgacttctactttttcggaataaccgggataaccggttgcctttatgtatttgtcgggattggcatcgactttcaacgataaaatctcttccagctttttggcatccatttcttctttgtattttgaattgcgaataagggaaaaatcagccccatttctgaaatcatcacctttattgaccaaacaatctccgccattccaattaaatgtgcaacgatttaaaacaaaattattccaatccaaagaacttaatttattcagttcttctttatgccaattccaaaacggacgtgccagcctatacatttggctttccatcaattctttgacttcggggaatctgctgtcatcggacataaggcgcataatcgaactgtcaacgccgtagcagccataggttctattaatacgtcttttgtcttcgtaccaaaggcaattactatattcgtagccttttacaaatttgtcggtttcggggtcgtattggtagccttgtgcctgtatgtcttctttgaaagtttcgtatacgtcatgggctaaaagggctgttccgacataaggaactgcccttgtgcttaatttcgcgcctaagcgggcaagtttgccgactcctgacaagacggcggcgcgggaaactgatgcagttactttaacggggactttttcaagagagcgtgcgcctgttgaactttctaatacattcaaattcaaacttttatcaaatttgtaattatattctgtatgaattcctcctccctcacctaaaactttgtatgccttaaatccattatcgttatatttttccgaaagtgcatacatcaatttcccatttttaatttctaaatctgctgaaaaagatttagcactcaaaagaaacagaaaagaaattattagaatccgaaacatcaatttttccattgccaataatgaaaaatgaatcatccttgaatttaatttcaaagcaagattcattaaaattaattctattaaaaaaattatgacatttatccattgagaaatttttcaatagaccagtttctttcaaataacaataaaacacataagaaagaggcctatcaggataagattctgacaatttatctaaatcagaatttgatatatagaaaaagtcacgttcatttttattcatggtttcaagcctcaaatgtctaattaaaagcctgattttgacaccataacttcatgcgctcaattcttaaacagaaccgccccgattaatacgggtacggaaacgccgagataaaaataaaaatccatcatttcaaaacctttttcagcagggaaacaaagtaaacggacgcgaggatgccgaatactatccagcctgtttcaagaccgctttgcaggttgtctttcggactgcattccgccaataaaagccttagcggctgaccgtccgacatcttccacaggctgccgttatattccggcctgacaatctgtccgttttctttgattcttggtactaccaagctgaaataaaggttttcagcctggtgcttctcaagacatttatttccgacttggtagtacatgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtttcaggagagagatacagaaagtcccctgttgatacggactggacaacatagactttctgcattcaatcagcctttcttcacgagttgaaaaccgatgactttcagtttttgggttttgcccgtagtgacgatttctacgttcaggtttgcttcgatcggaaattgggcgtttcggaactgctcgaaattggcagagccgccgaaatcgtattcagtagtagagctgcccaatgcgttgccttgggagctgtctaagggtgtggcgacaatcaggcagcaatagtcgaagctcttgccttcgatttgtccgttgatttttttaacgccgacgatgtggccttgaagttggatgttcattttttggtttccttgtgtgattaaacgtctttcgggcagacactttaagcccatgaaatcggtagtcttgcgaatttgtcgtaaatgaagttgttatagctttcttcattgttgacgtgtttttgctgttcaagctgtttttcaagattctcgtaatattcgtacatatagtaagggtctttgtacggtttgaatgcgggctgttcatgaatggcttgagctttcaaaaaggcgcagtcgtaggcttcgggagccaaagacttgggcagcttgtgatgactcggctcaatcagttcaaacagtttggctttgtccaattcgggaaaaatgaatttcagaccgtttgccgcacgtccgaactgtttttttacccattcaaggtagcggtcggctgaaatgaccttatcttccttaaccgcgtgtatgcgcgttgccttttgggcgaatcgttcgcaaatcggatatgcgccgccgaaatattcgcccggattctgcaaaacttcgaaagggataacgatgtcttttgctttgaattcaatttcaaatcgcgtccatgtgcttgttttatcgcccaactgcttgcctttttcatagacgcggacatatttggacgattcacgggagccgataccataggtcttgcctttggtcattttggcttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgcgaaaagtcgtgattcccagccttcttttgcgacgccgcaaccggtgccggtcagttcgaaaagaatggtattttgttggccgccaaaatggacgcgaccgtatagggcgtcttccgaacccatcaaccaacagcgctcatagaaacgaccgcccgaacctttggattctttgtagataccgaaaccgaaaacttcttcggcgagcatggacgcggcgcgaataaaatcttcgtcttccaaaagacttacacgaacgccgtatttatcgaaaaaggttttttcatgaaatgaaaagctaatttgatcaatgaaagccgaatctgatacaccgcgccgaagaggaacgcctaacaggtttcctttaccgtccgttatgtacgtttcgtaacattcgaagacttcctgaaccctgcctgccgtttcggtttctgtccccccctgttagataaggggggaagatttgaagcggttgtcggcttcctgccgtccgctagcgcgtccgtcatcacgccggcaaccgcctttgtcatcccttgcttatcttccatggtgcgaatcctcaaaaacgggcaaaaaaaagccctgttacttgtagaaagtaaaggacgttaatttttgttaatcgtcccttcttagggacgcaatatataaggtttataccgtcgttgttcctaatgcgcaatcagcgacattgttgccaattatccgaaagaaagttaagcctgatggcattgtatacacggatacctttcgtagttatgatgtgcttgatattagtgaatttagccatttacgtaagtttaacggcattcccaaagagcatttggggctgcatttaaagaaatgccaatggcattttaaatagaatctcaaattcagattttaagacaattagttaatgggaatttggtctggttatctagtacagccccaagtttttatataaaaacagtttggtaagttctcttcgtgaagtgcttatgttttgccacaaaagttccataatcatggcggcatcacccaagctccatctttccaagaaaatggcatctttgttgtggttgaaaaccgacaaactcctcttttttcgatttggccctgcctgaatcgatggcttcccgtgcggcagatatgccgtctgaaagcgaagcagcgacatttccggcatacagggcggcggcggtgttgagcaatacgatatcgcgcgcagccccttctcttccttccagcacctcattcattttcaacaaagattcctgagtattggcaactttgatttcatccaaattgcggcgggtttcgataccgaaatcttctgggcggatgtcgtattcgctgatttttccgtctttgagctcggcaacgcgtgttttgcccgtcagtgtaatttcatccaaaccgccctccccgcaaacaaccaaaacgtgttttgaaccaagttgttgcaagacccgcgacaaaatgccgcacaaatcggtgtggaacacgcccaaaagctggttcggcgcgcccgcaggattcgttaacggacccaatatgttgaaaatacttcggaaaccgagcgaacggcgtacaggggcgacatggcgcatggcactgtggtgattgggcgcgaacataaacccgatgccggtctgcctgatactttgggcaacctgttcgggagtcaggttgaggtttgcgcccatctgctccaccacgtcagccgcaccgctggaggaagagaccgaccggcctccgtgtttggcaaccttcgcgcctgccgctgcggcaacaaacatcgaagtcgtcgaaatattgaaggttttcgcgccatccccgcccgtaccgacgatatcgaccagcccctctgcattctccagcggcacttttgtcgcaaactcgcgcatgacggctgcagctgcggtaatttcggaaacggtttcaaccttgatacgcaatcctgtcaaaatggccgctatctgctccggcagaacctgtcctctcataatctgacgcatcaagtcggtcatttcatcgtaaaacaactcgttattgctgattaatcgttcgatggcctgttgcggtgtaatcattttttgtcctccgttcaatattcggacgaaaatgccgtctgaagggcttcagacggcatcacgtcagattttttgcggtttgaagttttgaaattcgattaaaaaattgtttaacatatcatgtccgtgctcggtcaagagggcttcggggtggaactgcacgccctcgacggcatattccttatggcgcacacccataatctcgccgtcctcagtccaagccgttacttccaaacattcgggcatcgtattccgatcgataacgaggctgtgataacgcgtacaggtaaccggattgggcaaacccttaaacatacccttgcccgaatgggacacgggcgacaccttaccgtgcatcagcgttttggcgcggactatcctgccgccgaacgcctcgcctatcgtctgatgcccgaggcacacgcccataatcggcagccggccggcgaaatggcgcatcgccgccacggaaatccccgcttctttgggcgaacacgggccggggccgataacgagatattgcggattcaatgcctcgatttcctccaacgtaatatcatcgttgcggcgcacggcaacttcctgccccaattcagtgaaatactggacgatgttgtaagtaaaactgtcgtaattgtcgataaacaaaagcattttgtgattaacctattgatttataatttgtttgttattaactgcatttccgatacccccatccataccctcttatatcttagcgtgcccgatgcgccctcgtgaacctggcgcagagcctcgcgttctgacaagtacgc

SEQ ID NO: 30 - DNA, 14652 bp, Neisseria meningitidis
caaatcagagccagatacgctttcataacaaatctccaatcgataaaataatattcggttttacagaaatcaaagtgcaaccgccattaacaaaaccttgaaaaagattccgccgcgttgcacaaacagatgtttcggagcggcattttgctacaaatttcatttgaaatcaaagcctgtttgcaagtttacaatcgtttacccaaaaaagggcaattttaccccgaacctatttctttagtattagacctattatcctttacttcttaatattaacggatgtttacacaaattcccgtatacattttatgcgccatgccttctaaccaagtttgccaatgcctccgccaattcgggatgccgtttttccaactttgccgccgccgaaccgaaactctccagcgcagccttactcaaatgcagggtattggttttcggcggtttttccggtttcgggaccagcctgaccgaaacagagcgtatcgaagcatcaagccctgccaactgcggcaataccgacggtgcaatcattttcaagcgcgatgccgccatattgtttgccgccaaaaggacaagcctgccgtcttcgatacatgccgtctgaaaatgcgggtgcaggttggcaggcagcagttttttcacggcggcatccaaccgccgccactgtcccgcctgtttcaaaagtccggaaagcagcgcgtcccgcctgcccaactgttccaaattcataaaacatacacccaaaaagattgaaataccgcaaacgcgcctttatttcagacggcattagcactttgcacaaacgcttgtgttaaaatcgcgttttcgcccactattatatcaggcgcaggaattattcatgctgacaaacattgccaagaaaatcttcggcagccgcaacgaccgcttgctgaaacaataccgtaaatccgttgccagaatcaacgcgctcgaagaacagatgcaagccctaagcgatgctgatctgcaagccaaaactgccgaattcaaacaacgcctcgccgacggtcagactttggacggcattttgcccgaagccttcgccgtctgccgcgaagcgtcccgccgcaccctcggtatgcgccacttcgacgtgcagcttatcggcggtatggtgctgcacgacggcaaaatcgccgaaatgcgtaccggcgaaggcaaaaccttggtcgccaccctcgccgtctatctcaacgcgctggccggcaaaggcgtacacgtcgttaccgtcaacgactacctcgcctcacgcgatgcgggcattatggagccgctctacaatttcctcggccttaccgtgggcgtgattatttcagatatgcagccgttcgaccgtcaaaacgcctatgccgccgatatcacctacggcaccaataatgaattcggcttcgactacctgcgcgacaatatggttaccgaccaatacgacaaagtgcagcgcgaattgaattttgccgttgtcgatgaagtggattccatcttgattgacgaagcgcgcactccgctgattatctccggtcaggcggatgacaacatccagttgtaccaaatcatgaacaccgttccgccccacctcgtccgtcaagagacagaagaaggcgaaggcgactattgggtcgacgaaaaggcacatcaggtcatcctgagcgaagcaggtcacgaacacgccgagcaaatcctgacccaaatgggattgctggcagaaaacgactccctctattccgccgccaatatcgccctgatgcaccaccttatggcggcattgcgcgcgcattccctcttccacaaagaccaacattacgtcatccaagacggcgaaatcgtcatcgtggacgaattcaccggccggctgatgtccggccgccgctggtcggagggtctgcatcaagccgtcgaagccaaagaaggcgtggaaatcaaacgcgaaaaccaaacgcttgcatctattaccttccaaaactatttccgcctgtacaccaagctctccggcatgaccggcacagccgataccgaagccttcgagttccaaagcatctacaacctcgaaaccgtcatcattccgaccaaccgccccgtacagcgcaaagacttcaacgaccagattttccgttccgccgaagaaaaattcgaagccgtcgttaaagacattgaggaatgccacaaacgcgggcagcccgtcctcgtcggcaccaccagcattgaaaactccgaactggtatccaagctgctgacccaagccggactgccgcacaacgtcctcaacgccaaagaacacgaacgcgaagccctgattgtcgcccaagccggcaaagtcggcgcgattaccgttgccaccaatatggcgggacgcggtacggacatcgttttaggcggcaacctgaagcaccaaaccgatgccatccgcgccgacgaaaccttgagcgacgaagagaaacaggcacaaatcgccgcactcgaagacggctggcaggcggaacacgacaaagtgatggaagcaggcggtttgcacatcatcggtacggaacgccacgaaagccgccgcatcgacaaccaattgcgcggacgttccggccgtcagggcgaccccggatccagccgcttctatctctcctttgaagacccattgctgcgcttattcgcactcgaccgcgccgccgccatcctcaaccgcctcgcccccgaacgcggcgtcgccatcgaacacaacctgctgacgcgccaaatcgaaggggcgcaacgcaaagtcgaaggcagaaacttcgatatgcgcaaacaggttttggaatacgacgacgttgccaacgaacagcgcaaagtcatttacagccagcgcaacgaaattctgaccagcaaagacatcagcgacctgatgcaggaaatccgttctgatgtcgtcagcgacctcgtggatacctatatgccgcccgacagcatggaagaacaatgggacatcccgactttggagaaccgtctggctgccgaattcagactgcacgaagacatccaatcctggctgaaggcggacaatgcgattgacggtcaagacatcaaagaacgcctgatcgaacgcatcgaaaacgaatatgccgccaaaaccgaactggtcggcaagcaggcaatggccgatttcgagcgcaacgtgatgttgcaggtcatcgacaaccaatggcgcgaacacctcgccgctatggactacctgcgacaaggcatacacctgcgcagctatgcccaaaaaaatccgaagcaggaatacaaacgtgaagcctttaccatgttccaagacctgtggaacggcatcaaattccatattgcctccctgcttacctcggttcaaatcgaacaaaaccctgtcgcggtggttgaagagcaacccatcggcaacatccagtccatccattccgaatcgcccgatatggaagaacttttgggtcagtcgcaaaccgatctggttaccgaagcctttaatcccgatgggacagatttcagccccgaagccttggaagcgcgggggcaaatcgtccaccgcaacgacccctgcccctgcggcagcggtttgaaatacaaacaatgccacggcaaactggcttaagcgtttgaacgcaaatgccgtctgaacatcccgctcccgtttcagacggcattttgcctgaaccgccacatccgactgccattccgaaaaatcccgatttcgtaccgtccgtaccaaaaacagacatcccgtccgccccacatcatgattccatccgacttcattgacgagcttttagccaaaaccgatattgtcgatattatcgacgagcaggttccgctgaaaaaaggcggggcgaactatatggcgtgttgcccgttccacaaggaaaaaacgccgtcgttttcggtcagtccaaccaagcagttttaccattgtttcagttgcggggcacacggctcagcgattggttttgtgatggaacatcagggactgtcgtttccggaggcggttcagttccttgccgaccgcgtgggtatggtcgtgccgaaagtgcacgggcaaaacgataatcccgaagtccgtgccgaacgtaagaaaaaacagcagacactggaggaaacgacggctgcggcagctgatttttacgcgcaacagctaaaattcaatccagcggcaaaagcttatttggacaagcgcggcttgagtgcagaagttatcgcgcattatggtttgggctatgcgcccgacggctggcagcctttgacgcaagtgttccaaccgtatcctaataccgcgttagtggatacggggatggtgattgacaatgagggacggcattacgaccgcttccgccatcggattatgttccccatccgcaatccgcgcgggcaggttatcggtttcggcggcagggtgctggacgactcgaagccgaaatatttaaattctcccgatacgcctttgttcgataaggggaaaaacctttacggactgtatgaagggcgtgccgctgtcaaggaagcggggcggattttggtggtcgaaggctatatggacgtggtcgcgctggcacagttcggcgtgggctacggcgtggcggctttgggtacggcgacgacggcggaacacgtcaaaatcctgatgcgtcaggcagacagtatttatttctgtttcgacggcgacagcgcggggcgaaaagcggcttggcgcgcgctggaaaacgcgctgccgcagttgaaggacgacaaatcgctgcattttttgttcctgccggaagaacacgaccccgacagctacatccgcgcctacggcaaagcgcaatttgaagacgcgcttctgaatcaaagcaagcctttgtcggagtatttctgggaacacctttcagacggcattcatctcaatacgcaggaaggcaaggcggaattggtaaaaaccagttcgccgcttttggcgcagattaccgcgccggcattggcttatttgttaaaacaacggcttagcgagctggtcggcatcgaccccgacaacctcgcgcaactgctaggacaggaagcgccgaagcggcacgtcaaacaaaaaaactacaaactgcctccgatttccgtcaaacagcccgtcatgctgacgctggtacagcggcaaatccgcagcctcttgataaatccggattgggctgcatatatagacctgcccgattatctggcgttggacggtgatttcgcctgccttgccaatcttgccgaatcgattaaaaaccatgccgccgtacccgaaaccgctcaggttttagagtatatgcgcggctcgccttacgaagaaacgataacccgaatcttccattcaacgcaccaatcggaagaaatgaacagcagcagtgaagaagattgcgagaatttccaaatcggcatgaaaaaactgctcaatgagttaaaatacagccaaatcgaaacattaaaacaaaaaagcctgcaatccggcttaaatgaaagcgagaaaaaacttttgctgtcgctgctgaccgcaaaacaaaattgaccggcggattccgccatccgtaaaccgttatgccgtctgaaaagcattcaccccggctgcaacaacgacacctgcagaacacccatccccaaaagccttcagacggcatcagagtaccctactctgccacgccttcaggtgcgtccaaacgcaaaccgtcggcatcttaccaacagaaagcagacaatgtccagaaaccaaaatcacgaagaatatcaagacgacacccgtccgttaagcattgaagagcaacgcgcgcgcctgcgtcagctcatcatcatgggtaaagaacgcggctacatcacctactccgaaatcaacgacgccctgccagacgatatgtctgatgccgaccaaatagacaatatcgtcagcatgatttccggtttgggcatccaagttaccgaacacgcccccgatgcggaagacatattgttaagcgacaatgccgccgttaccgacgatgatgccgtcgaagaagccgaggccgccctttccagtgcagattccgagttcggcagaaccaccgaccccgtccgtatgtatatgcgcgaaatgggacaggtcgacctgctgacccgcgaagacgaaatcatcatcgcaaaaaaaattgaaaacgccctgaaaaatatggttcaggccatctccgcctgcccgggatccattgctgaaatcttagaactcatcgaaaaaatccgcaaagacgaaatccgcgtcgacgaagtcgtagaagccattatcgacccgaatgaagtattgctcaacgaattgggcttggggcacttggaaaccacagcgcccgagaaaccttccaacgacaattcggacgaaaacgaagacgacgaagaatcggaagaagatgcggatgaaatctcggcagccaatctcgccgaattgaaacaaaaagtcatcggccactttgcccaaatcgaaaaagactacaaaaaaatgattggccgtttggaaaaacaccacagccggcacaaagactatctcgcctaccgcgacgcgattgccaacaaactgctggaagtccgtttcgccacccggcaaatcgacagcctcagcagcagcctgcgcgggaaagtagaaaacatccgcaaactcgaacgcgaaatccgcgacatctgcctcgaccgcgtccatatggaacgcgactacttcatccaaaacttcctgcccgaaatcaccaatctagaatggattgaagaagaaatcgccaaaggcagggtttggagcgacgcgctcgaccgcttccgccacgccatcctcgaaaaacaaaccgagttggcggatatggaaaaagaaacccgcatttccatcgaagagttgaaagaaatcaacaaaaatatggtgtcgagcgaaaaagaaaccgcagccgccaaacaggaaatgattcaggcaaacttgcgcctcgtgatttccatcgccaaaaaatataccaaccggggcttacaattccttgatctgattcaggaaggcaacatcggtttgatgaaagcggtcgataagttcgaataccgcagaggctataaattctccacctacgcaacctggtggatccgccaggcaattacacgctcgattgccgatcaggcgcgtaccatccgcattccggtacatatgattgaaaccatcaacaagatgaaccgcatctcgcgccaacaccttcaagaaaccggcgaagaacccgattccgccaaacttgccgaactgatgcagatgcccgaagacaaaatccgcaaaatcatgaaaatcgccaaagagccgatttcgatggaaacccccatcggcgacgacgacgattcgcacttgggcgacttcatcgaagatgccaacaatgttgcgccggccgatgcggcaatgtacaccagcctgcacgaagtaaccaaagaaatcctcgaaagcctgacaccgcgtgaggcaaaagtcctgcgtatgcgtttcggcatcgatatgaacaccgaccacacgctggaagaagtcggcagacagtttgacgtaacgcgcgaacgcatccgacaaatcgaggcaaaagcactccgcaagctgcggcatccgacaagaagcgaccgtttgagaagtttcttggacagcgaagacagcaagctgtaaaccaaaaaaccgcaggtttcaaatacctgcggttttttcttacacaataaacaacgcttccacatatcccacactcctatcccgagacctttgcaaaattccccaaaatcccctaaattcccaccaagacatttaggggattttccatgagcaccttctttcagcaaaccgcacaagccatgattgccaaacacatcgaccgtttcccactattgaagttggatcaggtaattgattggcaaccgatcgaacagtacctgaaccgtcaaagaacccgttaccttcgagaccaccgcggccgtcccgcctatcccctgctgtccatgttcaaagccgtcctgctcggacaatggcacagcctctccgatcccgaactcgaacacagcctcatcacccgcatcgatttcaacctgttttgccgttttgacgaactgagcatccccgattacagcaccttatgccgctaccgcaactggctggcgcaagacgacaccctgtccgaactgttggaactgattaactgccaactgaccgaaaaaggcttaaaagtagagaaagcatccgccgccgtcgttgatgccaccattattcagaccgctggcagcaaacagcgtcaggccatagaagtcgatgaagaaggacaagtcagcggccaaaccacaccgagtaaggacagcgatgcccgttggatcaagaaaaacggcctctacaaactcggttacaaacaacatacccgtaccgatgcggaaggctatatcgagaaactgcacattacccccgccaatgcccatgagtgcaaacacctgtcgccgttgttggaagggttacccgaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttatcgaagacccgttatgtggtcgaacaaagcttcggtacgctgcaccgtaaattccgctacgcccgggcagcctatttcggactgattaaagtgagtgtgcaaagccatctgaaggcgatgtgtttgaacctgttgaaagccgccaacaggctaagtgcgcctgttgccgcctaaaaggcagcacggatgcctgattatcgggtatccggggaggattaagggggcgtttgggtagaattaggagatatttggggcgaaaacagccgaaaacctgtgtttgggtttcggctgtcgggagggaaaggaattttgcaaaggtctcatcctgttattttcacaaaaacagaaaaccaaaaacagcaacctgaaattcgtcattcccacgaaagtgggaatccagtgcgttgagtttcagctatttagaataaattttgaaactctaatcgcgtcattcccacgaaagtgggaatccaggacgcaaaatctcaagaaaccgttttacccgataagtttccgcaccgacaactctagattctcgcctgcgcgggaatgacgaatccatccatacggaaacctgcatcccgtcattcccacgaacctgcatcccgtcattcccacgaaagtgggaatccagttttttgagtttcagtcattcccgataaattgccttagcattgaatgtctagattcccgcctgcgcgggaatgacgggatttgagattgcggcatttatcaggagcaacagaagccgctctgccgtcattcccacgaaagtgggaatccagttttttgagtttcagtcattcccgataaattgccttagcattgaatgtctagattcccgcctgcgcgggaatgacgaatccatccatacggaaacctgcaccacgtcattcccacgaacctacattccgtcattcccacgaaagtgggaatccagttttttgagtttcagtcattcccgataaattgccttagcattgaatgtctagattcccgcctgcgcgggaatgacgaatccatccgtacggaaacctgcatcccgtcattcccacgaacctacattccgtcattcccacgaaagtgggaatccagttttttgagtttcagtcatttccgataaattgccttagcattgaatgtctagattcccgcctgcgcgggaatgacgaatccatccgtacgaaaacctgcaccacgtcattcccacgaaagtgggaatccagttgcttgagtttcagtcatttccgataaattgccttagcattgaatgtctagattcccgcctgcgcgggaatgacgaattcatccgtacggaaacctgcaccacgtcattcccacgaacctacattccgtcattcccacgaaagtgggaatccagtgcgttgagtttcagtcatttccaataaattgccttagtattgaatgtctggattcccgcctgcgcgggaatgacgaattcatccgtacggaaacctgcatcccgtcattcccacgaaagtgggaatccagttttttgagtttcagtcattcccgataaattgccttagcattgaatgtctagattcccgcctgcgcgggaatgacggcggaaatcttgtttatattgaatcaaaaaaaacctgcaccttaatcagttggcggtttagtccgacttttggggtgcagatcaagctttcagacggtatttcctttaaaacttcatttcgagcgcgagactgaagttcctgcccggtgcggcataccttccatagttgctgtcgccgccgtgccggtttgccgtgctttccgcagtctggcgcaaggattcccaagtaacgtagcggtagttgccgatattgtagatagccgccctcaaggtcagccgttttttcagattcagataggcggaaacgtctgccgtcgaccaagaagacgacgctctttttgtcgaatatcgtttttgatcgcctgccagataagcaagctcgtcagggtttttccctttggaataggtcagcataatgtttgcgccccatttcccctcaggctggtcgtatccgaaccccaaaacataacgcgacggctgtaccgcatccaaagcatagctgcggagggacagtcccggccggttggataccgatttcggtttgatgcggttgtacgccaatgtggtgtacaaaccttcgggcagtttgccatacacgccgttccagtcgatttttcccaatatattaacgccttgaagcgacatattttgggcattgtaataatcgcgtatatcaatctctgtcaattgtcctgcctgattcggcaatttggttttgtgatcggcaacggcaatcatatcggtataacggttgcggaagctgctgatttccaaaaagccgaaatcgcccttccactgcaaaccgatttcccggttggctgccttttccgatttcagggcgggacgctgccagcctttcggataatcgtgataaatgtctatcccgaaaagttcttggaatgagggcgttctgaagccgctggaggcacggtaagacacggaaaaatgccggttcggtttgaacaagatgccgctgttccacgaacggtcaacataccgcccgctgcggacgagttcttccgacgtggtgaagtttttccggtcgtacctgccgcccaagctgaaatcgaaatatttgccgattgaaaaacggtcgttcaaagaaatatggatattgctgccgttgatttttcttggcacgcatttgcgggaacgcagggtttcgatgtagccgcagaccgacccttcgacgacttcgggcttacccaaaagatacttatcttgattgttttcatcgaatcccgtggattccgaaatccttgccgcattgtgggaaagctgttcggggcgggaaatcgctttggaagcatcgtaaccgaagcccaaagtcagatggtgtttcgtccatttgtttttcagcgatttctcaaacgaggcattcaaaacattgtgctgttcgcggtagtggaaacggtcgctgctgtcgtaggaatacggtttgtccgccgacgcgcggcaggatttgtccacagcaggatacacggcgcaattcagcttcagcgtgttgttatcggttgccacgccctgtttgtcaaacgacaacaccgccttatccgcccaattgtcagaatacgcttcgttttcataacgatacagcaaacccatacggcggcggcggtgatgttcgtcaataaatttggtgcgggaatatttcaaacctatgcccctgaccaaatttttatcgcccttccactcttctatattcggcacaaaatacaagccgtcgcggaaatcgtcgccgtcgtacaccccgctcttgtctctaaacttttccgcctcgtccgtaccgtaatactgtttttccgtcatatcgcggatatcgtaacgctgtttggtatcctcaaacacgccgccgacataatgcctgccgccgaagcggtagcccagcttggcaagccaagagccgctgcggtaatccatcggatcgggcaatatcctgccgccgcccgtgtaagcttgggcggacagattttcgtggcgcgcctgcgcctcccgcacctgcgcctcttcttcagcacttaaaggctgattttgttcaatacgttcttttacccagcggttgagctggttgttcaaatatttcccgtagcccgccaattttgccacgggcttggattcacgctcgccctctactgagaaaaatggctctcttgtcttgcgtttaatatcgtatgtctgacggaacgcgtccaaacggtctatgccgtattccaccccgtccgcaatatcgccgtgcgggcgcgtttcccgcccttggcgttcggttcggattaacagcccttcccaaccgtctttgctgaaccccgcgccgagcgacttcataaattggcggtttttactgccgtaggcggtttttgcctgtatcccccaacttttgccgtctgaaatcaggtctgccgcctctttggtgcggaaggcgaccgcgccgccgagtgcgccgctgccgtgatcggacgaaccggcacctttgtcgatttccaccgtgctgatgttttcatattcgatttcgttgattgcaccgctgccgccgcgtccgccgtatccgctcaacgatccctgcacggtaaacgcctgtatttgggcaacaccgtcgaccgaaaccgccacacggtttttatccacgccgcgtatcgagtagccgccgctcgcgccgttgccctgttcgacaaccgccacgcccggatcgtagcgcgtcaggtcgcggataccgagtacctgttctttgttcaacgtttccgacgttttgacgattttgcccaaaccggtcgcctctttcgatcgccgtcccactttggcggcacggacggtaatctctttcagggattgggtctgcgcggcatcaggtgtcgccccccccgcttgggcagcataagccggaaaagcggttgcaatggccaaggcagtcagagtcagcggaaaaccgtgtttcttattcatttttccacctcctgcatatctttcttcgcaccgaataccacgccgaattggtgtttaacttcagattctaactgtttgccaacatcaacttcagcatcaacttcagcttcaacatcaactttattttcagtaccttcagttataccaagagatttcccatcattattgaaaataataccgcccaattcctccgcctgcgggccgtaaaatcccccttctacacgaagattactagcttggaaggttttggggtcggtcgaaccatttcccgaaagattgatgccgttctcccgagtgcgtgctgtcgcgtagaaaccgttgccctcaatcttgccgttttcaatatggaaagcaggttctacaccgttttcctccgtcagcgttccggaaatcgatttcttgccgaaatcaacggtaaatactgcttttgccgcttctttatccgcctgattgtcccattgaatgggtttgccgatacgcgcttcccaagtgccggtatagtgtgcttctccagttttcggaatatccgtttccgccgtgcggatacctttcaggaaaaggtcgatgttcctgcctttaggggcttccggagcgggcaggatgccgtctgaaccgctgccgccttcttctgtcggcgattcttcttcgggttcttcagcttcatcttcaccttctacggcttcgtcttcttcgctgccttcgtcttttacggctgcgtcttcggtgccttcttcatcgtcgatttcgtcttcgccttcttcgacgctatcaacgcctgtatcctcttcgtccctctcttcgtcctgcgccttcggtttggcggcgggacgttcggtttgcatccgtccgattttcacataggtcagaaaatcgcagcaggttcggattgtcgttttcctaccatcggcaagctcgatggtttgttctttgtttaccaaaggaatttcacgcccttcgacaagaagtttgtcgggatgaccaaaatcgggcatagaggaaatggcaaactcacggggatttttatcacttgcctcgtcaacggaaattttcagagaatccaagattttggtgtgttttccagacgacagggcaggttttgtatctgctgcgttttctgtctctgttttttgtttgcctgcgaatacgccgaatacgctgttgtcgttgctgataaaccgtccggcaagctcttctccgttatcgccgaaaaaaccgccctcaagccgctgatcggcatcggtatggaaaaacaaatattctttatcagcgtgttgcgtcttcacctcggtgctaactttggcactgccggtaaagcggttgccgtccaatgttgcggtaatgtcgtaaatggtcagcggttttttgggctcatttggattacttttattttgcacatactgatttttaatcagcttgccattcagggttttgttatcaaaatcaaccgtatattcggcaggatgcttttccctgtcgtcggcatccctagcctcataagaagttgc

SEQ ID NO: 31 - DNA, 8367 bp, Neisseria meningitidis
  misc_feature (8323)..(8323): N is any nucleotide
tttttggatagcgtgccaaatgctgctgaatttgctcaaccgagatggcaagccttggcgacacctcaaagccttgttttgccaagcggatcggtgtatcaaataattttccccaaggcaatacaccgtatcgctgatgtattgtctccatcagtttagggatagcaggcgtacccaccgagcgaccaccggccaccggttccataaatttcaatggttgaccatctttatccaaaaataattccggcgtcgcacgcatcggtgccgtctcacgcccatcaaatgtggtcaatgttttggcggtattatcccaatacaacacaaatgcaccaccgcccaagcctgacgactgtggctctaccaagcttagtgtcgtctgcaccgccaccatcgcatctgcagcgctaccgccttgctttaagatatcatagccagcttgtgttgctaatggattggctgacgctaccataaaatcacttgcaagaccaggtaaggttcttcgcgttgcatcgaattaatccacatcatccaccgcttgtgcgggtccccgtcaattcctttgagttttaatcttgcgaccgtactccccaggcggtcaatttcacgcgttagctacgctaccaagcaatcaggttgcccaacagctaattgacatcgtttagggcgtggactaccagggtatctaatcctgtttgctacccacgctttcgggcatgaacgtcagtgttgtcccaggaggctgccttcgccatcggtattcctccacatctctacgcatttcactgctacacgtggaattctacctccctctgacacactcgagtcacccagttcagaacgcagttcccgggttgagcccggggatttcacatcctgcttaagtaaccgtctgcgcccgctttacgcccagtaattccgattaacgctcgcaccctacgtattaccgcggctgctggcacgtagttagccggtgcttattcttcaggtaccgtcatcagccgctgatattagcaacagccttttcttccctgacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtaggcctttaccccaccaactagctaatcagatatcggccgctcgaatagcgcaaggcccgaaggtcccctgctttctctctcaagacgtatgcggtattagctgatctttcgatcagttatcccccactactcggtacgttccgatatgttactcacccgttcgccactcgccacccgagaagcaagcttctctgtgctgccgtccgacttgcatgtgtaaagcatgccgccagcgttcaatctgagccaggatcaaactcttatgttcaatctctaactttttaacttctggtctgcttcaaagaaaccaacaggacaatgttcaaaacattatcttgtctgtctttcaaacagtgtgagactcaaggcactcacacttatcggtaatctgttatgttaaagagcgttgcgaattataaagtattccttccgcctgtcaagatatctctcgatatccccaacattctgtgctatacttttcagttcgtccgccacttctgcagcagcgaagaaccgaactatacgcccacagggaaaaacggtcaatgctttcagcgggatttttttggggaaattcgtcatgtcgctgtcggataaggttttttatttctgctaaatactgcgccgcctccaacaatcctttcctctccctcctccggctggtgcgcctttgtgaatatgctgtctgaaactcggggactcagacggcatctgttggctcttcttatcttttcagaatgatttccaatacgaacttgctgcccatataggcaatcataaggctgacaaatccgatgatggtccacacggcggcttttttgccgcgccatgcggtcatgctgtgcttgagcagcagtccgccgtaaatcagccatgacaatatgccgaatacggttttatgggtaaaggtcatgggtttgccgaatacggcttcggcaaaaaatgttccactgacgacggaataggtcagcaggatgaaacctgcccacatggcctggaacatgagtttttccaaactgagcagcgacggcaggaatcctgcgagcttggagaagctcctgcggtgcaggctccgattcagcagcagggtcaaaacggacaataatgttgcgatgccgaacagcccgtatgcgagcagcgaagttccgatatgcagcataaagggaaggtcggtaatttcatatcccgagaattttccaggaaaaaccaaacctgacagcagcatcagtgcggcgcaaggatacagcagcaactgcactccgcgcagcggataaaagaagctgccggcaaaataaataaacagcatcatccaaacaatcaggctgccggaatacccgaagcccataatgatgattttgtcttgaatgaccggcataagcagtgccgcgccgtggacggtcaatgccgcacccaaaaccggcaattccgtcttccacgggtaatcccggccgcacccctgctgttggcagtgccatgcaaatgcacccaatcctgcgtaaaccgccgtcaaaaagatgaaaactgtcggcatggtggactttctctatctatactgttgcgccgtatgcggccgcttatgaaatattggaacttttaacgttggaattgtaaaatccccatttcggtcaagccttgacggatttgccgatatgctgtccggcacacaagccgcatcaaattattttgattttattttaacaaagaatgcccctgatggggcaagctattcttattcagaccaaggaccagtatgttagacaatttaaccggccgcttcagcaatgtcttcaaaaacatccgggggcaggccaaactgaccgaagacaatattaaagaggccttgcgcgaagtccgcctcgccctgcttgaggcggatgtcgccctgcctgtcgtcaaagagttcatcaacaacgtcaaagaaaaggccctcggtcaggaagtagcgggcagcctgacgccggatcaggcatttatcggcgtggtcaacaaagccctgaccgaactgatgggcagggaaaacaaaacgctggatttgtcggttgcgccgcccgccgtcgtgttgatggcaggtttgcagggcgcaggcaagacgacgaccgtcggcaaactcgcccgcctgttgaaaaacgatcagaagaaaaaggttttggtggtatccgccgacgtttaccgtcctgccgcgattgaacagctgcgtctgttggccgaacaggtcggcgtggattttttcccgtccgataccaaccaaaaaccggttgaaattgcaactgccgccgtcgattacgccaaaaaacatttttacgatgtattgatggtcgataccgccggccgtttggcaatcgatgaagagatgatgaacgaaatcaaagcccttcacgcggcggttaacccggtggaaactttgttcgtcatcgatgcgatgctgggtcaggatgcggtgaacactgctcaggcatttaatgaagccctgccgctgaccggagtcgtattgaccaagatggacggcgactcgcgcggcggtgcggcattgtccgtacgccacgtaaccggcaaaccgattaaatttatcggtgtcggcgaaaaaatcaacggcctcgaacctttccaccccgaccgtcttgccggccgcattttgggtatgggcgacgtattgaccctgattgaagacgttcaaaaaggtatagacgaagaagccgccgctaaaatggcgaaaaagctgcacaaaggcaaaggcttcgacctcaacgactttaaagaacaaatccagcaaatgcgcaatatgggcggtttggaaaacctgatgtcgaaaatgccgggcgaactgggtcaaatctcgaaacaaatccccgaaggaacggctgaaaaagcgatgggcaaagtagaagccatcatcaactcgatgacccctaaagaacgcgccaaccctgccctgctcaaagccagccgcaaacgccgtattgcaatgggtgcgggcacaaccgtgcaggaagtgaacaaattgctcaaacagtttgaacaaatgcaacaaatgatgaagatgttcagcggcaacggcttgggcaaactgatgcgtatggcgaaaggaatgagggggataaaagggatgttcccgggtttgtaagccgatttaacagaaaacgccgtctgaaatttcagacggcgtttttgttttatattctgatttatagtggattaacaaaaatcaggacaaggcggcgagccgcagacagtacagatagtacggaaccgattcacttggtgcttcagcaccttagagaatcgttctctttgagctaaggcgagccaacgccgtactggtttttgttaatccgctatatattctgatttaaaaccataaggctttaagcaatcatctcttctataaagcctaaatacaaaaggccgtctgaaatcctattttcagatggcctttactcattcaatcctcaacttattgcggctttttctgctcttcgcgtactttatccaccaactggtcaatcgtggtcataccggactgccagtctttaaattcaacttggtatttgccgccgacaatcacagtcggtgtgccgctgatttggaatttattggtcaactcttccatttgagccgcacgcgcttggctttcaggagcctcaaatgcagccaatacttttttgccgtcaaacgctgtttgctcggacagccattttttcagggtatcggtatcggccagattgattttttgattaaccatcgcatcgaaaatatggctgttggctttatctgattcaccggccatttccactgcggccgccaaacgtgccaaaggtttcatttcatcaccccacacgacatgctcccggcgcatataggtatcgtctttaaacgttttgatgtgctcgctcaagaccggctcaagatgggcgcaatgcgggcagaagtagccgaaaaattccaatacttcgattttaccggcctgctgttgcggaataggcgtagacaatacagtgtagttcacaccttcgttcaactcagcaggggctgccggagcagatgagctgctttgggcgctgtctgccggaacactggtttcagcctgtttgctacaagcggccaatgccaacagggtcaatgaagtcaaagctaaggttttcagtttcataggtatctcttgtgtgtcagattaatgtgcggattttatggcattttattgaaggcgtgttcgatttgagtgaaaaaatgtgtttagttttatttcagcctttgcctgatttcatcagaaacggtaatttacccgggcagtatagccgcgcggattacccggcatagagtccgaacgccaatatttttgattgagcagattggctgcggcaaaggtaacgttaacatttttatggttccagccaagcatggcatcaactcgggcaaagcctggaagcgtagtcacttctttatttcttgagttgtaaccgtagcgtttgcctgtaccggttacgccgatttcgccgtagaggttttcggtcggggtataacggaaaaacaggttgccggtaacgttgctggtattattcaaatggatgcccactcggtcgggattttctttgtcttcaacgactttcgcctgcatcacgcccaacgaaccgcgcagatagagttttttggggatgatttgcccgatggcggacaattccacgccgcgcgaacggtgtttgccgctaaccgcataaatataagggttgttttttggatcggggcggtagcggatattgaagcgttcgatttggtaggcagacaacgtagtgctgaggcggtcgtccagccaactgcttttcacgccggtttcgtattggcgggtgtactcggggtcggcgttgaacacggcggaagacaacgtatcgatgctcaaatagccgccgcgtccgccataaggcgcgaagcctttgttatacgaggcgtaaagtgtgtggacgggattgatgttccacactgcgccgatgttggggctgaacgagtgtccgctgtattggcggctgctgccggtgagtttgttttcggaattaaaggtgtatttgtcgtaacggccgccgaggacgaatttcaaatcgggcgtggcggagaagatgttttgcacaaagatgccgtaggagtcggctttgtggcggttttgggtcagaataggctgcaatctgcccgaagccggccagcttgcgcggtcgtaggggttgatggaggcggaaaaggcgctgctgaaacccaatgtcgggttgcggtgttcgcggctgtaatccatgcctacggtcaggtggttttcaaaacggccgatggtgtagtcgccgttgagcgttaagttggacgacagggttttgttgtcggtctgctgccaggcgtagttacgtttgattaagttgccattttcgctgcctgcatagaaatgatcaaaatcctgcgccgccgtgcggtgggcgagctgccattgggcacgccatttgtcgttgaaggcgtattcaaggtcggaacgccaaacttgcagcttgtctttgacaaaatcgttccggtgggcgaaccccatgcggtaaggcagtccgaagcggtcgtacacggacttggtcggactgcggtcgggcgtgcgctccacattgtcgtaggtgtattgccccgtccacttcaagccgttgtcgagtttgacggtaatgctgggcgaaaccatgacatttttgctgtctatgccgctgcggaacgaattggcgcgcccgacttcgccggtgagacggatggcgacgtttttgttcagcacttcgttaatgtccatattcaggctgcggtttgcccatgagccgtaaaccgctccgatgttgcggctttgtttgaagttggcgtatttgctgaccatgttgatgacgccgccgccgttggtgcggccgtaaagcacggaagacgggcctttcaggatttccacgcgctcgatgttggcagtactgcggcgcacttgtccgctttcgcgcacgccgtcgcggtaaatatcggatgcgtcggcttgaaaaccgcgcaggaaaatgctttcaccgcgcatatcgtaggcagcgtcgatgccggcattgccttcgaggatggaactcaaatcgttcgtaccgtaatttttgtttttctggatattgagcgtatcgatggtttgcggcgtttctttgatgagctgtccgttgcgggtaacggcggcttcgtcgtagttgatgtagcctttgagtacgctggtgtcggactgtccgaccacggaaacggtgggcagagtggcggtgtaatgttcaccattgtcctgcgtatcggcggcagcaacagggaaggaagcaataatcagcgtgggtaataaagctaaatgaaatgatattttcatttttatactcaatttaacaaaacaaccgaattatattgcctcacggaggaaatgagaataatttcttttaactatattgaacatgatatttgtaaacaaaggtctcagaatgcggaaaactcgccgcctgatactgaaaaatgccgtctgaacagggttcagacggcatttttttgaccgcgaaattatgcgccgaacactttcaaacgttctgcaacgggttcaaaggtcttttcacctgccgccccttcaataccgccgataaccatttgtgcgcgcaacaaccagttttcggggatattccacgctttggcaatcgccgcatcgggcaagggattgtaatgttgcaggtttgcacctacgccgaccgcggcaagtgtcgtccaaacggcatactgcaccatcgcgtttgcctgatccgcccaaacggggaagttagcggcataagcagggaactgctcctgcaaacctttgacgacattttgatcttcataaaacaaaatggttgccgcacccgccttaaacaggttcaatttttgcgcggtcggttcaaaactgtcggcaggcacgacggcacgcagcgcgtcttcgacaaattgccacaccttatcatgctcttcgccaaacagcacgaccacgcgggcagattgggaattgaacgaagaaggtgtgtgcaaaacggcgtgttcgacgatttggacaacttcatctttgccgacgggcagatttttatttaacgaataantggaacggcggctttcggcagcctgttgcagagattgacgggtc

SEQ ID NO: 32 - DNA, 13732 bp, Neisseria meningitidis
cagcgcgccgccctcggcattcccgccctccctttgaacgcgcagcaaaccgccgatttggttgagctgctgaaaagcccgcccgcaggcgaaggcgagttcttggtcgaactgcttgcccaccgtgttccgcccggtgtggacgatgccgccaaagtcaaagcctcattcctggctgccgttgccgaaggcagcgcgtccagcccgctgatctcccccgaatatgcgaccgaactcttaggtacaatgctcggcggttacaatattcacgccttaatcgaactcttggacgacgacaaactcgcgtccattgctgccaaaggcttgaaacatacgcttctgatgttcgattccttccacgacgttcaagaaaaagccgaaaaaggcaacaaatacgcgcaagaagttttgcaatcttgggcagatgccgaatggttcgcctcacgcgccaaagttcccgaaaaaatcaccgttaccgttttcaaagttgacggcgaaaccaatacagacgacctctcccccgcgcccgacgcgtggagtcgtcccgatattccgctgcacgcgctggccatgctgaaaaacccgcgcgacggcatcacgcccgacaaaccgggcgaagtcggtccgattaaattgttggaagaactcaaagccaaaggccatccggttgcttacgtcggcgacgtggtcggtactggttcttcacgcaaatccgcgaccaactccgtcatttggcataccggcgaagacattccgttcgtgccgaacaaacgcttcggcggcgtatgtttgggcggcaaaatcgcgccgattttcttcaatacccaagaagattccggcgcgctgccgattgaagtcgatgtatctgctctaaaaatgggcgatgtcgtcgatatcctgccttatgaaggcaaaatcgtgaaaaacggcgagactgttgccgagtttgaattgaaatcacaagtattgctggacgaagtgcaagccggcggccgtatcaacctgattatcggccgaggtctgaccgccaaagcgcgcgaagccctgaaactgcctgcctctactgcattccgcctgccgcaagcgcctgccgaaagcaaagccggtttcaccttggcgcaaaaaatggtcggccgcgcctgcggtctgcccgaaggacaaggcgtgcgcccgggtacttactgcgaaccgcgtatgacgacggtcggctcgcaagacacgaccggcccgatgacccgcgacgagttgaaagacttggcttgtttgggcttctccgccgatatggtgatgcagtctttctgccacaccgccgcctatccgaaacctgtcgatgtaaaaacccataaagaactgcccgcctttatttccacccgtggcggcgtgtcactgcgtccgggcgacggcgtcatccactcgtggctcaaccgcctgctgctgcccgataccgtcggcaccggcggcgacagccatacccgtttccccatcggtatttccttccccgccggctccggcttggttgcctttgccgccgcaacgggcgtaatgccgctcgatatgcccgagtctgtattggtacgcttcagcggcaagctgcaaccgggcgtaaccctgcgcgatttggtgaacgccatcccgctgtacgcaatcaaacaaggtttgctgaccgttgccaaagccggtaagaaaaacatcttctccggccgcatcctcgaaatcgaaggcctgcctgatttgaaagtggaacaagcctttgaattgaccgacgcatccgccgaacgctccgccgccggctgtaccgtgaagctcaacaaagagccgattatcgagtacatgaaatccaacgtcgtgttgatgaaaaacatgattgccaacggctatcaagacccgcgcactttggaacgccgcatcaaagctatggaaaaatggctggcaaatcccgagttgctcgaagcggataaagatgccgaatacgccgccgtgattgaaatcaacatggacgacatcaaagagccgattatcgcctgcccgaacgacccggacgacgtgtgcttcatgtccgaacgctccggcaccaaaatcgacgaagtattcatcggttcgtgtatgaccaacatcggccacttccgcgccgcctccaaacttttggaaggcaaggcagacacccccgtccgcctgtggattgcgccgccgaccaaaatggacgcgaaacaattgtccgacgaaggacactacggcgtactcggacgtgccggcgcgcgtatggaaatgccgggttgctccttatgtatgggtaatcaggcgcaagtacgcgaaggtgcgaccgttatgtccacctccacccgcaacttcccgaaccgtttgggtaaaaacacctttgtttacctcggttcggcggaattggcagcgatttgctccaaactgggtaaaatcccgaccgttgaagaatatcaagccaatatcggcatcatcaacgaacagggcgataaaatctaccgctatatgaacttcaacgaaatcgacagctacaacgaagtagccgagaccgtgaacgtttaatccccgtcatccgtatgaagtaagggattgaccgcaatgccgtctgaacaaccttcagacggcattgcaacattccgctaacccttctttccgcaaacgctgcaaatacggcgttcacgcccccacataaaggaaacgacagtgaacctgaaaaaccgccattttctgaaacttttagacttcacgccggaagaaatcaccgcctacctcgaccttgccgccgaattgaaagccgccaaaaaagcagggcgcgagattcagcggatgaaagggaaaaacatcgccctgatttttgaaaaaacctctactcggacgcgctgcgcgtttgaagtcgccgcgcgcgatcaaggcgcgggagtgacttatttagagccgtccgccagccaaatcgggcataaggaaagcatcaaagacaccgcccgcgtgttgggcaggatgtacgatgccatcgaatatcgcggtttcggtcaggaagttgttgaagaattggcgaaatacgcgggcgtacccgtgttcaacgggctgaccaacgagttccatcccacacaaatgcttgccgacgcactgactatgcgcgaacacagcggcaaacctttgaaccaaaccgcgtttgcctacgtcggcgacgcgcgttacaacatgggcaattccctgctgattttaggggcaaaattggggatggacgtgcgtatcggcgcaccgcaaagcctgtggccgtctgaaggcattattgccgccgcacacgccgccgccaaagaaaccggcgcaaaaattaccctgaccgaaaacgcgcatgaagccgtgaagaatgttgattttattcataccgatgtgtgggtcagcatgggcgagccgaaagaagtctggcaggaacgcatcgatttgctgaaagattaccgcgttacgcccgaactgatggcggcatcgggcaatccgcaagtcaaattcatgcactgcctgcccgccttccacaaccgcgaaaccaaagtcggcgaatggatttacgaaaccttcgggctgaacggtgtggaagttacagaagaaatattcgaaagccccgccagcatcgtgttcgatcaggcggaaaaccgtatgcacacgattaaagcggtaatggtcgcggctctgggcgactgacagaactgtgcctgtttaaattcatccgcaacacagataccgtctgaacacgatgttcagacggtatccatatatagtggattaaatttaaaccagtacggcgttgcctcgccttgccgtactatttgtactgtctgcggcttcgtcgccttgtcctgatttttgttaatccactataaaaaaactgcctacacgatgtgtaggtagtcccgtttgaaaacaatcagtttttgtcttggtcaaccaatttgttggcagtaatccaaggcatcatggcacgcagttgtgcgccgactttttcaacttggtggtcggcattcagacggcggcgggcagtcatagacgcatagttgacattaccctcttggataaacatttttgcgtattcgccggtttgaatgcgtttcagggcattgcgcatggcttctttgctggaagcattgaccacttcagggccggtaacgtattcgccgtactccgcattgttggaaatggagtagttcatattggcaataccgccttcgaaaatcaggtcaacgatcagtttcatttcgtgcagacattcgaagtaagccatttcaggcgcgtaaccggcttcggtcagggtttcaaaacccgccttgatcaactcgaccacgccgccgcacaatacggcttgttcgccgaacagatcggtttcggtttcttcgcggaaagtggtttcaatcacaccgcctttggtgccgccgttggcagccgcataagacagggcgatgtctttggctttgccggaattgtcttggtaaacggcaatcagagaaggcacgccgccgccgcgtttgtattcactgcgtacggtatggcccggacctttgggggcaaccataatcacgtccaagtcggcacgcggaacgatttggttgtagtgcacgttgaagccgtgtgcaaatgccagcgttgcgccttctttcaaattggctgtaacttcggcgtgatagacggcaggcatggtttcgtcaggcagcagcagcataacgacatcggcttctttggtcgcttcagcaacggttttgacgacatgaccggctgcttcggcttttttccaagaagaaccttggcgcagaccaatcaccacgtttacacccgaatctttcaggttggcggcatgggcatgaccttgcgaaccgtaaccgatgatggcaacggttttgcctttgattagggacagatcggcatctttatcgtaatagacttgcatttgatttcctttaaggtaaatggttgtcgaagccttaaaatgttgagcggcttcggacgggttaaacagagtgtgccgcttaatcggcaacttcattcatcaatacgatttccaacgcttcggttttgccgtcgacggactggacgaaggcttggaaatgcgcgctggcgttatgttcgtcaatagctgcttgagatttccaattttccacgaaaacaaaacggttcggtttgccgatttcctgatggagatcgtagctgatgttgccctcttctgcacggctggctttgaccagttctttaaactgtgctgccagtgtttctgtgtattccggtttgacggtaaccagtgcgacaattttaatgttcgacataaatctctcctgccgttcgtttttcagacgacattcaaataccgtgccgtctgaaaggttacggcgttaaattttcaaaatacgctcaccgcgaccgatgccggccgcgcctgtgcgtacggtttccaaaatttgggcgcgtccgaccgtttccaaaaaggaatccagcttgtctgtcgagccggtaatttcaatcgtatagctgcggtcggttacgtcgatgatgctgccccggtagatttcggtcaagcgtaaaaattcgtcgcggtctttgccggcggcacggacttttaccaacatcagttcgcgttcgacaaaacggctttcattcaaatcgaccactttaatcacttcaatcaatttattgagttgcttggtaatttgttcgatgacctgctcgtcgccgtgggtaacgatggtcatccgtgacagggttttgtcttcggtcggcgcaaccgccaaagaatcgatattgtaatcgcgtgcagagaacaaaccgaccacgcggctcatcgcacctgattcgttttcaatcagaacagataagatatgtcgcatttgtctctccttacgcctttccgtccgcacgcatatgcggcggaagtaccatttcgtccaaacctttgccgttgccgaccatgggcatcacattctgtttctggtcggtcaggaagtcgataaacaccagcctgtctttttggttcaatgcttccaacaacgcaccttccacatcagacttcttgtccacgcggataccgatatggccgtatgcctcggcaagtttgacgaaatcgggcaaagaatcgaaataggtttccgactctcgtccgccgtaatatatttcctgccactggcgtaccataccgagataaccgttgttcagcgtaatgacgttaaccggaatccgatattggaaacaggtggacagctcttggatgttcatctggatcgagccgtcgccggtgatacagaatacgtcttgatccggggcggcaagttttgcaccaatcgcataaggcagacccacgcccatcgtacccaaaccgccggaattgagccattggcgcggacgttcgaagggataatattgagccgcaaacatttgatgctgccctacatccgatgtgatgattgccgaattgccggtaatctcggcaagcttctgaatcacatattgtggcttgataatttcgctgccgttgtcaaaccacaagcaatctcgggaacgccattcctctatggttttccaccatttgcccaaagcatcttcagacggcacggactcttgtttttgccacagcgcaaccatctcggacaaaacgtttttcacgtcgccgacaatcggaatgtccaccttcacgcgtttggcgatgctggaaggatcgacatcgatatggataaccttcttcgccttctcgaaaaatttggacggtacggaaaccacacggtcgtcaaaacgcgcacctacggcaagaacgacatccgcattctgcatggcaaggtttgcctcgtaagtaccgtgcataccgagcataccgaggaattggcggtcgccggaaggataagcgcccaagcccatcagcgtacccgtgcacggagcacccgtcattcggacaaatcgggtcagctcttcagaagcattacccaacaccacgccgccgccaaaatagacgaccggacgtttggcagatgccaacatctgcacggcctttttaatctgaccgatatgtccttgaacaaccggttgatacgaacggataaaaatgtcttcctgaggatagctgaatttcgccatcgcctgcgtaacatctttcgggacatcaaccaccacgggccccggtcggccgcttgcggcaatttggaacgcctttttaatggtttccgccaactcattgatgtccgtaaccaggaaattgtgtttgacgcacggacgggtaatacccaccgtatcaacttcttggaacgcatccgtaccaatcagggaattgcctacctgcccgctgatgaccaccatcggaatcgaatccgtataggcagtagcaataccggtcagtgcattggtaacgcccgggccggatgtaaccaatgccacgcccaccttaccgctgacgcgcgcatacgcatctgccgcgtgtactgccgcctgctcatggcgggtaagaatgtgtttgaatttattgagttggaaaagggcatcgtagatttcgataaccgcaccgccgggataaccgaaaacgtactcgacaccttcggctttgagactctgcactatgatttgcgcgcctgataactgcataacgacctcttttatacggtttcaaaccaatagggacaaaccgctttgccacagcacctgtaatgcaattccaccaagcagcgatttagggtacgcgcattgggggaacacggcaacagacggattatccaatcaattggaaaggaacacagagtttgtgaaaaagagtagaaacgataacgcaaaccgacagttcaatcaagaaaaatctttcatcttttaatattttttgaaagcagagaaattattgattgattttaaaagaataaaatcaggagtaccttttttgaaagatggaaattgttgacagtttgtgtaggaggggcagatgtgaaaaacccttcttcgatatcaagaattgtaaaatttacagggtttcatcccaataaagactcgggatattgattgaacttgattttatttttgatatatcaaaaatattcccaaccatacttcctgaaaatggctcattgcaccggactgtattggacggcattgacagaaccaagagggctaacaacgacttaatatattgattgtatagtggattaacaaaaatcaggacaaggcgacgaagctgcagacagtacaaatagtacggaaccgattcacttggtgcttcagcaccttagagaatcgttctctttgagctaaggcgaggcaacgccgtactggtttaaatttaatccactatatttagttttatctatttcattaaacagcaatagacaaaaaaaataaccgctctaaaagcggttgtggtgcccagggtcggactcgaaccgacacaccttgcggcgggggattttgagtcccctgcgtctaccaatttcgccacctgggctggtgaagaagtcgtcattataatggcttttgaaattctgtaaaccttttttttgaaattattttatctgtttttattttatttttgattttaaatagaatttttattattttaatcttactgttctttccgctccaaagattctgtatgattcggcaattcctgccgtgcagacaacgtaaaaaaatactacattaaatctgccaaacgcgttaagatggaaatattcaaattccgtacgaatcaggttttgctatttattcttgggagattgtcatgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctgataaaaccgtatgccgtctgcaccgtcggcgcctattcagacggcattattgtttcaaccgacaaaggacatccacaccatgcaggataatgctttgaccatcgccttatccaaggggcgcatttttgaggagacgctgccgctgcttgccgctgccggcattgttccgactgaagagcctgaaaaatcgcgcaagctgattatcgggacgaaccatgaaaacatccgccttgtcattgtccgcgcaaccgatgtgccgacttatgtccgctacggcgcggcggacttcggcattgcgggcaaagacgtgctgatcgaacacggcggcacggggctttaccggcctttggatttggagattgccaagtgccgcatgatggttgctgtgcgtaaagggtttgattacgaagcagcttcgcaacccggatgccgtctgaagattgccacaaagtatcctgaaatcgcggcatctcattttgccggcaagggtgtccatgtggacattatcaaactgtacggctcgatggaacttgcgccgctggtcggcttgagcgatgcgattgtggacttggtttcgacgggcaacaccttgaaggcaaacggcttggaagcagtcgaacacatcgtcgacatttccagccgcctggtggtcaacaaggctgctttgaaaacgaaatacgcgctgctggagccgattattcaggcgttcggcggcgcagtgaaggcgaagtaagcatccatttgaataaagatgcgttttcagacgaccctatccgttcccgccgacaggtcgtctgaaaatatcaccggcagtaaactgtataggagaagttaaaatggttgcaaaaataaaaaaattctcagattcaaccctttccgttttgaataacggcgagcgtcggttttatgtctattgtctgaccgacctgaaaaaagacaaaatcctctacatcggcaaaggctgcggtaatcgtatcttcgagcatgaatgggttgctagtcgttcacaagatccagtctccggcgagattatcgatcggaaactcaaagccatctccaaatgcaagaaactcggtcgctatatcatcagctatcatctgactgaagtcgaagcactcgccgccgaatctgccttaattcattttgttaaatctgtcttgggtaaaaaactcaaaaataaaattgccgggcatggtccgggtggtattagcgtagaagaactagatcgccgctttggattctcttctctcccacttaacgagattaaccccgacgggctgattctcgccatcaaaatccacaatgctttcgatttagatactgacgaagaattagactaccttttcgacaaccaagacgatgccaacctcaaatcgcgtacgttgggcaactgggttatcggtaaagatgttgcttcaaaagtgaaatacgttatcggcgttcacaccggtctgcaaaacgctgttgtcagtgcatacgaagtggacggttttgaaacaatggttgaggaaaccaaaaacggtagaaaacaatcccgttaccgtttccgcactacctctcgtagcgaagaggtattagccaaactcggtctgcaacaaaaatgcctgcccgaattgaagtttggtagcgggggagaaaaagcgtatatcagacccaaaacagagacagaaactgaacaagagaatattcagacgacccccaatccaaaaataaaaaaggaaaaaaccaaatcatgaaaaaactcaacacccaatcgcccgatttccaagccggactcaaagccctgctggcttttgaaaccgcgcaaaaccccgaaaccgaacgcatcgtcgccgacatttgcgccgacgtgcaaaagcgcggcgatgcggctttgattgaatacaccaacaaattcgatcagacaaacgctaaaagcatcgatgatttaatactcacgcaagccgatttgaacgcggcgttcgagcgcattccgaacgacgttcagacggcattgcagaccgccgcccgccgtgtcgaaagctaccaccaacgccaaaaaatggaatcgtggagctacaccgatgaagacggcacgctgttgggacaacaaatcacaccgcttgaccgcgtcggcatttacgtccccggcggcaaggcggcgtatccgagttccgtcatcatgaacgccatgcccgcccacgtcgcaggtgtgaaagaaatcatcatggtcgtgccgacaccaaaaggcgaacgcaacgacatcgtacttgccgccgcatacgtcgccggcgtaaccaaagtcttcaccgtcggcggcgcgcaggcggttgccgccctcgcctacggcacggaaaccatcccccaagtcgataaaatcaccggtccgggcaacgccttcgtcgccgccgccaaacgccgcgtgttcggcgtggtcggcatcgacatggtggcggggccgtctgaaatcctggtcatcgccgacggcacgacacctgccgattgggtggcgatggatttgttcagccaggccgaacacgacgaaattgcccaagccatcctcatcggcacgtcgcaagcgtatctcgacgaagtagaagccgctatggaccgcctgatcgaaactatgccgcgccgcgacatcatcgaagcctcgctcggcaacaggggcgcgatgatactcgccaaagacttggacgaagcctgcgaaatcgccaactacatttcccccgaacacttggaactgtcagtcgaaaacccgcaggaatgggcgaaaaaaatccgccacgccggtgcgattttcatgggacgctacaccggcgaaagcctcggcgactactgcgccggtccaaaccatgtgttgcccaccagccgaaccgcccgcttttcctcgcctttggggacatatgatttccaaaaacgctccagcctgattcaggtttcggaacagggcgcgcaaaaattaggcgaaaccgccagcgtgctggcacacggcgaaagcctgaccgcccacgcccgcgcggcagagttccgtatgaaataatgccgaaacggcgtacaggcatattccaaccattaaggaaacacgatgaaatccgtccgctccttcatccgcgacgacatacaagctatgtcggcatatcagattgccgacgttccgcccggctttgccaaactcgattcgatggaaagtcccgtccacccttttgccggacatgaaacgctgttgcaggaatggcaggcacggcttgccgccgcgcccatccatctttaccccaatccctccggcagcggtttacaggaagcattacgttcggcgttcgacattcccgactgcgccgacatcgcgctgggcaacggttcggacgaactgatacagttcatcacgatgctgaccgccaaaccgggcgcggcaatgttggcagccgaacccagtttcgtcatgtaccgccacaacgccgcgctgtacggcatggattatgtcggcgttccactgaacggagatttcaccctcaacctgcccgccgtcctcgaagccgtcaggaaacaccgccctgccctgacctttatcgcctaccccaacaaccccaccggcgtatgcttcacgcgtgccgaaatcgaagccgtcatcgaagcttcagacggcatcgtcgtcgtcgatgaagcctacggcgcattcaacggcgacagcttcctgccgcaggcaggcaggattcccaacctgatagtcttacgcaccctcagcaaaatcggttttgccggactgcgtatcggttatgcggcaggctgccccgaagtcatcggcgaactgcaaaaaatcctgccgccctacaatatgaaccaattgagcctgaccactgccaaactcgccctgcggcactacggcattatctctgccaacatcgacagcctgaaaaacgaacgcgaacggatgttcgccgaattgggcaaaatatgccgtctgaacaccttttcaagtcaggcaaacttcattaccatacgcgtacccgatgccgatttgttgtttgacacgctcaaacaaaaccgcatcttggttaaaaaactgcatggcgcgcacccgcttttggaacactgcctgcgcattaccgtaggcagccccgcacaaaacgatgccgttctcaacatcattcgccaactttactgccaaccaacggatttcctatgaatttgactaaaacacaacgccaactgcacaactttctgaccctcgcccaagaagcaggttcgctgtccaagctcgccaaactctgcggctaccgtacccccgtcgcactctacaaactcaaacaacgccttgaaaagcaggcagaagacccagatgcacgcggcatccgtcccagcctgttggcaaaactcgaag

SEQ ID NO: 33 - DNA, 18974 bp, Neisseria meningitidis
ataagtcggacaaagttattgattgattctcttttttctggaatagaagaattaaacatgatatttggctaatctcattttctgataattcagaaatggtaattaaagaatccctgaaagatggtcataaaatatacaaatttgaattttgcgaaattgtcgataattgcaattttgatgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaagtgcgcctgttgccgcctaaaaggtaccccggatgcmtgattatcgggtatccggggaggattaagggggtatttgggtagaattagggagtgattggtagcggaaatagacgaaaacctgtgtttgggtttcggctgtcgggagggaaaggaattttgcaaaggtctcaattagtatagtggattaacaaaaatcaggacaaggcgacgaagccgcagacagtacaaatagtacggaaccgattcactcggtgcttcagcaccttagagaatcgttctctttgagctaaggcgagccaatgccgtactggtktttgttaatccactataaaatcgagtttatcctagctgtccaggacagcccctattttttcataaccatcacgaaaggaattttgcaaagattttattccatctcaaaacaatcatctcaaaaatgcgtttctgaccgccggtaaaacaaaaccctctaagaaaatacttagagggttttgaaatttggctccccgacctgggctcgaaccagggacctgcggattaacagtccgtcgctctaccgactgagctatcggggaacaagcgcgaataataaaacagaaataccgaacgtgtcaatataaattgacaatcgattgcactttatctgcaagcccgcaatctttatatgttatatggcttccgcaatatgccttgccgcacgtttggcatccaataggattaaaccaagtctgccggtttcttttgccaccagcaccaacacggcatctttacccgcctgacttaaaaggatatagcctgattttcctttaatcatcacttgttccaattccccgcaggcgagttcctgcaccgagcgactccccaaagcaagcaaagtggcagaaatcgcccctaccctgtccgaattcaaatgtgaaggaagcattgtcgccatcggcaatccgtcggttgagataacggcagacgcgataatatccgtagatgtattgtttaaatcttcaaggattgaaatcaataattgctgcataacccctcctctctcccaagttttacacgcggttgctgtaacggcggtataaaatccttaccaaagtaacaaatgcctctttgcccaaatcgggaatgccgccgataaccaaaataaatttggttgaaccgatatacaatgggaaaaatgtcaattcgctctgaccggaaggatcgcaaacgccccaagcgttattgttgatatacaggttgttcttaatcagcagccggtatttcttttccatctgtgcgacttctgccgccaacaaccccaactcttccgccgcctcatgatggaaattggcgttggcaagatacagaccgttccgatcgaccaataacgccttaccgctgccggacaattgttccatcagcaacggcaattgctcgtccgacaaattgatgccgtctgaatgaccgttttcatcgccatagaggaattcgagtttttgcaaacggtacaacaggttcaaagcggtatcgatgtcggcggtgtccgcccaagtaagcagcttctcactgctgaccatttcgtccgcatctgctttcaacaggctgtgcaacaaagttttaccggcactgggggcatcgctggatacggcataaaatgcaccggcaggagtcaggcggggatataaatttgcttgtagtgaaagtgttgattccatattaaacctccagtcccggatcaatagaaaataacattgcgctaaccaattgttttacgtcatcttccttacgggcatcaatttcaaaaaccggaacattaagattatgttttgcaagatatttgtgatacacgtcgataccgggctgagagcgtatatccatcttggtaataccgacaacgacgggtgccttctccagcagccctcgaaacgaatgtaaaaagaattccaaatctttcaacggattggttcgggcattatctaaaagcaagaccaaacccatactgccttggcttaagatttcccacataaagttgaaccgttcctgaccgggcgtaccatataaatggactttggtatcctcatccaagctgatggccccgtagtccatcgccactgtcgtattccttttcctatccaaagtcatatcggatgcggaagcatcggtctgaacgagtgcttcgtccgaaatagccgcaatggcagtggttttccctacgccgacaggtcctgtgaaaataattttattttctctcatctctccgcctcttagctgcccaacagttttttcatcagcctttgcagaaggccgcgcgactgggattgggatggtgttgtgattttttccgcttttttcatcatttcactatcagaggcagaatcggctccgatatttattttatccgccatatcggagtatgcctgttgtgaaaccgtttttaaatctaccgacaaaaacccggttgtataggttgccgcaagataattcagaatatcattgaggtttaaaggcatcactttatacaacacgttaaggttgacggatgccttggtcagaaatgccgacaagcgtatcgaccccggcacatttgccaaccgggtcaggtttggccaagatttcaacgtaaacggagtatcgggagaaatcggataaatcaacctgccctgcgctgtccaaatggaaaactgccacatacaggacataatgcctactttagccttttcgcgccattgcgggttatcgggaacagtcttgcagctgacctgcaaattttcgtctttgcacaattcttcgagtttttgcacactttctgtcagcaaaacccgttgtatcgaggggaaaacaataaggaccggcttatttccatgcaagatagcgatgtcctgcctgttcttttccgcaaaccgcaacgcccccaataatcctttattcgggttaaactggcgtatcgtaaccgtacgctgcacattcccgttatttttcgccgaccggtctgcgggtgcaataaacgatttcccataaacattctcgccctgcaacaatttgcggagcataggaaacaatgtttcaaaccgaatcggtttgggcaggtagggaacttcagaatcgggaactttctccgaacagacggcgacgggtatatccttataacgctcggcaagctctttccaaagttcaaaaccgccctcggcatcggtatccgccaaaaccaaatcgggcacggcactgccgtctgaaggggatactgtttcataacgggtggtattgtgcattttgaatgccattttgaaaacggattcctgctgcgccgtcatccccgccaacattacgcgtactgttttaattttcggcagttgaacttccatttttattttccgtaccgttttatttttttaatattttgattcatacgctgcagcagccggctcatcagcataacgacctcttcaggaagcctgtccgcacgttccctcaatacccttaaaaactgccccaacctatcccaatcttcagtacgttcataaatatcgatcaacgtaatataaagctgggactcgtcgggatatttcaataccgcctgctccaacacatccattgccgcttcaatctgaccatacatcagcaacgactctacttccttaaccgcatcgtctgccggagacgaaccggtgttaatcaacgaagaatcttgaagcaccaaatcccgatgttgcgatttgaatttctgtatatttttcggcagatacccgtgccccataccgatgtctttgatttgccggtcgttcggccctttttccaaatcatcgaaaacttcatggtaacccaagctgtacccccaccccagcatccgctctttaacctgcctgccgtagttgcccaacgtttggtaaagtttccacaaatgtccggcaaaacggtctatgtccgcgtgttggtaatcgagtttcaacgcatcgataatcaggtttgcaggtttttcggaagtttggatggcacggtcgtattgtttcgatgccgtttcatagctgactttgtctttaaggattttcgcaccttgatcggcacggaccaaaccggcaatcgcaccgatttcctcttgactgattccggacacgtcttttttgccccgcacaatcgggatgcgcttgatttcttcggcttcataagccttaccgccggcatccggcgggggcgatgcggaagctgccgtcgcagaaccgccttccgcacgtttttcaatctcctgagtaccccatcccaaaccttcttccgccaagacgcggatacgcaaatggtttgaatcgcgctgtaatgcctgttcgatatattttgccaaaagttcggaaagaatcagtttgccgtatttttgcagattgtctgccaaaacatcgacatcccccacttcgagattgatatcgagcagctcgcggataaggttttcaggtttcgcttcaccatccggaatgccgtccagataggcagccaaagattcggcagccttgccctgataaccgaattgcttataaacctgatactccgtaagcggatcgacttcttgcgcggatacggcggcggatgcggtctcggcactttcgttccaagaccagtcgggttgcgtgccgtctgaaaccgattgtccaatctgatcgacccagtccgaatcattgcttccgggtgtctgcccctgcgtattgccgacaccttgggatttgcgcttcggtgttttcttaccctgcttcgcacgcataaccaaaagcatcagcaataccgccagtgccaaaccgataattaatgagttttccaaaggatactcccgataccgtaacgagcggatagctgaccgcctgcaacggccattgtccgcttttattattaacgatttactgaaatagacttgtaagttttaaatcataccataatttaacgtttaacaatatgccttctgcacaagcctcgccatattaccttttacccacatcagtatcaatacccgatataaaaataactttgcccataagctgccttattgcctgcccgccgcagagtagcgcgcgataaaaaataacggatgataagtcaggcgcactttgcccgacggcataccgaacgccgacaagtaatcgccaataaatccattgagattttttcttgtccaatttttttggttcgtggctgttacgcctgtatatttaaggtgtttgagtacatctgacggcgtatcaaagtctagtattaccgtaaaatcctcacaccataaaagctcaaaatctttggctaaccaagcctgccattgggataaagtcgggtaatttaagcctatatttgtaatttggcggacttcttttaaattgtctttgccaaaggttgcaaccgccaataatccgtttgttttcaagcctgttttgcaatgggtgataaaagcgtcgggttgatgaaaccattgcacggcagatgcgcttgcgattaagtcaaattgtcgttgaaaaggaaagttttccgcatcgccgcaataaaaatcaaaggattgcggcagtttttcagccagttggggctgcacattgcacaaatcattaaataaccaataattcgctgaaatctgtttttgcagcaaggcactcaacattcctgagccgcagcccaattccaacacgttttccaatggcatatccggcaaataatcttgcaaatgcgtcattaaattaatcgtcattttttgttggattaaggcgtgccggtcataatcgtttaatgctttttggaaagcctgccgaatgcgcgatttatttatggcagtcagtgattccatagtgccgaccaatgggtgaatcttgaaaacaggtaatgtccgacgtcaatttcccgaacggtgcaacgcggtgtccaatatcggtgctgattggcaggcataaaaattttatcgcccgatccgaccaaggcatttgtccagcggataagatctgtacgtctatcttgcccgatcatcgcaaaaagtgcgataagttcttgatgaatttcgccaaacgggcgtgcgggaaattgttggtaatcttcaaaagatgctttatcgccacacattctgcgttcaaattttaaacgggtgttttccgtgaggttctccaatgtgcctttaaaaacggtgcaagggataccgaaattatcatcgcaaggcaaacctgtgccattcactgccgttgcggattttaatcttattccttgcaatgccctctctgccgcccaaacgcccattgaccacgccaccaaacggatgtgccgataggcggaaaaatcaaaatccaaatttaaatcttgataatcatagcaaatcaataaatcgtgattttccggcaaaatcaaatgatttacagcatcgggcggcgttccccaacctgcaaaatacaggattaaatgtccgccttgatgattgtaaaattttgtttccatatcatatccttacaggcacgccgcaaactgccgcacttcatccgttgtcatatctgccgttaaagacaggcggattctggatgtgtttttgggtactgtcgacggtctgatgggcaggcaataataaccctgcctttgcaggtattccgctttggcaagggtggcttcattcccgcctaaaatataggggacgatacaggtttggctcggcattatttgcgtccgatgcgccacttcccgccgtaaaaatgcgcttaactgctcaagatggcttctttcttttgagaattgcggcaatcgttcaaaaataaaataagtccaagccacattaaacggcggcaatgcggttgaaaaaatcaatgggcgcatttgattaatcaaacattctttcaatacttggttgcagacggcatacgcccccaccgaggctaaggctttaccgaaagtgccaaccaataaatcaatctcggcaatcaaattatcccgttcggcaatccccaatccgttttgcccataaacaccgattgcgtgggcttcatccacataaagataagtattgggaaactgtttttttaattggacaagctgtttcaaatccgccacatcgccgtccatactgaaaacagattcggtaacgataaaagtgcggtcaaattttccgacgtttttttcaagcagatttttcaaatgttcataatcattatgacgataacggaaaaacgcacaccggctcaaacggatgccgtcaatcatactggcgtgaacaaatttatctgccaaaatcaaacttttcgtcgtcgtcaaagcaggcaaaataccgagattggcgtgatagccgctgttgaacaataacgcgctttcccgttggaaacgttgtgcgacaagctcttccaaatcggtataaataggaaagttgcccgttaataaacgcgatgaagaactggtaaaagagggaaaattaccgccgtattgctgcaaaaaagaccggcgcaagttttcatctgatgccaaacccaaataatcattagacgacatattcagcattttgcggttttcccgcgtaatataccgcccttgatgaatcaaatccggaatcgaacgatattggttttgcgcgccgagttgttcaagctgttgtttaaaaaccttcattatgatgtaaatattcctgagttaaagcctgaaccaacccagcatcaaacaatcaagtaatgcccttttaataaaaaccgttttgccgccgacctttgccacacccctgccttcataatccaaggcggaaatttccgcgacatttgtttccgttgccattacccaatccgtccgcactgtaccgaagcgcatattttcgcacaaattggtacggtttcaggtatgatttgccgaaaacctatcggacacacaccatattttgatatgaataaaacaatctgccgcactgctgcactattgataagcggtttttcatacgcaaacaccatcattcccgatgtctcccccgtcgcacaaggtcaacatgtcttcattaacatccctcagcaacgcctgttcctctacaccgacggcaaactgaccaaggtttatcccgttgcagtaggtcgggcgatgacgcaaaccaatctaggcgaacataaaatcggtgcgaaagcctataaccctgtttggtacatccccaaatccatacagaaagaacgcggcgacggcgtaaaaaccatagccgccggcccggacaaccctttggggccggtttttgtccgcttaggcgaccccaaactcggtttgggcatacacgggaccaatgcgccggccagcgtccccggggttcggagtcacggctgcgtccgcatgaaatcgcccgacgcgctcgagtttgccaaaaccatcgccagcggctcgcccgcctccgtcatctatcaaatggcgggtctcaatgaagatgcggatcgcaacctgtggcttgccgccttccgcgacccttacggtaagaacaaccttgacatcgcctctctgaaaaaaagtattgcgcaatgggcaaaaacacagggtaaaaccatcgcgcccgagaaagtcgatgctgtactcaaagaccgcaccggatcggccgtctgcctgacctgcggcaaaaacggcaagatgaagatgccgctcaaatcgctggcgtggatacagggttcttcctcatacagccaagctgaagtcattgaacaaactgaggaaaccaactctgccgaaatatccgagacacgcacgcccgaagtgcctgatgtacacacgcccgaggcacaaccgcatttaaatacccaatccgacggcacgccgactgcctataccgaaccggctgccgattcatcgccgcaagtagaaacacctgatcaggctgcttccgagccggttgatgtattattttcaatagatgtgatacggcagggaaatttgcgtttaggtaattgaataaccttctgattatttaatgcttatgtttatcagaagttgataggcggtttggtttttgtttggcttttcctacaccgccgcctgccgctttctgcaacattcaagcgcacaaatatgccatctgaaggctttagacggcatatttcacgataatagtcgcccaatcaaataaacacagattggaaatttattttatttttcccttaccaataccccagaactttccaccaaatgctgccgataacgaaaaaaatcagaaaattgactacgctcatgataaaacccgccttccaccattctcccattgtggtgtagcccgaaccgaaaatcacaggcgaagtaccggtcgcataatgagtgagggtcatcataatgttggatgcggccgccatcatcagcgcggtcggcatcgccggggcattcagtgaaacggcagcagcgaaaaatgcgccgaacatagcggtaatatgtgcagtagtactggcaaacatataatgcgcatacatataagcaagcacgaggattacgcccgcagccgtgccgctaacgcccaaaccgccgacactttccgccaacactccggagaaccatttaatcagtccgagtttatttaaaaatgcggccatcataatcaatgcgccaaaccaaataatcgtatcccacgcgcttttttctttcaaaacatcgtcccaagtcaatacaccggaaagcaaaagcaggcttaatccgataaatgcggtggcggtggcgttgatactaaaagcgtgattgccggtaataagggcgggaacatctgcccacaacagcagcaagataccgaaaatgaccgccataatgatttcgtctgccgacattttacccatctccctcagacggtctttggcaaattgaacggcattgggcgtttctttaatttcaggcggatacaaaaaatataaaatcaaaggcataacgaaaaaggcgataacgccgggaacagccattgcccacgcccacgccccccaagaaagacggaaactactgcctaaattttcggcaatcaagttgacgattaaagggttgggggcagttgcagtaataaacatagccgacgaaatgggattggaatgatagttgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcgcccggtttgtcggcggttacgccggttactgcgaccaacccgacggcaataatcgacagcgcgcccaacggcatggccttgccgataatggcggcaatcacaccgacaaacatggccagcagcgtccaagcctgaggcttgaccccgtcgggtacgggcagtgccaaaaccagggcgcacaatactgcggcaatggcgaggggtatcggtttgaaacccaatttcatcatattgacctccgtaaaaaagaccgtcccgaaaaatcggaaaaataatatttaactaattgttttataagatatattctgatatttcaccgtctttccgatatgcggctccgggcaacttttgtttcagtatttgaattttcattagactgaatacgccgtttgaacggcacggcgaaaacccgggggatgccggacgttcagtcctttttcgcaccttgaaggtaaagcatttccaaggcaattgtggcaccggccaaagcggtaatgtcggattggtcgtaagagggggcaacttctacaacatccataccgacgatgtcgagatccgtcagcccacgtaggatttttaatgccctgtcgctgctcaagccgccgcatacgggcgtaccggtcccaggggcgaacgacgggtccaggcagtctatgtcgaaagtcaggtaaacgggcatattgccgacggtttctttgattttacggacggtctcttcaacactgtcttcattgactttaggggcggacaacacagtaaaaggcaattttttactgtgttcggtgcgtatgccgatttgtacggaacgggacgggtcgatgaggccttccttgggggcggtatagaacatcgtaccgtggtcgtattcgctgccgttgtcgtaggtgtcggtgtgcgcgtcaaaatgaatcagtgcgagtttgccgaaatagcgggcgtgggcgcgcaacaacggtagggtaatgaaatggtcgccgcccaaactcaaacagcgtttgccggaagaaagtaatttgccggcgtgcgcttccattttttcgacaaaatccctgctgtcgccaaaagaaaaaaccaagtcgccgcaatcaataatgttcaggcgttcgcgcacatcaaatgtccatggaaacctgcggtgctcccaagcgaggttgacggaggcgcgccggatggcttcaggaccgaaacgcgcgccggaacgccctgaaaccgccatatcataaggcacgccggtaataacccaatcggcatgactttcatacggcataaaattaagcggcaggcgcaaaaacccgaaattattggaaacgagggagttgtcggtttgtcctgccagtgtgctgtattgcatcgtaatgattccttgtaattggtttcaatcggtcgtgatgattggtgtttgagtaagaaaatcgggcttcagacgacatatccgatgccttgatgcgtctattcgtcttccaaataggtataaccattaagccccgcttcgagttcttttaagaaagacatagcctgcgaggcaggaaggtctgaatgttcgatttgttcgcgatagcgtttcatcagctctttcggatcttgataaacgtattcgagcatatcggcaacggtgtttccttcatcgtaatcgatgacggtaaattgtccgtcttcccctacaacaacatcggcagtggcagtgtcgccgaaaagattgtgcatattgccgagtatttcctgatatgctcccaccataaaaaagcctaaaagcggcggctcttcttcgggataatcaggcataggcatcgtaccggcgatgccgtctccgtcgatgtagtggtcaatcgtaccgtctgaatcgcaggtaatgtccaacaacacggcgcggcgcgcaatcggttcattcaaaccggtaatgggacaaacagggaaaagttgatctatgccccaagcatcgggcaaagattggaagagtgagaaattgacatacagcttatcggcaaaacgttcttgcaattcgtcaataatggttcggtgagaccggtgtttttcattaaacaattcgccgacttcatgacagatatttaaatacagttgctccgcccacgcacgttgcgccaaactcaacagcccgacattatactgattatgcacatcagcaagatcaaactgcccttcgtgtatccagctgcgtaaggaacgtttttcccgcgaggcggaaatatccgtccaagtttcccacatactgtgcaacacacgcggtgcttcgggcgatggcgcatccagccggcgcggtttgtaacgttcaacgcctataacattagcaaccaaaacggcgtgatgtgcggtaatgccgcgcccgctctcggtgatgattgtcggatgcggcagcccgtgttcgagacaagcctgactgatgccccatacgactgtggcggcatattcgttgaggctgtaattaacggaacaatccgattgtgtgcggtttccttcgtaatccacgccaagcccgccgcctacatcaaaacagcggatatttacccccagtttgtgcaactcaacataaaaccgagccgattcgtgtacacctgtggcaacatcacggatgttcccaagctgcgagcccaaatggaaatgcaaaagctgcaggcaatccagcctgtttttttgtttcaaaatatcgaccagttgcaaaacttgggaagccgacaagccgaattttgatttttccccacccgaagactgccattttcccgaaccttgggaagccagtctggcgcgcacacccaaacggggcttgatgccgagtttttccgcctcttccaataccatttgtatttcggacagcttctcaatcaccaaataaacctgatgccccagtttttcgcccatcaaggcgaaacggatatattcacggtctttatagccgttgcagacgattaatgtttgccggttgccggcgtgtgccaaaaccgccatcagttcggctttagaaccagcttccaaaccatgcggttgtccgcttgacataagcgattcgatgacgcggcggtgttggttgaccttgatagggtaaaccaaacaataaccgcccttatagccgcactcttcccgtgccgtctgaaaggcgcggttaatgtcgcggaggcggtgttcgaggatttgcggaaaacaaaacaaaacaggcaggcgcgcctgatgtttttgttgcacggcttcagtcagtttttgcagtgaaacagtttgattgtgttgcgagggattggggcggacgatgatttcgccggaatcgtcaacatcataataacctatgccccaatgattaatgttgcacacttcacggatggtaaggataggcataataaacctgctccgtctgtcgtgttgaaaaggaatgattataacaaatcagcgtgaaatgtcatttttttaataagaaaagcctgcctcatacctgatgaggaacaggcaaaatgccgtctgaacgcttcagacggcattttggttcatctttccatcaaaggagtcagcgatcgagctgctctttgatgattttcaggtcggggtaagacaacacgatgtcgtattcgcggccgtctttataggcttccacttccagcacaggcttaccccaatggtcgtcggcatcgacatcgtaaacctgataaccgcgctgctccaacattttcacagcttttgtgcggttttgttcaaaatggggatcgccgtaaatctgacgctcggcagagtcgccggcaaatgcggcagcggcactcagagaaacaacggcagccaataacagttttttcattttcagtcctttttttatcggttgattgaacaagatgtgtttttcaataccgccattaaaacacagcaaaattaggtttgaattagagggaagtcaagaagcgtaaatgccgtctgaaaaaaacagagccgtcaaacggctccgttttccttatacttctttagtttcggttgccttctggcgcaaacgcaaacttaattcacgcaactgcttgtcgtccacgctgttgggcgcgttggtcagcaggcattgggcgcgttgtgttttcgggaaggcaatcacgtcgcggatggattcggcaccggtcatcagcgttaccagacggtcgaggccgaatgcaagaccgccgtgaggaggtgcgccgaatttcaggttgtccaagaggaagccgaatttctcttgttgctcttcagggctgattttcagcgcggcaaacactttctcttgtacgtctgcgcggtgaatacggatagagccgccgccgatttcccagccgttcaataccatatcgtaggcgcgtgccaaacaatttgccgggtcggaaaccatcaggtcttcatgaccttcttttggcgcggtaaacggatggtgtacggcaacgtagcggtcggcttcttcgtcgtattcgaacattgggaaatcaacgacccacaaaggtttccattcgtctgtgaaatagccgttgtctttgccgtgctccaagccgactttgatacgcagtgcgccgatggcttcgttcacgactttggctttgtctgcgccgaagaagatgatgtcgccgttttgcgcgccggtacgcgcgataatttctttcagggcgttttcggacaggtatttcacgattggagattgcaggccgctgtcttcgccgttggaaaggttgctgacatcgtttactttgatgtatgccagacctttcgcgccgtagatgccgacaaatttggtgtattcgtcgatttctttgcggctgaattctgcgccgttcggcacgcgcagagcgaccacgcggccgcctttcatgtcggctgcgccacggaagactttgaattcttccgttttcatcaggtcggtcaactcggtaaatttcaagttgatgcgcatatccggtttgtcagagccgtagtagaacatggcttcagagtaaggcatgcgtgggaagtcgcccaaatctacatttaaagcatctttgaagacttgtttggccatgccttcagtgatgtccatgatttcatcctcgtttaagaacgaggtttccaagtcgatttgggtaaattcgggctggcggtcggcacgcaggtcttcgtcgcggaagcacttggtgatttggtagtaacggtcgaaacccgccaccatcaacagttgtttgaataattgcggcgattgcggtagcgcgaaaaactcgcccggatgaacgcggctcggcacgaggtagtcgcgcgcgccttcaggcgtggagcgggtcagcatcggggtttcaatgtcgatgaaaccttgcgcgtccaagtagcggcgaacgcccatagcaacttggtaacgcaggcgcaggttgcgttgcatcaccggacggcgcaagtcgataacgcggttggtcaggcgaacgttttcgctgatgttttcatcgtcgatttggaacggcggcgtggcggcggcgttcaagacttcgatttctttggcaaggatttcgattttgccggaaatcattttatcgttggtcgtgccttcgggacggttgcgtacgcggccggtaatgctcaaaacgtattcgttgcgggaggaatcggcagcggcaaacgcttcgggcgtgtcgggatcgatcacgacttggacgatgccttcgcggtcgcgcaggtcgataaaaatcacaccgccgtggtcgcgtcgacggtgtacccagcctttgacggtaacggtttggtctaagtattgctcactgatcaggccgcaatagttggtacgcataaaatcaccttttattgatttaaactgaaaacagaaaatgccgtctgaacggcggctttattgttgttcgggcaaatccgccttttcagacggcataggtcctgccaatgttttgacgggcaggtcgtcagggatgaccatacccagcgaaatcacatatttcaatgcttcgtccacgctcatatcgagttcgcgcacatcgcttttctttaccataatatagtaaccgccggtcggattcggcgtggtcggaacatacacggaaagataatcgccgtccttcggcaatgcggccttaaccgcattcgacacctgccctgacacgaaagcaatcgtccaaataccgggctggggaaacggcacgagtaccggcgttttaaacgaacggctgctgtcggacagcagcgattcggatacttttttcacactcgaatagatggatttcacaaccggaatccgccccaacaggctgtcccacgcggcgaggatctgccgacccaatacgttggcggcaaacaatccggttacaaacaatacggcaatggcaacgataacgcccagccccgggatattaaaccccaaaacatattgcggccgccattgcttcggcagcaggttgacgagctgatcggacgcggaaacgatataggaaaccacccaaaccgttaccgcaatcggcagccagaccaaaatgcccgtaatcagatatttttttaacgcyttggcagctttgccgccttcggccgcaggttccgtcatcttgcttgattccgacaaagtccgtacaaaccgcacattatacgcgtttgcccggattcaaacgaaatttttatcccgccccgccaaaccgccggcggcttcagacggcacggcaacttgatataccgtctgaacacgcggttcagatgccgtccaagtcgttgaacatcaacccgataccgataccgttctgcttgtggttgtagtcgatcaggctctcgccgtaaccgtggaatccgcgtaccacgcctttgagtttgcccttaatcggaaacgtgtaggcggcttcaatcgcgccgtagcccgttttggggttgtagcgcaatacggaatacacattctgcctgtcgttcaggcggtactgcagcttcacgtcgccataccccatatagtcggcaatatcgggattgtcgtttttatcgccgctctgatcgaacgcacgcacccacacgcgcggaatcaccgtcaatttgccccattccatgcctgccatggcgtaaatcctgttccacgaacgcgattcgggacggctctgtccgttggactggtggacaaaacccgcaccgagcatacgcagcctgccgccgaacggcaaatccgccttcacaggctgggtcaggaaaatttcaggtttgtaatccgtattgcggaacggcgcggatttcctgccttggttgtaaatctgccaatcggatctttgggtgtagccgaaccacagatccgcgcgggttttaaacaaatcttcggcaattttgcttttgaacgaaacctgcaatttggtttccgcacgtttctgctgtccgaatttttcctgtacagtcgtaccgcgcgtcggcgaacccggggcatagttgggcgaattgttgtaccagagcggcataaggtacatcggattgtgttcgcgtacgcccaacagcccgcgcaaatcgtttttgtccaagtcgtacatcaggctcaaaggcgtatagatgtcggcggtttcgcccgcactgtcggcaggaagcgcatccccgcctttttcaacaacaatgaccgcctcgcccttatccaggctgctgcggacggtttccgtcagattgagtacggctttcgactcctgcccttcctgccctgccgaagacggaagctgtgccgcaaaaatcctgtcgtaacacgccaaacgcgtaacattgtccgtcaaagcggcgcattgcagcgcggtctctccaaaagcggatgccatcggcaacagtcctgtcaaaagaatatagcgcatattccgtgtattcatctccgcccccattgtcggcatattggttttcaaacggcattttatagcggattcggataaaaaatcgcaccctttccgccatttcgggattttgcccccgcaatacagaaaaccccgaaaccgtcgggcttcagggttttccgcttatcgcgtatcaaccgccttggcggttttgcaaaaatcaagccaaggcttttacttttgcagacagacggcttttgtggcgtgccgctttgtttttgtggaacacgcccttgtcggcgatgcggtcgatgactttgacggactcttggtaaaccgcttgtgcgg

SEQ ID NO: 34 - DNA, 28730 bp, Neisseria meningitidis
caaatggtcgtcattcatataatcgtcttccggcccgctccaattcaaaatatcttgttctgtcagctttgccataatgtatatcctctcggttcaccgcaaaaaacaaagcaccacaaagtggctttattcctttgatttttataaggcttattgcctaaggcgtttttgaaaacgcgcatcataacacgttttggattggtttttttattttctttacattattgatattgccgttccatttcctgcgaacggcgcacacaggcacaaacgccctcgcttatggcttcggcgacacgatgccgcctgaaagcttccacggcttcgtgggttgtcccgccttttgacgttacatttttttgaagcttctcgaaatcttcacccgtctgctcggcaagggcaaccgctcctttaaacgttgccagactgagcgcgcgtgcttctgccatatcaaacccttgtcggatggcggcattttgcaatgcgtccagcagataaaacacataagccggtccgctgccgctgatgccggtaatgccgtgcattttttcctcatcatccaaccaaacagtcaaaccgactgatttcatgattcgatcggcaatcctgcggtctgtttccgatacttccgcttcggcatacataccagatacgcccagcccgatttttccgggtgtattcggcataacccggacaatgcggcgtgttcccccgaggtaacggctgagcgtaccgaccgacaatccggctgcgacagaaagcaccaatgcgccgttggtgcggatatttttgcacgcagcttccatatcctgcggtttgacggcaaggattaaaacatcgtcggaatgaagctccggcagggttgccgaagtttcgacccccaactctttttccaaacgttcgcgtttttccgcaccccgattggctatatagatgcggtaaccgccttgtttgaccaatccgcccgcaacggcagccgccatattgccgccgccgagaaaataaacattcattatttctaccctattcaaaattaccttactaaattcattcccaattttttaccatcggacgcgctcggacagaccgttgcgccgcaacccctgcttttccaagcagtcaaatcctccctgtttgaacgtctcaatcaaaggtttgccgtcacgcgtacgccaatccagcccgcaggcttcaaacttccctattttcctgtaaaagtaagattgttgtgcggattcatattcgtttgccctgacggaacgattgccgtctgaaagcggtatctcgtagtcccctaaagacggcggactctcgccgccaatatcccaaaaatcgatggcagccggttttctcggcttacaccagccggtgagggacgaacactcataccaccccgccagccggcagcctgcaaccgtaaatgcaagcaacgcagccattgccgtatattttattgcccgaatttccatcagccccttttcccgaaaatcgcgctgccgatacggacgtgtgtcgcaccgcactcaatggcggcaggcatatcgtccgacatccccatagacagcacgtctgccttaacgccagccgcattgaggtcggcaagcagtttccgcatcgtttgaaattgcaccttcaactccgtttcactgctgttggctttggcaacacacatcagtccacgtacgacgatattcggcagcttcgccacttccacagcaagcgcgactgcttcttcgggcgcgacaccgtgcttcaccgcctcgcccgcaatgttcacctcgatacacacctgcaaaggcggcattgaggaaggacgttgcccgctcagccggacggcggttttcagacggcatacggtatgcacccaatgcgcgcgttcggcgacaaacttggttttgttggactgcacatcgccgatgacgtgccacacgatgtcggtcaaatccgccaactcttccgttttgccgtaccactcctgaatatagttctcgccgaaatcacgctgtccggcggcgtaaacttcgcggatgccgtctgaagggaaagtcttaccgacggcaatcaggctgacggaatgcggctccctgcccgcctgcagaaccaattttccgatacggtcggacacctcacaataacgttcttgcaacaccgtcatagattatcccctaattaaaaatgattaaacagttgaaacccctccagtcagggcggtacaatcaaggttgttagaaccattccaaccaatcgaaacattatactaaacagagccgcattatgcagattaccgacttactcgccttcggcgctaaaaacaaagcatccgaccttcacctgagttcgggcatatcccctatgattcgggttcacggcgatatgcggcgcatcaaccttcccgaaatgagcgcggaagaggtcggtaatatggtaacttcggtgatgaacgaccaccagcggaaaatctaccagcaaaacttggaagtcgacttctcgttcgaactgcccaacgtcgcccgattccgcgtcaacgccttcaacatcggccgcggtcccgccgccgtattccgcaccattcccagcaccgtcttatcgctggaagaattgaaagccccgagcattttccaaaaaatcgcagaatcgccgcgcggcatggttttggttaccggccctaccggttcgggcaaatcgaccacgcttgccgcgatgatcaactacatcaacgaaacccagccggcacacatcctgaccatcgaagacccgattgaattcgtccaccaaagcaaaaaatccctgattaaccagcgcgagctgcaccagcacaccctcagcttcgccaacgcgctgcgttccgcattgcgcgaagaccccgacgttatccttgtcggcgagatgcgcgacccagaaaccatcggcttggcactgaccgccgccgaaaccggacacttggttttcggcacgctgcacacgaccggcgcagcaaaaaccgtcgaccgtattgtggacgtattcccggcgggagaaaaagaaatggtgcgctctatgctgtccgaatcgctgaccgccgtcatctcccaaaacctgctgaaaacgcacgacggcaacggccgtgtcgcctcgcacgaaatcctgattgccaaccccgccgtccgcaacctcatccgcgaaaacaaaatcacgcagattaactccgtcctgcaaaccgggcaggcgagcggtatgcagacaatggaccaatcgctgcaatcgctggtgcgccaagggctgatcgcaccggaagtcgcacgcagacgcgcgcaaaacagcgaaagtatgagtttctgacacacaaccgctttccggccataccggcgggaaaacaaggcgcaaacacgcggggcgggacgcagcatcccgcccggctacctttccgaacaagaagcgtccgccttcctgttgaaacctgccgccgcaaactgcaaggcttaaaccgaaaagaagctaacgatgaataccgataacctgcacgacatcttggacgaaatggttcaagtgtattctcaaaaaaaacaaagccgatccgaaaccccggccgaaatcggcgcacacttccacccgctgctcgaccgcctgtgcgaaaccgcagaagcacaaaacgcgtccgacatccttatcagcaaaggattcccgccctcgttgaaaatcaacagcgcattaaccccgcagccgcaaaaggcgctgacgggcgaggaaaccgccgccatcgccgcatcgacgatgaacgccgaacaatcggaaatattccggcgcgacggcgaaatcaactactccgtccagtcgcgcagcggcacgcgctaccgcgccaacgcctaccacagccaaggcagcgcaggtttggttttgcggcgcatcaaccacgtcatcccgcaaatgcaggaattgggcctgcccgaaaaactcaaagacctcgccgtcgcaccgcgcgggctgctgattatcgtcgggcctaccggttcgggcaaatccaccacgatggcgactatgctcgaacaccgcaacaaaaccctgcccagccatatcgttaccatcgaagacccgattgaatttatctacaaaccgcgccgctgcatctttacccagcgcgaaatcggcgtcgacaccataaactggcagacggcggtacaaaacgctatgcgccaatcccccgacgtggtctgcatcggcgaagtccgcagcagggaaagtatggaatacgcgatgcagctcgcccaaaccggccacctgtgcatttttacgctccacgccaacaccgcgccgcagtcgctcgaacgcatactcaacttctaccccaaagaacagcacaaccaaatactgatcgacatcgccctcaacctgaccggcatcatctgccaacgcctcgccctcaaacaagacaaaacgggcaggacggcggttgtcgacttgctcatcaacacgcccgccatccaagacttcatcctgaagggcgacctgatgaacatcagtaaaatcatggaaaccgccaaaaccgacggaatgcagacgatggatcaaaaccttttcgaactgtaccgtcacggcatcatcagttacgaagaagccctgcgccagtccgtttccgccaacaacctgcgattgcacatccaactgcacaaagaaggcaaaacgcccgaactcctttacgacagggtcaacggtctcaacctcatttcctgatccgcaaaacccaatgccgtctgaaaaccgcatccccgttttcagacggcatgattttatccgccccattcatgtgctacactttatagtggattaaatttatagtggattaacaaaaatcaggacaaggcgacgaagccgcagacagcacaaatagtacggaaccgattcacttggtgcttgagcaccttagagaatcgttctctttcagctaaggcgaggcaacgccgtactggtttttgttaatccactatattcacttcataacaataaaccggtaaaaccatgaaaaccccactcctcaagcctctgctcattacctcgcttcccgttttcgccagtgtttttaccgccgcctccatcgtctggcagctaggcgaacccaagctcgccatgcccttcgtactcggcatcatcgccggcggccttgtcgatttggacaaccgcctgaccggacggctgaaaaacatcatcaccaccgtcgccctgttcaccctctcctcgctcacggcacaaagcaccctcggcacagggctgcccttcatcctcgccatgaccctgatgaccttcggcttcaccattttaggcgcggtcgggctcaaataccgcaccttcgccttcggtgcactcgccgtcgccacctacaccacacttacctacacccccgaaacctactggctgaccaaccccttcatgattttatgcggcaccgtactgtacagcaccgccatcctcctgttccaaatcgtcctgccccaccgccccgtccaagaaagcgtcgccaacgcctacgacgcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgccttcgcggcaaacaccgccacccgcgcaccgccaaaatgctgcgttactactttgccgcccaagacatacacgaacgcatcagctccgcccacgtcgattatcaggaaatgtccgaaaaattcaaaaacaccgacatcatcttccgcatccaccgcctgctcgaaatgcagggacaagcctgccgcaacaccgcccaagccctgcgcgcaagcaaagactacgtttacagcaaacgcctcggccgcgccatcgaaggctgccgccaatcgctgcgcctcctttcagacagcaacgacagtcccgacatccgccacctgcgccgccttctcgacaacctcggcagcgtcgaccagcagttccgccaactccagcacaacggcctgcaggcagaaaacgaccgcatgggcgacacccgcatcgccgccctcgaaaccagcagcctcaaaaacacctggcaggcaatccgtccgcagctaaacctcgaatcaggcgtattccgccatgccgtccgcctgtccctcgtcgttgccgccgcctgcaccatcgtcgaagccctcaacctcaacctcggctactggatactactgaccgcccttttcgtctgccaacccaactacaccgccaccaaaagccgcgtccgccagcgcatcgccggcaccgtactcggcgtaatcgtcggctcgctcgtcccctacttcaccccgtctgtcgaaaccaaactctggattgtcatcgccagtaccaccctctttttcatgacccgcacctacaaatacagtttctccaccttcttcattaccattcaagccctgaccagcctctccctcgcaggtttggacgtatacgccgccatgcccgtacgcatcatcgacaccattatcggcgcatcccttgcctgggcggcagtcagctacctgtggccagactggaaatacctcacgctcgaacgcaccgccgcccttgccgtatgcagcaacggtgcctatctcgaaaaaatcaccgaacgcctcaaaagcggcgaaaccggcgacgacgtcgaataccgcgccacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccacctcgccgccgaacacaccgcccacatcttccaacacctgcccgaaaccgaacccgacgactttcagacagcactggatacactgcgcggcgaactcgacaccctccgcacccacagcagcggaacacaaagccacatcctcctccaacagctccaactcatcgcccgacagctcgaaccctactaccgcgcctaccgccaaattccgcacaggcagccccaaaatgcagcctgaaaaagtttcggcattttgtaagagaggacagattgtcagacaggttacaagatagtggataaagctttgcgcagggtaaatgcgtagcaactgaaccgtcattcccacgaacctacatcccgtcattcccacgaaaacagaaaaccaaaaacagaaacctaaaatcccgtcatttccacgacaatgggaatccagttcgttcggtttcgcttgttttaagtttcgggtaacttccacttcgtcattcccgcgcaggcgggaatccagtgcgttgagcttcagctatttagaataaattttgaaactctaatcccgtcattcccacgaaagtgggaatccagttttttgagtttcagtcattcccgataaattgccttagcattgaatgtctagattcccgcctgcgcgggaatgacgaatccatccgtacggaaacctgcatcccgtcattcccacgaaagtgggaatccggttcgttcggtttcacttgttttaagtttcgggtaacttccacttcgtcattcccgcgcaggcgggaatccagtgcgttgagtttcagctatttagaataaattttgaaactctaatcgcgccattcccacgaaagtgggaatccagaatctcggactttcagataacctttgaatattgctgttgttctaaggtctagattcccgcctgcgcgggaatgacgaatccatccgcacggaaacctgcaccacgtcattcctacgaacctgcaccacgtcattcccacgaacctgcaccacgtcattcccacgaacctacatcccgtcattcccacgaaagtgggaatctagaatctcagactttcagataatctttgaatattgctgttgttctaaggtctagattcccgcctgcgcgggaatgacggcagagcggtttctgttttttccgataaattcctaaaactcaaaatttcatcattcccacaaaaacagaaaaacaaaatcagaaacctaaaattcgtcattcccgcgcaggcgggaatccagaatctcggactttcagataatctttgaatattactgttgttctaaggtctggattcccgcctgcgcgggaatgacggcagagcggtttctgttgctcccgataaatgccgcaatctcaaatcccgtcattcccacgaaagtgggaatccagttttttgagtttcagtcattcccgataaattgccttagcattgaatgtctagattcccgcctgcgcgggaatgacgacagaacggtttctgttttttccggtaaattcctaaaactcaaaatttcatcattcctacaaaaacagaaaaccaaaatcagaaacctaaaatcccgtcattcccacgaaagtgggaatccagaatctcggactttcagataatctttgaatattactgttgttctaaggtctggattcccgcctgcgcgggaatgacgaatccattcatacggaaacctgcatcccgtcattcccacgaaagtgggaatccagaatctctaaagcttcagctaacctttgaatattgctgttgttctaaggtctagattcccgcctgcgcgggaatgacggcatcggtttgacggtatttaattgaattgtggaaattgatggattcagtgagattggcgagatgaagcctaccctatagcccgccttttacgaacccgcccctcccgaaaaacgcaaaaaatgccgtccgaaaacctttcggacggcattttcgcgtgcaaatcagtagaagacttcacgccagctgattcgtttcataccgcacgtcgggccggtaatgtccaagctgtccaaatcgttcatcagcagggtgcgcacccctttttgggagaagcagcggttgtttttgccggaacgcttgccggcggggtctataccgctgccgcccgcatcgccgtctgccgttgttgaaaatccgtctgttttcttttcatccagataacgcacattaaccggtttgtcgtaaacatatccgttcgggcagacgatttcattgcctttttgcatacaacctatagggatggatttgccgttgatgcctttcttatggccggaatattgcgcgacagcctgattctcggccggcacaatcgggcgcgcgcttttcttggtcagcttgccgccgtcggcggtattgatacccaaaatggcggtttccgcgccgcatttgtccgtacccgtatatttatggatggttacaaaggcggtacgcaataccacggtcggtttgacggtaacgcgctgtccgcccttcaatttcactacccaccctttgctgcccgatccgtcggatcgcttgtaatcggtcaggaataaggttttatcctcctgcttaagctcttgctcgagcagcccgcctcccaaaccgctgagttttacatttacgttattcgccaccgtatcgtcgtcgaagataccgtaaatatattgttcgctcgtactgagtacatcatcctcactcaaatcactgcccgtgccgaagataaccacgcgtttgtctttcagttgggaaatagcgggcgcggaagtaatcggttttgtgccttcaaaaatggcgcgtacagaccattgattaggatcttgattgctcaaatcaaagcggtacatactgccgccgcgatcgccggcataggcgatatcgaccgtgccgtccaaatctttatccaccagcgtgggggacgaaagcccgcccttgccaccgggtacttcgatttttttaatcagcgtgccgctgctttccaaatcatacacatacagcgcggttttattgtcgccgctggtaatgtctttagtcgcataaccggaggcgaggaaagcggcgtatttgccgtcgtgggttttgccgatttgcggcgtgccgacggtgtagcctaatttcacgccgttattgccattcttgtcatgtttgacatcaaacagggaaacgtctgccaggttgccgttgccgctgtcgattttgcttaaatccaaggcatacgcgcctctgccgccaaagcccatcgcgccgaacataaacacatggtctttcccgttccgttcgactttgcgcaagacaaagccgccgtccacgccgtagcggtcgcccacatagcttttttcggcaaaggcgcgcagctctttggcaagggtggattcggtgttttgaatatccttgcgcggcatcgtacccgggatataactgagcttcagattgtagctgcgcttgtccccgccgctttgtttgaagatatgcaccatcccgtcgttggcggaagtagccaaatactcgccgaccgccacgatggggctgttgacgatgtcgcccaaattgcgctcgtgcttgccgttgtcgcggctgcggtatttttggctgtattttggcttgccgtctttttcttctttgttgaatgtgttaaattgaccgtcatcattggaagcacgaaccgtccaaggcagcaatacttttttccactcgctggcatcaggcatgaagctcccttcactaacaatgccgaaagtgtcgtttttgccgtcatttccattaaaattggcgacctcatcattgtttctacccagtttgatctgctgtacgccgccatccaatcggatgatggtttgccgccctgtgaaattcggctgtcgattttcaatatccgacttagccaagtctgcgagggaatggcggccgggtttgttggggtcggtttttcttttcagattttgaaggaagatgcggctgctcgaactatcggggtaggtggaaaccgaagcggaatacatctgcaccttaccattttgcacaggtccgaaccacagcgcgggggcagtcagtgcgggggaaggggctttggtactcttattggggttatttgcgttgatgcagcggcctgctttgacttccggcaatttgagtttgacgctgactgttcctttctcttcatacgtccaactaccgttaaaaaagttactattccgtcttttccatgcttccgtcggctcgatgcgtgttttcaagatacccaaattaactgttttaccttgcacgatatttttaatgtgttttttatccagcaggtgcagcttggcgttcagataaaaggcgacggcgtggtgtttgtcctgatggtttttattattctgactcttgtaatcgtctgtcgtataaacgaggtttttgtctttgtgttggctgcccgcaccattttgctgcgtcacgtcctcgctaaaagaagataccaaagaaccttgtctctttggtttgaaggagctctctccgcccaaattgaaagacacgcccaaccaaggatgatccttcaatttgtaaatgggcgaattgtcgcggcttttgtcttcgtatatatccagcccgccgccgtttgccttttttgccaaactggaattgccgaaggtaaattgggttctataggcaactgtaggacaacctccgctggagcatgtgctaccttcgtagctgtagcctaccagccccgttttggtcgtaccaatctgatcaagggcatttttgcgctcggtcagcttagcggtatcaaaaccggaaacctttccgtagggcggcaggtaggtcgccgcgccgaaaacgacagtatcttttttttcagcaacaacttcatcggtattattgaatgagaaactaatgctcttttttgccaaaccaaaaccactcgtatggataacttcgcgttcattgcttttgtgcgtcaatgactgatattgatccccccactttacctcgggcagattttgcgcgttcattacaatagcgtatttatgcgtttgcgtttgcgtttgcgcttgcgcctgcccccccccccgccggtatgggaaaacatcaatatggcggtataaagcgcggtatggcggaaaacctgccgtttccaagttttattcatcttttattccttgagtttgccttcacgggacggggcggcgcgccgcgaacgccggggttcggtaaaccgcccgattccgcgcccgccgaattgctgattgaaaagccctttcacttggctgccaaaggggaatgttaagaaaagcaatgcgcccctttgacggggtacaatatataaggttaccgcgccattctaaccctgcgcacttatcacagtaaagcggtttttagcaaaccgctgcagatgcccaacggtctggattcccgcctacgcgggaatgacggcggagcggtttctgttttttccgataaattcctaaaactcaaaatttcatcattcctacaaaaacagaaaaccaaaatcagaaacctaaaattcgtcattcccgcgcaggcgggaatccagtgcgttgagtttcagctatttagaataaattttgaaactctaatcccgtcattcccacgaaagtgggaatccagaatctctaaagcttcagctaacctttgaatattactgttgttctaaggtctagattcccgcctgcgcgggaatgacgggtcttttataacctttgaatattgctgttatcccaaggtctggattcccgcctgcgcgggaatgacgaatccatccgcacggaaacctgcaccgcgtcattcccacgaacctacatcccgtcattcccacgaaagtgggaatccagaatctctaaagcttcagctaacctttgaatattgctgttgttctaaggtctggattcccgcctgcgcgggaatgacaggtcttttataatctttgaatattgctgttgttctaaggtctagattcccgcctgcgcgggaatgacgaatccatcctcacggaaacctgcaccgcgtcattcccgcgaacctacattccgtcattcccacgaaagtgggaatccagaatctcggactttcagataatctttgaatattgctgttattctaaggtctagattcccgcctgcgcgggaatgacgaacccatccatacggaaacctgcaccgcgtcattcccacgaacctacatcccgtcattcccacgaaagtgggaatccaggacgcggaatctcaagaaaccgtttacccgataagtttccgtgccgacagacctagattcccgcctgcgcgggaatgacaggtcttttataatctttgaatattgctgttgttctaaggtctagattcccgcctgcgcgggaatgacggtttagaagttgcccgaaacctcaaaaaaaaaaaaccgaaaccgaacaagccggattcccgcctgcgcgggaatgacgaacccatccatacggaaacctgcaccgcgtcattcccacgaacctacattccgtcattcccacgaaagtgggaatctagaatctctaaagcttcagctaacctttgaatattgctgttgttctaaggtctagattcccgcctgcgcgggaatgacggcggagcggtttctgttgctcccgataaatgccgcaatctcaaatcccgtcattccctcaaaaacagaaaaccaaaatcagaaacctaaaattcgtcattcccgcgcaggcgggaatccagtgcgttgagtttcagctatttagaataaattttgaaactctaatcccgtcattcccacgaacctacattccgtcattcccacgaaagtgggaatccagaatctctaaagcttcagctaacctttgaatattgctgttatcccaaggtctagattcccgcctgcgcgggaatgacggcggagcggttgctgtttttccgataaatgccgcaatctcaaatcccgtcattcccacgaacctacattccgtcattcccacgaaagtgggaatccagaatctctaaagcttcagctaacctttgaatattgctgttatcccaaggtctagattcccgcctgcgcgggaatgacggcggagcggttgctgtttttccgataaatgccgcaatctcaaatcccgtcattcccacgaacctacatcccgtcattcccacgaaagtgggaatctagaatcccggactttcagataatctttgaatattgctgctgtccaatggtctggattcccgcctgcgcgggaatgacggtttagaagttgcccgaaacctcaaaaaaaaaaaaaaccgaaaccgaacaagccggattcccgcctgcgcgggaatgacggcagagcggtttctgttttttccgataaatgccgcaatctcaaatcccgtcattcccacgaacctacatcccgtcattcccacgaaagtgggaatctagaatctcggactttcagataatctttgaatattgccgctgtccaatggtctagattcccgcctgcgcgggaatgacggtttagaagttgcccgaaacctcaaaaaaaccgaaaccgaacaagccggattcccgcctgcgcgggaatgacggcagaacggtttctgttttttccgataaatgccgcaatctcaaatcccgtcattcccgcgaacctacatcccgtcattcccacgaaagtgggaatctagaatctctaaagcttcagctaacctttgaatattactgttgttctaaggtctagattcccgcctgcgcgggaataacgggtcttttataaactttgaatattgccgttatcccaaggtctagattcccgcctacgcgggaatgacggtttagaagttgcccgaaacctcaaaaaaaaaaccgaaaccgaacaagccggattcccgcctgcgcgggaatgacgggctaaataatatcaaaccataaatcctgccaagaaacattattttcttcaatcagttgcaatttccaagccctgttccatttcttcaactgtttttcccgagtaattgcactctccatcgtaggatgcagttcataccaaaccagcatagtaacgttgtaccgtgatgtaaatccctcaatcaaatgctccctatgttggtaaatacgttgcaccaaatcagatgtaacgccaatgtataacgtgccattacgttggcttgctaaaatataaaccgcaggctgcatataatacccttttgaattatttcaatttatattcccgcgaacaccatcccgtgattactttaacccttcgttattcccatagctttccatcattcccgcaactcttcgtcattcccgcgaaagtgggaatctagaacgcaaaatctaaagaaaccgttttacccgataagtttccgcaccgacaaacctagattcccgcctgcgcgggaatgacggcggagcggtttctgttttttccgataaatgccgcaatctcaaatcccgtcattcccacgaaagtgggaatccagaatctcggactttcagataatctttgaatattgccgctgtccaatggtctagattcccgcctgcgcgggaatgacggcatcggtctgccgttacaacacggtttctttagattttacgttctagattcccgcctgcgcgggaatgacgaatccatccatacggaaacctgcaccacgtcattcccacgaacctacatcccgtcattcccacgaaagtgggaatccagaatctcggactttcagataacctttgaatattgccgttatcccaaggtctggattcccgcctgcgcgggaatgacggcatcggtctgctgttttcggacggcatttcggctcaatccagcagtgcgtccacaaacgcgcgcgcgtcaaacgggcgcaggtcgtctatgccttcgcccacgccgatatagcggacgggaacggggcggtcggaggcaagcgcggcgaggatgccgccttttgccgtgccgtcgagtttggtaacgattaaaccggtcagccccaatgcgtcgtcaaaggctttgacttggttgacggcgttttgcccgatattggcatcaagcacgacgatgatttcgtgcggcgcgtcgggcatggctttttgcagcacgcgtttcacttttttgatttcttccatcaaatgaagctgcgtgggcaggcggccggcggtgtcggccagcacaatgtcgatgccgcgcgctttggcggcttggacggcatcgaagcacacggcggcggaatcgcccgtggtttgcgaaatcacggttacgttgttgcgctcgccccaagcttgaagctgctcacgcgcggcggcacggaaagtatcgcctgccgccagcaatacggatttgccctgcgcttggaaatatttggcgagtttaccgatagacgtggttttgcccgcgccgttgatgccggcaagcatgatgacaaacggctctttggtttcgggcaaaaccaaaggtttctccagaggcttaatcaggtcgtacaaggcttctttcaacgcgccgcgcaattcgttgccgtctttcagccctttgaggctgacgcggtcgcgcacgtctttcatcaggtattcggtggcttccatgcccatatcgctggtaatcagcacggtttccagctcttcgtataaatcttcgtcgatttgtccgccgccgaacacgcccgccagcgatttcgccattttgtcgcgcgatttggtcaggccttgtttcaaacgcgccgcccaaccgagcttgtgttcttcagttgtcgcaacggcttcttgaacttgcccgacagcctcgccgacggtttcggcaacggcttcttttgccgcttcgacttgttccgctgctttttccgccgcttcctctgcttcagacagcatctcggcaacggtttcctttacctgttcaaccgcaccgctgacggtttcaacggcagattcgacctgccctttgacgctttctgctaaagattcagcatcttctttaatattttcaactatttgagcaagttcagattctgcttttgctgcggtttcctgaatttgagcctcctcgagagccggcgtttcctgttttttcttgcgacggaagaagctgaacattgaattttccttttaattttagaaacttgaaacagggcgtattgtagcgtattttacgcggtaaggttgtctgaaaatccgggctgtaaggtttcggcatctcaaacgtctaatcatgcaaaccgtccacacaggaaacatcaaaatgaaacaccgtactttcttttccctttgcgccaagttcggctgcctgcttgcgctgggtgcttgttcgcccaaaatcgtcgatgccggagccgcgaccgtgccgcacactttatccactttgaaaactgcggacaaccgccccgccagtgtttacttgaaaaaagacaaaccgacgctgattaaattttgggcgagctggtgtcctttgtgtctgtccgaattgggacagaccgaaaaatgggcgcaagatgcaaaattcagctccgccaacctgattaccgtcgcctccccgggctttttgcacgagaaaaaagacggcgacttccaaaaatggtatgccggtttgaattatcccaagctgcccgtcgtaaccgacaacggcggcacgatcgcccaaagcctgaatatcagcgtttacccctcgtgggcgttaatcggtaaagacagcgacgtgcagcgcatcgtcaaaggcagcatcaacgaagcgcaggcgttggcgttaatccgcgacccgaatgccgatttgggcagcttgaaacattcgttctacaaacccgacactcagaaaaaggattcaaaaatcatgaacacgcgcaccatttacctcgccggcggctgcttctggggcttggaagcctatttccaacgcatcgacggcgtggttgacgcggtatccggctacgccaacggcaacacgaaaaatccgagctatgaagacgtgtcctaccgccatacgggccacgccgaaaccgtcaaagtgacctacgatgccgacaaactcagcctagacgacatcctgcaatatttcttccgcgtcgttgatccgaccagcctcaacaaacagggcaacgacaccggtacgcaataccgcagcggcgtgtactacaccgaccccgccgaaaaagccgtcatcgccgccgccctcaaacgcgagcagcaaaaataccaactgcccctcgttgttgaaaacgagccgctgaaaaacttctacgatgccgaggaataccatcaggactacttgattaaaaaccccaacggctactgccacatcgacatccgcaaagctgacgaaccgctgccgggcaaaaccaagaccgccccgcaaggcaaaggcttcgacgcggcaacgtataaaaaaccgagtgacgccgaactcaaacgcaccctgaccgaagagcaataccaagttacccaaaacagcgcgaccgaatatgccttcagccacgaatacgaccatttgttcaaacccggcatttatgtggacgttgtcagcggcgaacctttgttcagctccgccgacaaatatgattccggctgcggctggccgagcttcacgcgcccgattgatgcaaaatccgttaccgaacacgatgatttcagctacaacatgcgccgcaccgaagtgcgcagccacgccgccgactcgcatttgggacacgtcttccccgacggcccgcgcgacaaaggcggactgcgctactgcatcaacggcgcgagcttgaaattcatcccgctggaacaaatggacgcggcaggctatggcgcgttgaaaggtaaagtgaaataagccgcaccgccgcctaccccgacaaaatgccgtctgaaacccgaaacgtttcagacggcattttttatccgatggggattttgttcagacggagattttgtttagacagcatcgccgccgttttcaatcagccccgccaaccgttccaacgcgaaggcgaccgcctgcgcgcggacggattcgcggttgccgtcaaaacggcgcattgcttcgcaacttccgcccggaaaggcaaacccgaaccaaaccgtgccgacgggtttgctttcgctgccgccgcccggaccggcgatgccggaaataccgacggcgtaatccgcctgcgccacggctttcgcgccgcgcgccatctcatagacggtttggcggctgaccgcgccgtgttcgagcagggtttcgggcaacacgcccaagcggtcttctttggctttgttgctgtatgttacaaaactctggtcgaaccattgcgaactgcctgcaacgcttgtgaatgcggcggcaagcattccgcccgtacaggattcggcacagcttacggtttgacgttttttcgtcaggtttcgggcgatggtgtgcagcgcgtccatttcccactcctctttcagacggcgtttaagaattgatgatgtgtatgtcgcgttgcgggaacgggatgttgatattgactttgcggaggttttcgaccacttgttcgttcaagtcgcattgcagcgtccagcggtctgcttcgtttgcccaagcccataatgtgatttcgatggcattgtcgcccaaggcggtgatgtaggcggcagcctgccgctcttcgttttgaacgctcaaggggtgttcgacggcggctttcaacaccgcctctttcgccactttcaaatcgcagttgtaatcgacgccgactatcacttgggcgcggcacagcggcagtgtggaacggttgacgatgctgttgcccatcaccacgctgttgggcagcacgacttcttcgttgtcggtcgtccgcaaagaagtctgcaccattttaatctctcggacatatccttcaaaaccgccgacgcggataaaatcgccgactttgaacgggcggaacaggataatcagtgcgccggcggcaaaattggacagctggtctttcagggacaacgccaccgccaaacccgcgccgccgattaaggcggttacggatgttgtggaaacgcccaatctgcccaatgcggcaataatcaccaaaatcaataagccgatattggcaacattacacaaaaaactaatcagcgtggcatcgacctgcgcgcgcgtcatcgccgccctcatcacagcgacaatgcgtttcgccgcccattttccgaccaaaaaaataagcagcgcggcggcaaggttcagcccgaacgcccacgccttttcagccagatgctcccaaccggaaacactgatcaggtgtaaaaaatcaaattgtttgaagtccattgttttcctcttgatcgaacatccgccccgtgcggcgtaatcggcacaggtgtaaaaatgccgtatgaagccctgcggggaggtatgtttgttttatttcaaaaccgttctaatccaacgggaaacccatccgcgctggttcgcatcaatatcgcgctgcgcgggggcggtggtgtgcgtcggggcttgggcgaagcggaacacgtcgggcaggcgcgtgtttttgacggcggggtaaacccacatttcggacggaaccgcctgctgcacttcccgactttgcagccattgcaccagttttgccgccaattccggctgtttcgcgcccttcaagaccgccgcgccttcgacctggcggaatacgccgccttttaaaaacaggttgcccgtcggcggctcgctgtatttgcctttggaaaaatacacttccgccgccgggctggcggcataaccgaccaccagcggatacgcgccgccgttgtgcgaaaagtcggtgtaatacgcctcgctccagcctttggcgaccttcacgccgttctgccgcatctgtgcccaccatttgaacgcgctttcttcgcccagaccgctgatgttcgccatcaggaagcccagccccggggacgacgtggcgggggacggcacgaccaataggtttttatattcggggcgggtcaaatcctgcagggtttgcggcaggggcagctttttgccttcaaaccattttttgtcgtaattgatggacacatagccgtaatcgaccgccaaagccgaaggcagcccgaccgcgacgggggcggattcgggttgcgccgccgccaaaatgcccatttcccgcgccttgccgatattggcgttgtccaaaccatacaccgcgtcggcaatcgggttggcgcggctcaaaatcagtttgttgagcatttcgttcgcgccgcccgcctgaataatcgacaccttcgcatcgtttgcccgctcgaagcgcgcaatcaaccctttgggcaggctgaacgacttatgcaccgccagcctgacttccgtctgcgcctgcaggtatgccgaaaccgccagcagcggcagcagccaaattttccgtttcattccgagtcctcctctattcgctgtaaaataacattctaacaaattttcacggttcaacatgcaagaaaacccgaccgtgtggctgttcgacctcgacaacacgctgcacgatgccgacgcaggcatcttcacactcatcaaccgcgctatgacacgctatatggcacgccgcctcaaactctccgaatctgccgcgtccgacctgcgtcaagactattggcaccgctacggcgcaacgctcgccggactgcaaatccaccatcccgaaatcgacatcgccgaatttttgcgcgaaagccatccgatcgatgcaatcctgaccaggctgcacggcatgcctgaaacacaaaacaccctgagccgcctaaaagggcgcaaggcggttttttccaacggcccgtcgttttacgtccgtgccgttgtcaacgcactcggtttggaaaaccgtttcgacgcgcttttcggcacggatgatttcgggctgctgtacaaacccaatccgcaagcgtatctcaatgtctgccgcctgttggacgtaccgcccgaatgctgcattatggtggacgacagcgcggacaacctgcatcaggcaaaggcgctgggtatgaaaaccgtccggttcggtgcaaaatcccacgcgctgccctttatcgatgcctccgtaagcgatatggcgcaactggctcggtatgcagaaactttgtcagaacaccgccaaaatcattacaataccccctaccccccgaaaatacgaaagaaaagccatgcgtaaaaccttcctcttcctgaccgctgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaatcaaaccggcaacaacgccgacgaagagcatcgccaacactggcaaaaaccaaagtttcaaaaccgataaacctaccctatgccgtctgaagccgcttcagacggcattgcacaggaaaccgtcatgccgcaaaacactttaaacatcgtcatcctcgccgccggcaaaggcacgcgcatgtattccaaaatgccaaaagtgctgcaccgcatcggcggcaagcccatggtcgggcgcgttatcgacaccgcagccgcactgaatccgcaaaacatctgcgtcgtcatcggccacggcaaagagcaagtcttggacaccgtcaaacgcgatgtcgtttgggttgaacaaaccgaacagctcggtaccggccacgccgtcaaaaccgccctgccccacctttccgccgaaggccgcacgctggtgttgtacggcgacgttcctttaattgacgttgaaaccctcgaaaccctgctcgaagccgcaggcaacgaagtcgggctgttgaccgacgttcccaacgacccgacaggcttggggcgtatcatccgcgacagcaacggcagcgtaaccgccatcgtcgaagaaaaagacgccgacgccgtccaaaaagccgtgaaagaaatcaataccggcatcctcgtcctgcccaacgccaaactcgaaaactggctgaacagcctttccagcaacaatgcacaaggcgaatactacctgaccgacctcatcgccaaagccgttgccgacggtattaaagttcatcccgtccaagtgcgcgcctcccacctcgccgccggcgtgaacaacaaactccagctcaccgaactcgaacgcatcttccaaaccgaacaggcgcaagaattgctcaaagcaggcgtaaccctgcgcgatccggcacgtttcgatttacgaggccgtctgaaacacgggcaagacgtcgtgattgatgtgaactgtatctttgaaggcgacatcgagctcggcgacaacgtcgaaatcggcgcaaactgcgtcatcaaaaacgccaaaatcggcgcaaacagcaaaatcgcccccttctcccacctcgaaagctgcgaagtcggcgaaaacaaccgaatcggcccgtacgcccgcctgcgtccgcaagcccgccttgcagacgacgtacacgtcggcaacttcgtcgaaatcaaaaacgccgccatcggcaaaggcaccaaagccaaccacctcacctacatcggcgacgccgaagtcggctgcaaaaccaacttcggcgccggtacgattattgccaactacgacggcgtgcacaaacacaaaaccgtcatcggcgacgaagtgcgcatcggttcaaactgcgtcctagtcgcccccgttaccctcggcaacaaagtaaccacaggcgcgggcagcacgattacccgcaatgtcgaagacaacaaactcgccctcgcccgcgcccgccaaaccgtcatcgaaggctgggtgcgtcctgaaaaagacaaacaataaagctatgccgtctgaagccggtttcaggtttcagacggcaccccaaaacaaacatccgataaggacggcaaaccatgtcattacccccatgcccgcaatgcgcctccgaatacacctatgaagacggcggacaatacatctgccccgaatgcgcccatgaatggaatgaaaccgaatccgccgccgaccttgcggctcaagtgcgcgatgccaacggcgcagtgctgcaaaacggcgataccgtcatcctcatcaaagacctcaaggtaaaaggcagctcgatggtgatcaaacaaggcacaaaagtcaaaggcatacgcctgcaagaaggcgatcacaacatcggctgcaaaatcgacggcagcgcgatgaatttaaaatccgaattcgtcaaaaaagcctgaccgcccaaaaacaagaaacgccgtccgaacccgtttggcaaggttcggacggcgttttttatatggcggatttatacgcccagcagcccttgccccaaaaagccgcctttttccacgccgggcaagacgaagaaatagccgccgccgaaggggctgatgtattcttccagcggttcgccgttgaggaggttttgcacgaagatgaatccgtcggcaaggtttgcctgatagcagacgaacaccagcccgacatcaagctgtccgcttgaggcgagtccgcgcgaatagctgtaggcgcggcggaagaggcggtgttttttgaggaattcgggatcgcgcggattcgccaggcgtatatggctgtctttgggcgtgatatcaccctcggggtctttggcaaaatccggttggtcggcttcttttttgccgtccatcggcgcaccgctgtatttgcgccgcccgaaaatgtcggtttgctcttgaagcggcgtcctgtcccaaaactcgacaaagtggcggataaggcggactgcctgatagctgccgtttttcgcccactccggttcgtcgaggctgttggcggccacccccgtccacaaaacctcgtcggcagttttgggatcggaaactttggggttgcccgtgccgtccctgaagcccaacaggttgcgcgccgccatcgcgccgggttcggatttgggctgccacccgtcgatactccaacggataacggcggtttggacggtgtgtttgatgatgtcgcgcagggcggcttggcaggtttcgggggtgaaggcacagatttgcaggctcaaatcgccgtcgcaccagcttttttgcagcttatcgttggagaagtcgcgcatttcctgcaaatgaatcggttttttgtctttgagtccgaaccggccgtcaaacaggctgctgcccacccccacggtaacggtcaacccgtcggggttgaaggctttgcccaaaatgccgctgccggctggcggaagtttgtcgtcgccgtcttggtattcgccgccttgggtgagaaactcgatgcgggcggtcagcgtgcggaacaggttttccagctgcttggcactttgcgcggttacgtcgaaggcgcacataatcgaaaacgcctgctgcggcgtaacgatgcctgcctgatgttcgccgtagcagggataggcttggggcgagtgttggctttcggcggtgcgttcggcggtttcgccctgttttttgccgccgagataacctccgattgcgccgactgctccggctgcgatcgcggttttaaaaagagtgcgcctggtcggttgtgcgggttgttttttgctcatggtgtttccttcaatatccgtgcagcaggatgggtatccctgcacgccgtttttccattaaccgatagcggcaggttgaaatcccgccctgcaatatatggcggatatagtggattaacaaaaatcaggacaaggcgacgaagccgcagacagtataaatagtacggcaaggcaaggcgaggcaatgccgtactggtttttgttaatccactataaaacttcagacggtatctgccgccaaataccgtctgaacgcttgcggcttatttcaagccgagtatgccgcgaagttgggcaaggtcttcggcaagcgcgttaatagaggcctgtaacgctttgcggtcggcttcgcccagcttgtcgtaggtttcaaaaccgtctttagtccggtatttcgccagaatttcgttgacctgtttgaagttggtatcggttttttccaacaaggctttgtttttggcctcgatcagcggacggaacaaatcgacgatttttttagatccgtccacattggcttggaagtcgctcaaatcggtgtggctgtaccggtcttcttcgccgctgattttactgcccgccacttcttcaatcagttcggacgcgccgccgaccaccttgcccggaggaaacgccaatgcgtcgatttctttttgcagggcttcgacatcggtcatcagtttcgctgcaatttccttcacgccggacacgtctttttccacccaaagggcgtattcgatacggtgaaagccggtaaatccggcatctttcgcgccgtctttgaagtcgtcttcacgcgcatcgatgacggggtcgagttcgctgaaaagctcggcaatcggttcgatgcgttcgtaatggacgcgggtgtcggcaaacagggatttcgccttttcaatgtcgcctgctttgacggcttcggtaaaagttttggttttcgccaccagctctttaacctcgccttgaacgtaggctttatagtcggcgagcggttgggacagtttttccaaatccgcttcgttggcggtgtctttaaagccgctgtcggttaccaccagcttgccgcgcggattggtcaaaagaccgcaagtcatttcgtattcgcccggcaacagggtgacggtcattttatcggaaagtccgggggcgatgttttcgcgctcgtccaccaccatcacgcctttcaggatttcccattcgagcttgcggccgctgttgtttttaatattgaacacaacctgtccgctcggcacggtcagttccatcggttcgcaggcattgtcgttgacggcgatactgaccgaaccgccctcgttggcggtttgcgcctcaccggacgctgccggcgcagctttctccgcctccggcggctggcacgcggtcaaacctaaggcaagcatcacggacaatgcggtcaaattgaattttctcatttcagctcctctttacgggttaaagtttcagacggcctgctgccgcacaaaaaccaagttatgacgggaataaggtacagcagccaaaccaaggtctcgccctgcgtcggatggtcggtatagccgaaaaatccgccgagcagcacgcccaacggactgtcttcgtgcaaatattttgatgagtcgaacacaatgtcctgaagcgcgttccaaatacctgcctcatgcagcgcgcgcagcgagccggcaagcaggccggcggcaacgacaatcagaaacgcccccgtccaacggaaaaacttcgccagattcaggcgcatcccgccctgataaatcaacgcgccaatcacggcggcagccaaaacccccgctaccgcgccggccggcatctgccacgtcgggctctgtttgaatacggcaagcaggaaaaaaacactctccagaccttcgcgcgccacggcaagaaacgccataccgaccaaggcccatccttgaccgctgccacggttcaaagccgcctgcacagaatcctgaagctgccgcttcatcgaacgcgccgcctttttcatccataaaatcatataagtcagcatggcaacggcaaccaaaccgataatgccgacgacgaactcctgctgcttctggggaatctcgcccgttgccgaatggatgccgtaccccagccccaaacacatcaaagaagcaaggacgaccccgaaccagaccttaggcatcagtttggaatgtccggactgtttcagaaaaccggcaacgatgccgacaatgagcgcggcttcaataccctcgcgcaacataattaaaaaagcgaccagcataaacgcgaacgaacaaggatgatgaataatatattatcggaatattttcattgcttgtaaatacaaatgcaagttatttttatctgcagtaccgcgcggcggaaagttccgcaggctgcagctgcgccctgtgttaaaatcccctctccacggctgccgcaacgccgcccgaaaccatctttcttattactgccggcaacattgtccattatgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcaggcggggccgtctataccgttgtacgagcatcgggctgaaaacgcttgggcgttcaggctgaaccttgccgccgcgctgcttatttttttggtcggaaaatgggcggcgaaacgcattgtcgctgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcgcgttcatagtcggcgattttatccgcgtcggcggttttgaacgatatgtccgagagattaaaatggtgcagacttctttgcggacgaccgagaacgaagaagtcgtgctgcccaacagcgtggtgtatggcgacgggcgatgacggggataccggataggtcagtgcggtttttacctttttgcggatggcctgggttttttctttgtaaattgccaatttgtccagcaggctttccaatacgccgcccgtttcgcccgccgcaac

SEQ ID NO: 35 - DNA, 50925 bp, Neisseria meningitidis
ccggatttggtgcgaaaaatttgcattccgccgaaaatttcggtttcagacggcattcaaatgttttggctgcccagccagcgttccgcgtccaaagccgcctgacagccggaagccgcgctggtaatcgcctgacggtaggtatggtcttttacgtcgcccgccgcccatacgccttcgatattggttgcgccgacattgtccgccgtgccgcctttggttttcaggtaaccggcttcgtccatttccaactgacctttgaaaatatcggtattcggcttgtgcccgatggcgataaaaatgccgctgacggcaatttgttgctcagaaccgtcgttgttttttaataatgcgccgtttacgccccgatcgtcgcccagtacttcttgcaggttgctttccagcttgaggatgattttgccctcttccacgcgtttcatcagtttgtcgatcatgattttttcggcacggaactcgctgcggcggtggatcagggtaacggttttggcgatattggcaaggtagagtgcctcttcaactgccgtattgccgccgccaactacggcaacatcttggtttttatagaagaaaccgtcgcaggtggcacaagcggaaacgccttttcctgcaaacgcttcctcactcggcaaaccgaggtatttggcggacgcgcctgttgcgacaatcagggcatcgcaagtgtactcgcccatatcgcctttgagtgtaaacgggcgtttttgcagatcgacggcgttgatttggtcaaaaatgatttccgttccgaaacgttcggcgtgggcgagaaaccgcgccatcaattccggcccttgcacgccgtcggcatcggcaggccagttgtccacttcggtggtggtcatcagttgcccgccttgcgcgatacctgtaataatgacggggtttaaattggcgcgcgcggcatagacggcggcggtgtatccggcggggccggaacccaaaataatcagtttgcggtgttgggacattgtttttcctttgctgtgtcaagttttcggattctactcgaattatcggcgcgtttgagaaatttcgaccataccggcgctcagacggcatcccgcagccttaactgccgtctgaatatcaaagcaggaatcacgcttatgcaacaaaaaatccgtttccaaatcgaaggcatgacctgccaggcctgcgcttcgcgcattgaaaaagtgttgaacaaaaaagattttgtcgaatcggcgggggtaaacttcgccagcgaagaggcgcaggtagtgtttgacgacagcaaaacctcagtagccgacattgccaaaatcattgagaaaaccggttacggcgcgaaggaaaaaacggaagatacattgccgcaacccgaagcagaacaccatatcggctggcggctgtggctgctgttcaccatcaacgtcccgttccttatcggcatggcggggatgatgatcggcagacacgattggatgattccgccgttgtggcagttcgcattggcaagcgtggtgcagctttggctggcaatcccgttttacaaaagcgcgtgggcgagcattaagggcggactggcgaatatggacgtgctggttaccatcggcacggtctcgatttacctgtattccgtctatatgctgtttttcagcccgcacgcggcgtacggtatggcgcatgtgtattttgaagtgggcgtgatggtgatcggttttgtgtcactgggtaaatttttggaacaccgtaccaaaaaatccagcctcaacagcttgggcttgctgctcaaacttacaccaacccaagtcaacgtgcaacgcaacggcgaatggaaacagcttcccatcgaccaagtgcaaatcggcgaccttatccgcgccaaccacggcgaacgcattgccgcagacggcatcattgaaagcggcagcggttgggcggacgagagccatcttaccggcgaatccaatcctgaagaaaaaaaggcgggcggcaaagtgttggcgggcgcgttaatgaccgaaggcagtgtggtgtaccgcgccacgcagctcggcagccaaacccagctcggcgacatgatgaacgcgctctctgaagcacaaggcagtaaagcaccgattgcgcgcgtagccgataaagcggctgcggtattcgtgcctgccgtcgtgggcattgcgttgttgacttttattgttacttggctgattaagggcgattggacggttgcgctgatgcacgccgtcgccgttttggtgattgcctgcccgtgcgcgctgggtctggcaacccctgccgcgattatggtcggtatgggcaaagcggttaaacacggtatttggtttaaagacgcggcagcaatggaggaagccgcccacgtcgatgccgtcgtgttggacaaaaccggtacgctgaccgaaggcagcccgcaggttgccgccgtttattgcgttcccgacagcggctttgacgaagacgctttgtaccgcatcgccgccgccgtcgaacaaaacgccgcccatccgctcgcccgtgccatcgtctccgccgcccaagcgcgcggtttggacattcccgccgcacaaaacgcacaaaccgttgtcggcgcaggcattaccgccgaagtggaaggcgtgggtttggtgaaagcaggcaaagccgaatttgccgaactggccttgccgaagtttttagacggcgtttgggatattgcaagcattgttgcggtctcagtcgataacaaacccatcggcgcattcgcacttgccgacgcgttgaaagccgataccgccgaagccataggccgtctgaaaaaacacaatatcgatgtctatattatgagcggcgacaaccaaggcacggtcgaatacgtcgccaaacaactgggcatcgcacacgccttcggcaacatgagtccgcgcgataaagctgccgaagtgcaaaaactcaaagccgccggcaaaaccgtggcgatggtcggcgacggcatcaacgacgcgcccgcgcttgccgccgctaacgtcagcttcgccatgaaaggcggagcggacgttgccgaacataccgcatccgccacgctgatgcagcattcggtcaaccaactcgccgatgctctgctggtgtcgcaagccactttgaaaaacatcaagcaaaacctgtttttcgccttcttctacaatattttgggcattcctctcgccgcgcttggctttttaaatcccgtcatcgctggcgcggcaatggcggcaagctcggtttccgtgttgagcaatgccttgcgcctgaaacgggtaaaaatcgattagcagcatgtaaccgccctgcagccttgtccgaacggataaggctgtctccagcgatatggtaatatgccgtctgaaaccgtttttcaagtaattgatatgaataaagaaacccgttttccggaacacttcgacatcccacttttcctcaaaaacctgcccaacctgccaggcgtataccgttttttcaacgaaagcggcaacgtcttatacgtcggcaaagccgtcaacctcaagcggcgcgtgtccggctatttccagaaaaacgaccattccccgcgcatcgcattgatggtgaaacaggttcaccacatcgaaaccaccatcacccgctccgaatccgaagccctgattctcgaaaacaacttcatcaaagccctgtcgcccaaatacaatattcttttccgcgatgacaaaagctatccttatttgatgctcagcggccatcaatatccgcaaatggcgtattaccgcggcacgctgaaaaagcctaatcaatatttcggcccatatcccaacagcaacgccgtgcgcgacagcattcaagtgttgcaaaaagtctttatgctgcgtacctgcgaagacagtgtattcgagcatcgcgaccgtccttgtctgctttaccaaatcaaacgctgcaccgcgccttgtgtaggccacatcagtgaagaagattatcgtgacagcgtgcgtgaagccgcgactttccttaatggcaaaactgacgaattgacgcgtaccctgcaacacaaaatgcaaaccgccgccgctaatctacaattcgaagaagccgcacgttaccgcgatcaaatccaagcgctcggcatcatgcaaagtaatcagtttatcgacagtaaaaatccgaacaatcccaacgatatcgatttgcttgcactggcggtttcagacggcctggtttgcgtacactgggtcagcatccgcggcggacggcacgtcggcgacaaaagctttttccccgacaccaaaaacgatcccgagccaaacggacaagattacgccgaagccttcgtcgcccaacactatctgggcaaaagcaaacccgacatcatcatcagcaactttcccgttcccgatgcgctaaaagaggctttggaaggcgaacacggcaagcagatgcaatttgtcaccaagaccataggcgaacgcaaagtccggttgaaaatggcggaacaaaacgcgcaaatggcgattgcacaacgccgcctgcaacaaagcagccagcaacaccgcattgatgaactggcaaaaatcctcggcatggattcagacggcctcaaccgccttgaatgtttcgacatcagccacacacaaggcgaagccactattgcgtcctgcgttgtgtacgatgagcaaaacatccagccttcgcaataccgccgctacaacatcacgaccgccaaacccggcgacgactacgccgccatgcgcgaagtgttgacgcgccgttacggcaaaatgcaggaggccgaagccaacggcgagaccgtcaaatggccggatgccgtgttgattgacggcggcaaagggcaaatcggcgtagccgtatcggtatgggaagaactcgggctgcacatccctttggtcggcattgccaaaggcccggagcgcaaagccggtatggaggagctcatactgccttttaccggcgaagtcttccgcctgccgcccaacagcccggccttgcatctattgcaaaccgtacgcgatgaatcgcaccgtttcgccattaccggtcaccgcaaaaaacgcgacaaagcccgcgttacctcctccttaagcgacatccccggcgtaggcagcaaacgccgccaagccctgctcacccgcttcggcggtctgcgcggcgtgattgccgccagccgcgaggacttggaaaaagtggaaggcatcagcaaggcattggcggaaacgatttacaatcatctgcattagcatgctgtcaaagacaaaatccgtctgtaaaaaatatgatacagcaggtcggtataccgatatatagtggattaaatttaaaccagtacggcgttgcctcgccttgccgtactatttgtactgtctgcggcttcgtcgccttgtcctgatttttgttaatccactataaacctaacttcataacgaataacgatgattcgacaaaacggaaaacgatctgacatgaacaatcccgacttaccctatcggcaggccttagaatgcctgtctcaaaaacaatataactttaccgaagtccgccgactgctgacagaagcgttctcggcaggtcatcccgccgccgcattcgagttggcaaaacacctgatggacgcggacagcccctaccaagaccgcgaacaaggtatggaaatgctccgcatcgccgctgaacagggacatccctacgcgcgttacaatctggcatatatccaagaattggaaggcgcacccccggaaaccctgataccgctttacagaccgttggcagaagaaggactgcccgaagcgcaagtccgcctgatgtaccttctgtacgcgtcccgacattttgaagaagccttggaatgggcaaaaacaagcgcaaaaaacaacaacccccacgggcaatacctgcttgcccaatactgccggtacggcacaccgccggattttgaaacggcgcacctgctctaccgaaaatcggcggcacaaggcttgccggaggcacattggcagctcgggctgcaatatcgtttcgggcaagggacgaaagtcgacacggcacaggccgtcaatcatttgcgcgccgccgcacaacaaggatacattcctgcctacaccccacttgccgagctcatcctacctacggctcctgatgaagccgttcactggtttcaacaggccgcacaggaaaatgaccccgatgcccatgccgcacttgccgacatctacctgcaaggcaagcatctggaaagaaaccacaaacttgccctgcatcatgccgaagcagccgccgccgaacgccatcccgaaggtttgcggatactgggcgacatctgccgctacggtttgggcatagcccccgatacggaaaaagcccggcattattatcggcaggcagccgaagccggcagcctttccgcctatcagaaactcatatccgacagcgcgttaaaccatcctgaccaatacggcggcattaaagattccgccatcaggcggcaaagggcagaacggctttatcaaaaagcccaagccctgcattacggattacaatgcgcgcccgaatacgcagccgcgctcaaactctacacagaagccgcagaactcggacacagcaaagcccaaaccaatctgggcagcatgtattacttcggacagggtatgaccgccgactacaatgaagcacgcaaatggtttgaaaaagccgccgcgaaaaaagacagtatggcgttctacaacctcgcctgcatccattacagcggacacggcgtcgagccggacaaagaaaaagcctgccgctacctgcaagaagccataaacaacggatacgggcaaaaaagcgtcctgcaagaactgctgcaacaatggcaaaatgccgtctgaacagcgttacacctaccctgccgaaacgaaacaggtataatcgcccctttcccttcccgccgtccgaacaggcatttcacattcagacggcatcctgattgcacaagcgtacgaaagcattatgacagacaccgccgagaaccaaacacaaaacaactggcaagccggacacccccgcagcatccgcagcttcgtcctccgccaaagccatatgaccgccgcgcagcaacgcgccatcgataccttatgggacagcttcggcatcgactaccaagcaacaccggccgatcttgatgcccgtttcggaagcagccgacccaaaatcctcgaaataggcttcggtatggggacggcaaccgcagaaatcgcccgccgcctgcccgaaaccgacttcctcgccatcgacgtacacggtcccggcgtaggcaacctgctcaaactcatagacgaaaaccatttagaaaacatccgcgtgatgcggcacgatgccgtagaagttgtcgaaaatatgctgcaagacggctcgctcgacggcatccacatattcttccccgacccgtggcacaaaaaacgccaccacaaacgccgtctgatacaagcccccttcatcgccaaactactgcccaaactcaaaaccggcggctatatccacctggcgacagactgggaagaatatgcacagcagatgcttgaagtcctcagtagcttcgacagcctgcaaaatacggcggcagactacgcccccaccccggactaccgccccgaaaccaaattcgaagcgcgcggcaaacgcctcggacacggcgtttgggacttggtattcaaacggatcggataacaaaccactgtttgaaaatgccgtctgaaacatgtttgcttacagacggcattttttcaagataaagcagcaagtgatgtttcgatataaagtttaaaacaatagtttgaacggcaaaacgcgtgtgtaccgcacgcatccttataggttttatgcacatcggttttaaagtttgtgccgcccgcaggtagtatgtgatagctacgcacgcggttggtgtgatgtaggctacggcttgctggttacaaccgtaaaaaagtaagtgccgccattgcggtaaaaacgaagggatttcatagtgttatgctcgtaatgattttgtagattggattctcgaatccgaccttttgggcattgctgcaatggattgcaacgacgggaatgttgaaggttttgtcggatacaagtatccgacctacgcttgttgctatatatcttttgatttaatgactaaatatgacaaagttaaagtgcagattacagcaagcatgatatgcttctttaggcttttatcattccatgatatagatatttcttccttttcattttctttataaaattttaaacctatatcaccatttttccattcctggtggtttactatgattttatttttaaaagaatctcttaaactttcatgtaaagagttaaattttcttgatttacttcccttagtacatggtgagcaattgtatttctaattttatttaatctctcccctatatcatatacttcgctaaataagccaagattacgcgcaatttttagttttgtgcgaaatccaatttgtgtatcattgaaaaaatcttctttattacattttgcatatatccatgcctctaaaattctttcaaaaaataaatgtgttcgtaagattgaacctatttcatcctgtgtttcaatagcttctttcacgatatcaaaaatcttataatcatcaaaatttgaatttttaataaataattctaaattaaaatctaattgagacataataagtgcccatttcaaaaataaatctatattctagttaatataatagttattctaatatctaaattaaataataaactactatttttatatccacgacaaagtctaagtctcactccgccccaaacaacaaattctctttaatatccctaatcctatcccgcaacacagccgcctcttcaaactgcaaatccctagccgcctgctgcatggctttttcgagtttggcgatttctttaatcgcatcttcttcgttgtgaatctcgcccactttaaccttgtttttacctttcagacggcctttactgccgtcttcttcgtggtacacgccgtcgatgatgtctttgacctgttttttaatctgctgcggcacgatgccctgttcttcgttgaatttaatctgtttttcacggcggcgttcggtttcgtcgatagcggctttcatggagtcggtaattttgtcggcgtacaggatggcgacgccgttcacgttgcgcgcggcgcggcctatggtttgaatcaggctgcggtgggagcgcaggaagccttctttatctgcgtcgaggatggcgacgagagagacttcggggatgtcgaggccttcgcgtaagaggttgatgccgacgagtacgtcaaacaggccgagccgtaaatctctaatgatttcaacgcgctcgacggtgtcgatgtcgctgtgcaggtagcgcactttgataccgagttcgctgtaatagtcggtgagttgctccgccatgcgtttggtgagggtagtaacgagtacgcgttcgcctttttcaatgcggtcgttgatttcgctcattaagtcgtcgacttgggtggcaacggggcggatgatgatttggggatcaaccagccctgtggggcggacgacttgttcgaccacttgtccggcgtgttcttcttcgtatttggcgggggtagcggaaacgaagatggtttgcggcatgactttttcaaattcgtggaatttgagcgggcggttgtcgcgggctgaaggcaggcggaagccgtagtcgacgaggttttgcttgcgcgatgcgtcgcctttgtacatgccgccgatttgggttacggtaacgtggctttcgtcgatgaacatgatggcgttgtcgggcaggtagtccatcagcgtaggcggcggttcgccttcttttttgccggaaaagtggcgggagtagttttcgattcctttgcagaagcccatttcgtagagcatttcgaggtcgaaacgggtgcgctgttcgatgcgttgttgttcgacggggcgttgttcgcgggcgaaaaattcgatgcgttcgcgtaattcttctttgatggactcgcaggcgcgcaagacggtgtcgcgcggggtaacgtagtggctggacgggaagacggtgtagcggccgacgcgctggataaggctgcctgaaagcgggtcgaacatatcgaggcggtcgatttcgtcatcaaacaggctgatgcgtaaggcgttttcggagctttcggcggggtacacgtcaatcacgtcgccgcgcacgcggaagctgccgcgtttgaagtccaaatcgccgcgttcgtattgcatggaaacgagcgtggcgatgatgtcgcgctgctcgatggtatcgccttctttgacggacaacaccatttgttgatactcggtcgggtcgccgataccgtaaatggcggacacggtggcgacgataatcacgtcgttgcgcgtcattaggtttttggtggcggaaaggcgcatctgctcgatgtgttcgttgatcgcgctgtctttttcgatgaacaaatcgcggctgggcacataggcttcgggctggtaatagtcgtagtaggagacgaaatattccactgcgttttcggggaaaaattcgcgcatttcggcgtaaagctgggcggcaagggttttgttgtgcgccatgatgatggcggggcggccgctttgggcgatgacgttcgccatggtgtaggttttgcccgaaccggttacgccgagcagggtttgataggcaaggccgtctgaaagcccttcgagcaggcctgcaatggcggtgggctggtcgcctgcgggcgggaagggttggtggagtttgaagggggaatttgggtattggataacttccataatcttgcctgtgatgcgtttgcggacaaagcgtgcagtagggatgggtcggaaacgtctttcagacggcataaggcggtgaaatcctgaatgtatgccgtctgaaacccaatcgctacccaagtatagtggattaacaaaaaccagtacggcgttgcctcgccttgccgtactatttgtactgtctgcggcttcgtcgccttgtcctgatttttgttaatccactataaatgccgcacggttcaaattccggtaaaaaatcgctcataacctgtcctttcaaacataatatgccgtctgaaatcctttcagacggcatcgtcaaaacctacttcttatcttttttatctttcttatctttatttgaaaccggctttttcgccgccagccccaaagacttctgccactgctcgggcgacttgactaaatccaaagctttccgcaactggtcgtctttggcagggttgggaatccgccttgaagacaaatcctcgtcctttttctttttacctttttcttttacagcgggcttatccgcatctttttcaagcggcacggcaagggtttcaccgttcacatcctcgccgcccaagggattgccgatgtgtccgaccaaatccgcctcgcggctttcaaaaatgcgttccttatcttttacttcgacatcgggaacaatcccctgcgcctgaatagaacggtcgttcggcgtataatacagtgccgttgtcagcttgaccgcgctgccgttggacaaaggaatcaaagtctgaaccgaacctttgccgaagctctgcgtaccgacgatgaccgcgcgtttatgatcctgcaatgcacctgcgacaatctccgacgcggaagccgaaccggaattgaccaataccgtcatcggtatggttttcaactcggcaggaatgcccgccaacgaatcgccgcccatcccgtacacataatcttcaggaatggctttcagtaccatgcggtctttgccgtcgcgtcccttggtgctgacgacgactgcttcagacggcagaaatgccgccgacacgccgaccgcgccagtcaaaagcccgccggggtcgtcgcgcaaatccaacaccagccccttgagcggttttcctttattttcctttaccagctcttttgcggcggtattgacgctttcgaccgtccgctcttggaactgcgacacgcggatatagccgtaatcgggttcgatcaggtgatggcggacgcttttcactttaataatggcacgggtcaggttgacgactatcggcttgtcggcatttttgcgcgacagcgtcaaagtaatcttcgtacccggcttgccccgcattttcttcaccgcttcgctgaccgtcatgccgcgtgtcgaaacattatcgattttcacaatgaaatcgccgcttttcacccccgcccgttccgcaggcgtgtcctcaatcggcgaaaccactttgacaaatccgtcttcctgcccgatttccatccccaagccgccaaattcgccgctggtggactcctttatctcggcataaccttttttatccatatattcggaatgcggatccaaaccggccaccatacccttcatcgcaccttcaaacaaatcggcatcgggtttgtcctgatagtagtttgccttgatttgaccgtaaacctccgccattgtgcggatggattgcaccggcaggacttcgttatcccgcctgtccttctcggcggcaaaaccctgcaccgccagactgacggccacgccgctgattgcacccaaagtataaagtgcgattttcttaaaaacaggtttcgacattcttctttaactttctctcttgatttccaaaaaccggaaaatacaggtacggcaaacggcaaacttcacggaacagcgcaccatatcggcacgatttgcataaagcctaccgtttcggcaatccgatcaacgtatccagctcgaagggttcaatacctgaccttgataacgtatttgcaggtaaagcccctcttccccgtccggcagcgacccgctcgagccgattttgcttcctgccgcgaccatataacccttgccgacggaaatttcgctcaaaccggcatagatgctgatgtagttctcgccgtgatcgaccacgaccactttgccgtagccgtccaactcgtccgcatagcttaccgttcccggcgcaatgctttcaaccgttgccggtgcagtggaatagaacacgcctttccaaatatcgccgccgctccggttctgcccgaaaagtccggtcggcacaccgtcaaccggttttttcaaacgtccttgcatgcggctgaaaccgtcggcactgccgatacccataaccgaaggcgcttggatgttcctgtcttcggcggtcagttggacatttccgcacgtcgtgcttcagccttctgctgcgccgcttcttttctggctttttcggctgccgccagtctggcttcagccaattttctttttgcttccgcatcctgaatgcggtgttcggcctttttcttctccaaattgctcaagagcttgttcagctgctgctcgttccctttctgttccagcagttttcgggcatctttggcgattttggcattctgtctgcggctttccgtctgttccgccgcatcggttacaccctgttttttcagcagagattgcacgtttgcctgaattttcttcaaacgggcaagctcattgttgattttctgctcttgtaccgccaaagccttctgctgtttttccaaatccttgacaacttcccgattggaggcgtttacataacgcgtataacgcaaaaagcggtttttctgacccggttcggcgtttttcaggaacagggcaaccgcattcggctggctgtttttatagttccccgatacgaaacgggaaatctgcgctttcgtagcggcgacttccgttttcaaacggttcagctcggtattgagtttttggaacttgtcccaagcctcgcgctgtttgcggttgacggaagcaaggttgccgcgcgcctgacggatacgctcttggcggatacgctcttcctgaagctgtttgagggaattgctgacatgaagcagcattccttcgctttgtttgagcagggcttttttgttttcgacatcattggtggcagcggcaacggcggctttcaattcgtcggaatcggttttggcatttttctcttccctgtattttttgtcctgtttcactgctttgccgttcttgtcggaacggacttttttatttgcagaaacagtgtctttttccgccttgccgcccttgcgcggattgccctgtccttttgcctcttttttgccttgtttgttttcaggctgtgtttttgcgtttttttctttggatccggacacgggcttgccatgtgcctttttgtgttccgccttcgatttcttatccccttcgcgtcctttgcgcgcagactgcctggatgtcgcctccttctctgcttctttgcggtttttggcggtttttttggactctttgccctcttttgccgcctctttgccgcctgtttttttatctttcactgcgccatttttgcctttttcttttttgccttccgccgcttcgggctgttcttttttgttcttcgtctgttttttcacttcggcggaacggttgtgtgccgcgtcgtgggcggcaacggcgggcgtggaaaaaacgagcatcagggcaagcagaaggggtttgtagcgcatggttcgaccttcggaaaaagttggataatactgaaggctgcacgaaagcagccggacgtttggattatactgtcagttatgccgtctgaaaatgccgtttgcccaatcttgcgccttctttgcgcggatacttgcaatcggctcaaacagccttatattgtgcgtcatattttcaatgccgcaacggatattgtgttccgacacacagggtagcacattaagccgcataccgtatgttgcccgattttgggaacgtgcgcccctccaaacaaagcaagccctgccgctttcacggaaaacggggattcaaccgataaggaaattttgatgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctgatatgaacctctccaaccactttctcatcgccatgcccgatatggaagacgcgtttttttcacaatcggtcgtctatatctgcaaacacgatgaagacggcgcactcggcatcgccatcaacaaaccctctccgattacgatggacatgattttttccgccaccggcaaaaacatccccatgcggatgcagcacgacagcgtgatgatgggcggtccggtgcaggtcgagcgcggttatgtcgtgcataccccgatcggcaactggcaaagcagtatcggcgtttcagacaatatcgcgctaacttcttcccgagacgtgattgaaaatatttcacgcgaaggtgcggttgacaaagccttgatcagcataggctattcaagctggagcaaagggcagctcgaacgcgaacttgccgacaatgcgtggctgactgttcccgccgacgaacacatcctgttcgacatcccctacgaacaccgttacgccgccgcattcgccaaactcggcatcgacccgctcgccctgttttcaggagccggccatgcataaaattccaaaaggaacggcactggcattcgacttcggcgaagcgcgtatcggcgtggcacaaggagacgcggaattagggctatcccatcctttgagcaccgttaccggcggcagcaacgatgaaaagttcgcggcaatcgccaagctggttcaagaatggcagccgcgttattttgtcgtcggactgcccgtgcataccgacggcacgaaacatgaaatgacgcacctgtcgcgcaagttcggacgcaggctgaacggcaggttcaatctccccgtctattgggttgacgaacggctgtcgtccgtctatgccgaaagcctgctttcggaagcacaggtcttcggcaaaaaacgcaaatcggtgctcgaccaagtggcggcgcaagccatcttgcacggttttttcgagggcggtccggcggaatgtttcaacgggcgtgagggttaagcggcgcggttaacaccctaccgtgaaagaggcgcgcaccaagccgtccagctccaatgccaaattgtcccccgcaccgattgcgcccacgccggagggcgttccggtaaacaccaaatcccctttccccaaaccgtaatctgccgccagtttgtgtaaaatttcccgaatcgggtaaatcatcaaaccggtatccccgcgctgtttcaatacgccgttttgttttaatgaaaacaacaccttctcgggattgccgattctgcctgccgccgcaaaatccgacacgcacgcggaatgcctgaacccttttgccttcagccagggcagccctttttccttcagacggcattggatatcccgtgccgtaaggtccagccctacaccatatcctgcgacacatcccaaaatatctttaccctcgcccgtgccgtctgaatccttaccgaccagcagcacgagttcgcactcaaactgcacatccctactaaactcgggcagcaagattgtaccgccgctgttcaaaatgctgcctgacggcttcataaacaccacaggttcggaaggtatttcgttttttaactcttcgatatgtgcggcatagttcctgccgatacagaaaatattgccgacctcgactgcctctccttctaaaaatactgaagccacttcactttccccctaagtaaaaatgccgtctgaaattattttcagacggcattcgaccaagcttacgcatttaatgaagctgttacacgtgcaacaatttctccgattgcaactgcctgcgcttcgttgtcgcggcgttcggcgtattcgacattgccttctttcaaggcgcggtcgccgatgacgatgcggtgcggaatacccaacagctcggaatcgttcagcaacacgcctgcgcgttcgtcgcggtcgtcgaggaggacgtctgcgcctgccgccagcaattcggcatagattttgtcggcggcttcgcgtacggtgtctgattttttgtagttcatcggcacgataacgacttcaaacggcgccattgctttggtccagatgatgcctttttcgtcgttattctgctcgatggcggcggcaacgacgcgggtgatgccgatgccgtagcagcccatttccataatttgcgatttgccgttgttgtcaaggaagcttacgttcatggcttgggtgtatttgtcgcgcaattggaaaacgtgtccgacttcaatgccgcgcgccagtttcagacggccttgcccgtcggggctttcgtcgccctcgacgacgttgcgcaaatcgacaaactcaggttcggcagcgtcgcggccgaaattgaagccggtatagtggtagtcgtcttcgtttgcgccgatgacccagtccgcgcctttttcggtagcgaaatcggcatagactttgcctgcaaaaccgacagggccgagagagccgccgtttgcgccgaactgttcgacaatcgcggcagggcttgccatcgtcagcggcgatttcacgcccgcgagtttctcggctttgatgtcgttaaattcatggtcgccgcgtaacagcagcaggataagttcgccttcgttttcgccttcaaccacgatggatttcagtgttttttcaatcggaatactgaggaaatcaaccaatgaatcaatggttttgacgtttggcgtgtgtactttgacgagttctgcctgagcggctgcacgttcgcctttgagcggcaaggtcggcgctaactcgatattggcggcgtaatcggaagtgtcgctgtatgcaatcacatcttcgccgctttccgccaacacttgaaactcgtgcgaaccggtaccgccgatgctgccggtatccgcagcaacgggtcggaacgccaagcctagtcgggtaaagatgcggcaataagcatcatacatatcttgataggtcgtctggagcgaggcatagtcggcgtggaaggaataagcgtctttcatcacaaactcgcgcgcgcgcatcacgccgaagcgcgggcgcacttcgtcgcggaatttggtttggatgtggtaaaagtttttcggcagctgtttgtagctgttgatttctttgcgcacgatgtcggcgatgacttcctcgcaggtcgggcccatgcagaaatcgcggtcgtggcggtctttcaggcgcagcagttctttaccgtaaaactcccagcggccggattcctgccacagctcggcaggctgcaccaccggcatcagcaactccacgctgcccgcgcgcgccatttcctcgcgcacgacgttttcgactttgcgtaacacgcgcagccccatcggcatccaagtataaagacccgatgcgttggccttaatcaggccggcgcgaatcatcagcttgtggctggcaagcgcggcttcggcaggggcttcttttaaagtagagataaagaattggctggctttcataaaagtatttttccaaacaggcaaattcaaaagtaaatcgggtgcagattgtaacgcgaaaaaagcaggttttgcaccaacctccaaaattcaccccctgccccaagcgcgggacaaatcccataacagacggcaaaaacatgaccagaaacatcatattgaacataagcacatgatttttatagatttaaatgtgcctattttttaatcaaaataagcgtacatttgttgcgtaagacttttttaacacaagccgtggcttatcaacacggttatccacaaagcttgtgtatagattttctacaataggaaaattgccgacagagacataatgattcgatataccacaattccgaaaaaatatcgccaaaatcaaacagaatatttcgaaatcaaaaagacttgaccttaccaaacgccaacttcagtataaaacctgcttttacaggcatggttatttgccagcagacccgattgctgataggatttcgtgtggagcagatcgaacatttttttcaagttttcccttgtttccaaaacttttataattttttgaaaacattaaacttaaattatttttttcggtttgatttagaaattttcgtttttgcttattatttttcacaaacgaaaataaaggggttggctacaccctccctgccgattaaacactcaacataaaggatagatactatgtccacccaattacacgatgttgaccctatcgaaacccaagagtggctggacgcgttaagctccgtcctcgaatatgaaggcggcgaacgcgcgcaatacctcttggaaaacctggtcaaatactgccgcgacaagggcgtacgtatgccacacggcacgaccaccccgtatttgaataccgtttcggttgaaaacgaaaaaggcattccgggcgaccaaaacatcgaacaccgcatccgcgcattcgtgcgctggaacgccgccgccatcgtattgcgcgccggcaagaaagatttggaactgggtgggcacatcgcatctttccaatctgccgccaccatgtacgaagtcggtttcaaccacttttggaaagccaaaggcgaaggcgaagaaggcgatttggtcttcttccaaggtcacgtcgccccgggcatctatgcacgcgcattcgtcgagggccgtctgaccgaagaccagctgaacaacttccgccaagaagtggacggacacggtctgccttcctatccgcacccccacctcttgcccgacttttggcagttcccgaccgtatccatgggcttggggcccatcatggcgatttatcaggcgcgtttcctgaaatacttggaatcgcgtggtttggcaaaaaccaaaggccgtaaagtatggtgtttctgcggcgacggcgaaatggacgaacccgaatctcaaggtgcaatcgcactggctgcacgcgaaggcttggacaacctgattttcgtcatcaactgcaatctgcaacgcttggacggtccggtacgcggcaacggcaaaatcatccaagaattggaaggcaactttgccggcgccggctggaatgtcgtcaaagtcatttggggccgccgctgggaccgcctcttggcgaaagacaaagacggtatcctgcgccaacgtatggaagaatgtttggacggcgactaccaaacttacaaatccaaagacggcgcgtatgtgcgcgaacacttcttcaatacgcccgaactgaaagcattggttgccgatatgaccgatgagcaactctgggcattgaaccgcggcggccacgacccgcaaaaagtgtacaacgcctacgaccgcgcagcgaaccatgccgacggcaaacctaccgtcatcttggcgaaaaccattaaaggttacggtatgggcgcatccggcgaaggtcagaacgttgcccaccaagccaaaaaaatggacaaagcgtccctgaaacaattccgcgaccgctttgacattccggttaccgacgaacaaatcgaaagcggcgatctgccttacctgacttttgcccccgatacggaagaatacaaatacctgcacgcacgccgcgatgctttgggcggctacctgccgcaacgcaaaccgacgcaggaagtattggaagtgcccgagctgtcagcattcgacgcacaactcaaatccagcggtgaacgcgagttctcgaccacgatggcattcgtccgcatcctgtccactttactgaaagacaaaaaaatcggcaaacgcgtcgtacctatcgttcccgacgaaagccgtactttcggcatggaaggtatgttccgccaatacggtatttggaatccgaaaggtcagcaatatacccctcaagacaaagaccaactgatgttctataaagaatccgttgacggtcaaatcttgcaagaaggtattaacgaaccgggcgcgatggccgactggattgcggctgcaaccagctacgccaacagcaacttcgccatgattccgttctacatttactattctatgttcggtttccaacgtatcggcgacttggcttgggcggcgggcgatatgcacgcgcgcggcttcctgctgggcggtactgccggccgtacgacgctgaacggcgaaggcctgcaacacgaagacggccacagccacatccaggccgacctgattccgaactgcgtatcttatgacccgactttccaatacgaagtcgccgtcatcgtacaagacggtctgcgccgtatgtatgccaataatgaagacgtgttctactacatcaccctgatgaacgagaactacacccatccggatatgcccgaaggtgcggaacaagacatcttgaaaggtatgtacctgctgaaagccggcggcaaaggcgataagaaagttcaattgatgggctccggtaccatcctgcaagaagtcattgccggtgccgagctgctgaaagccgacttcggcgtagaagcagacatctggtcttgcccgtccttcaacctgctgcaccgcgacgctgtcgaggtagaacgcttcaaccgcctgcatccgctggaagccgaaaaagtacctttcgttacttcccaactgcaaggtcatgacggtccggttattgccgctaccgactatatccgcagctatgctgaccgtatccgcgcctacatcccgaacgactaccacgtcttgggcactgacggtttcggccgttccgacagtcgcgccaacctgcgccgcttctttgaagtggatcgctacaacgttgccgtggccgcattggccgcattggcggaacaaggcaaagtcagcaaagaaaccgttcaacaagccattgagaaatacggcatcaaagccgattcagctcctagctggaaacgctgattgatgtttcagacggcctgtttgccccattccgacatcaggccgtctgaaaaccgaatgcccgaatggtttgagcagacaaaccgtaccgatgccgcctgaagcagctttcagacggcatccaatgaaaaagattaaaggaactcaaatgagtatcgtagaaatcaaagtccccgatatcggcggtcacgaaaacgtcgacatcatcgccgtagaagttaaagcgggcgacaccatcgccgttgacgacaccctgattacactggaaaccgacaaagccacgatggatgtgcctgccgatgcggccggtgtcgtgaaagaagtaaaagtcaaagtcggcgacaaaatctccgaaggcggcgtaattctgaccgttgaaaccggtgccgccgccgccgaagccgccccggctgctgccgaagcacaacctgcacctgctgccgcacccgctgccgcaggcggtgcaaccgttcaagtagccgttcccgatatcggcggccataccgatgtggatgtaatcgccgttgaaatcaaagtgggcgacaccgttgccgaagacgacacgctgattactttggaaaccgataaagcgacaatggacgtaccttgtaccgctgccggtgtcgttaaagccgtattcttaaaagtcggcgacaaagtatccgaaggctctgccattatcgaagtagaaaccgtcggctctgccgcagcagcccctgctcaagccgctcaagctgccgcaccggctgccgctccgcctccgactgctgccgccgcacccgccgccgcgcctgcaccttctgcacctgccgctgccaaaatcgacgaggccgctttcgccaaagcacacgccggtccttccgcacgcaaactggcgcgcgaattgggcgtggatttgggccaagtcaaaggcaccggcttgaaaggccgtatcatgggcgacgacatcaaagcctttgtgaaatccgtgatgcagggcggcgcggcaaaacctgccgcagccagcgcatctttgggcggcggtctggacttactgccgtggcctaaagtggacttctccaaattcggcaatgtcgaagttaaagaattgtcccgcattaagaaaatttccggtcaaaacctgtcccgcaactgggttgtgattccccacgttaccgtacacgaagaagcggacatgaccgagctggaagaattccgcaaacagctgaacaaagaatgggaacgcgaaggcgtgaaactgtccccgttggcgttcatcatcaaagcctctgtttccgcgttgaaagcattccccgaattcaacgcctcactggacggcgacaacctggtgctgaaaaactacttcaacatcggtttcgcagccgatacgccgaacggcttggttgttcccgtcatcaaagacgtggatcaaaaaggcttgaaacaaatcagccaagaattgaccgaattgtccaaaaaagcccgtgaaggcaagctcaaaccgcaagaaatgcaaggcgcgtgctttaccatttccagcttaggcggcatcggcggcacaggcttcacgccaattgtgaacgctcccgaagtcgccatcttgggcgtgtgcaaatcccaaatcaaacctgtttggaacggcaaagagtttgccccgcgcctgatgtgcccgttgagcctgtccttcgaccaccgtgtcatcgacggtgcggccggtatgcgcttcaccgtattcttggcgaagctgttgaaagacttccgccgcattaccttataaaataaaacatccctctcaagcagtctgataatgtttggattgcttgagattgatgagtaatggtgttaaattcaacctttaaattaataacttatgggaaatttcttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacaggtctatatgacggatgttatatatctacgacaacagacaaggaaattgccaagaaatttgcaacaagttccggcatcgaaaatggctatatatatgttttaaatagggatttgtttggtcaatattctatttttgaatatgaggttgaacatccagaaaacccaaatgagaaggaagtaacaatcagagctgaagattgtggctgtattcctgaagaagtgattattgctaaagagttgatagaaattaactaagttgaaaggtcaatataatggctttagttgaattgaaagtgcccgacattggcggacacgaaaatgtagatattatcgcggttgaagtaaacgtgggcgacactattgctgtggacgataccctgattactttggaaaccgataaagcgactatggacgtacctgctgaagttgcaggcgtagtcaaagaagttaaagttaaagtcggcgacaaaatctctgaaggtggtttgattgtcgtcgttgaagctgaaggcacggcagccgctcctaaagccgaagcggctgccgccccggcgcaagaagcccctaaagctgccgctcctgctccgcaagccgcgcaattcggcggttctgccgatgccgagtacgacgtggtcgtattgggtggcggtcccggcggttactccgctgcatttgccgctgccgatgaaggcttgaaagtcgccatcgtcgaacgttacaaaactttgggcggcgtttgcctgaacgtcggctgtatcccttccaaagccttgttgcacaatgccgccgttatcgacgaagtgcgccacttggctgccaacggtatcaaataccccgagccggaactcgacatcgatatgcttcgcgcctacaaagacggcgtagtttcccgcctcacgggcggtttggcaggtatggcgaaaagccgtaaagtggacgttatccaaggcgacgggcaattcttagatccgcaccacttggaagtgtcgctgactgccggcgacgcgtacgaacaggcagcccctaccggcgagaaaaaaatcgttgccttcaaaaactgtatcattgcagcaggcagccgcgtaaccaaactgcctttcattcctgaagatccgcgcatcatcgattccagcggcgcattggctctgaaagaagtaccgggcaaactgctgattatcggcggcggcattatcggcctcgagatgggtacggtttacagcacgctgggttcgcgtttggatgtggttgaaatgatggacggcctgatgcaaggcgcagaccgcgatttggtaaaagtatggcaaaaacaaaacgaataccgttttgacaacattatggtcaacaccaaaaccgttgcagttgagccgaaagaagacggcgtttacgttacctttgaaggcgcgaacgcgcctaaagagccgcaacgctacgatgccgtattggttgccgccggccgcgcgcccaacggcaaactcatcagcgcggaaaaagcaggcgttgccgtaaccgatcgcggcttcatcgaagtggacaaacaaatgcgtaccaatgtgccgcacatctacgccatcggcgacatcgtcggtcagccgatgttggcgcacaaagccgttcacgaaggccacgttgccgccgaaaactgcgccggccacaaagcctacttcgacgcgcgcgtgattccgggcgttgcctacacttcccccgaagtggcgtgggtgggcgaaaccgaactgtccgccaaagcctccggccgcaaaatcaccaaagccaacttcccgtgggcggcttccggccgtgcgattgccaacggttgcgacaacggctttaccaagctgatttttgatgccgaaaccggccgcatcatcggcggcggcattgtcggtccgaacggtggcgatatgatcggcgaagtctgccttgccatcgaaatgggctgcgacgcggcagacatcggcaaaaccatccacccgcacccgaccttgggcgaatccatcggtatggcggcggaagtggcattgggtacttgtaccgacctgcctccgcaaaagaaaaaataaatccgactgaataaacagccgataaggtttatttgagcaaatgccgtctgaaatgttcagacggcattttctattttacagcggattaaaatatcttctccgacctatagtggattaacaaaaatcaggacaaggagacgaagccgcagacagtacaaatagtacggaaccgattcacttggtgcttcagcaccttagagaatcgttctctttgagctaaggcgaggcaacgccgtactggtttaaatttaatccactataaaaacgaatccgacacggcttatctaaaggaatggttgaaaacggcagtttccaatacaacaaaatgccgcctgaacatttcagacggcatttgacccattactgctgcggctctgaaaccataccgccttcatcaaaatccggctccggttcgttttgcaacgttttaccgttcaatttcaactgattgtttttcagagaaatggcagtatcaatctggtcgccgttcaaagtcagatatttttcccttgccatactctgaaccgtactgtccaccatcaggcgcaaggtctcgttgatgtcgtcaagacttgccctgccttccgcctcatcttcggcattgacgctgaaaatattgcctgcttgactgaccgccaagtcttccagcattttttggggaatactcattctgatgtcggcttcggttttcttcagcatcaaacccaattgattcaaatcttccttcttcatgtctttaaacatgatttttccgcccacatcgatttttcccgatggcagcgtgaatcggaaagttttaatgtccaatacgggattgttggtgaacagtccggaagcctctcctttgacggcggcaatcaaatcattgcggatttgttcctcggtcatttttttggcggaaatttgtgcaaacttgcgtttcaatacggttaaggcagaagcatcgaggtgttcggcagcgatatggatgtccagcgggccgtatttttcatcgccgtacaccagtgtatcgaaacggaactgcccttcactgttgataaacgcgcctgattccccggtcttggttgaaaaagccagtttgccgacttcgattttggaaggtgcgatgctgccgttgggattgataaacgcgccaatctgcaaatcggtaacaagattgaccagttcgtttaacttgacgttgtaatcgacaccctctttccattctagggagaatttttccaaggtcagattgctgctgcccaaagcaagcggattgatgccgtctgaagtttccgaatcgaaatgcactttttcaaacgcggcatcgcctttgtctgccagcttgattttaaacaagggggcatcatagccgttccggtagcttttgaaacctttttgataaaccgtttctcccgtcaggccttcccagtgcagccttgatgcccgacagctcttcataatcgaaggcgggaacactgacttccattttaccgctgccgttaaaataaacggtattggcaagggaagccgggacttgttttccaaaaaagcgttccagaactttttccgtttcaggcgcgtatttgaactcggtttcaatgtacgcctgcgtgccgaatccgccggcgaaagggccgtgcgtgatatggttaaccagcgtaaccggctgttccaacactgttttcaggttatccggcaggtattttcgggcattattcagcaactcgggtttcagacggatgaccgtcgtttccatagaggtaaaccagccgcgctcatattggtgcgattcgacggtcaagaagcccgtttcctgcaatattttttgctgctgcgtcaagctttcttcggctttgacacccaaataataaggcgtgcccaaagcaacgccgagcaatgctgccgcaaccgaaatcaaaggttttttcatcacttcaaacaagcaggtttcaaagacgctagaatagcattatttaagcgtatcccgccatatctctttaaaagaaatgccgtctgaaacctgttcggacggcattttccggatatagggaaatcagaaatccaattccgccttcagccagtaagtgcgcggcataccgacgacggcgaagctgcggtcgtattggccgcgctgtacctgccaatagtttttgttgaacaggttttccaccgagctgctgacggtcagagtgtttttgccaagcttggttttgtagcgcgcgcctacgtcaatcaaggtataggacgggaaggcgtattgtttttgcgtgtcttggtcagacttgccgaaatacgaaacattaccgtttaaagtcaagcctttggcaaacggtgtatcccattccaaacctgctttggcaattacgcgcggattggcgacttgtacgccgttaaccagcatatcgcgtgaatttggatactctttcacggtcgattgcagatacatcagacccaaagtcggacgcaaagtattgttgagcaagttcgcgtaggtgttgaactcaataccgcgattgcgttccataccttgctcgtcgccggccgcgccgccttgcgccttatagcgggcgaaatcagaattattgccataggtcagcgttgttgttaccccttttgttgtcttggtagttgtatgaccgcgccagtagcccgggcgtttgatttggaacgcgtttaacgtggttacgaaattgccccagtttttacgcacgcccacttcaaactggcggctgacacgcggtttcgccattgtcgtttcgccggaatcatcggttttgatgtcggcaggctccaagtcttccatatagttgccgtacacaaccaaatcaggttgcggcacccacgccgccatcagcatcgggctgaaacgtttggcatcgccgctctgtgattttttgtcggtatattcgactgtttggaaacgtccgcccaaagtcaggcggtatttgttatccacgaagcccaaggtgtcggacaaagccaggctgttgactttgatattggcatccaagttggcagagttctcccaagaattgggatagtcggctgtaaacgatgccaattgatgctcaatatttccgtttgccttcacttctaccttgctagctccggctgccgttccgcgtgattttttcttattggtgtattcaaccgcttggaaacgtccgcccaaagtcaggacaagcgtccgccggcgttttgaatgtcctgcatacgcgcgcgaccgccgttggttttgcgttttgcgtagatggaatcgaacgctacgcgcagtgtttcgccgcgatagtcggcatttaccgcaaattctttgttgtcttcgctgtaaccgtggcgcggggtgtcgccgtggcgcagtttgccgttggcgcgcacgccgaatgctttgttttcgccgaaacgttggcccaagtcgaacgtaccttgggcgcggttgttgccgaaccgggccaaaccgattttgcggttgccttcatcagcggcttttttggtttcgatattgacggaaccggataccgcgccatcagggttcatgccgtttacggcggtggacgcgccttgaatcagttgtgcggagccgacttgcacgctggtcgtgccttgcgtgccgtacatacctgtcaaaccgttgacgctgaattggcgcgcatcaagctgataacctctgaaatacaatccggtcagcgtgttgctttcgccgccgaactgccaaacggaagcgtcttttttcgctacggcatccaccaaagtacgcgcctcggtgttgttgagggcttgttcgtcgtagttgacgacggtaatcggcgcggtaaaggcgttggctttgcccattcacttggtgcttcagcaccttagagaatcgttctctttgagctaaggcgaggcaacaccgtactggtttttgttaatccactataaacaaatcgtacagggttctccgtttaatcagatatgggtttccatcttcggcagtttcgggcatttagccgtttccaccttcctgcccccgctgccagtaaaaatgccgtctgaaatatcggcgcgatacttcagacggcatacccgcccgttttcccgcattcccgggagcgggctgaaatttaaacgtgtgcggaaatgattttcaacatttgcgccagcactttgggattggcagccacaatatcgccgctttccagccagccgtcttcacccgacatatcggttacgataccgcccgcttcctgaacaatcaatgcaccggcggcaatgtcccacggtttgaggttaaactcgaaaaagccgtcaaaacgtcctgttgctacggcgcacaaatccaaagaagccgcaccttcacgacggccgccggcggtttttgccaagaaatctttcaaaatcgccagatacttgtccatcatgctttgatcgacaacagggaagccggtaccaatcaggcagcggttcagttcgatgcggttggaaacgcggatgcggcggtcgttgagcaacgcgcctttgccacgcgaagccatatatacgtcgttgcgttcgggggcgtaaaccaaagcttcttgcaacacgcctttgtgcagcagcgccatagagatggcgtattggggatgaccgtgaaggaaattggtcgtgccgtcgagcggatcgataatccattcgtactcggctgcggctttgccgtgggagccgctttcttcacaagtgattttgtggtgcggataggcttctttcaaagcctcaaccaggatgatttcggaattgcggtcaacatcggaaacaaaatcgttgaaggctttgctgtcggttttgacggcatcgagattgcccgcggcgcgtatcatcatctgaccggcacggcgggcggctttaaaggctgtattcaaaaacggattcatcagatttccttaagggtggcataccgccggttcggacgtacagtccttcggagcggcaaaatcggagtttatttggttggggtaaatcctgccaaatcgggtaaaataccgcctgacgcgtgtctgcttcaggcgcaacgttaaatttccgacgttgttaaagaacatttcagacggcatttgaccgtccgaacgaaaaagacggcgcattataccctattccattccgaccgaaaaccgaacatgactactctcaaacccgccctgcccgcttatctggacaacatccgcatcatcctcacgcgcaccagccatcccgccaacatcggctctgccgcgcgcgcgatgaaaacaatgggtctgcacaaactgaccatcgtcgccccaaatctgatggcaacgccgatgacggaaaacccgcccgtgtttgacccggagcatcctcaatcgtttaaattaccggaagaaagcttcatcctcgcttccggcgcggcagacgttttggaaaatgccaccattgccgcttctttggacgaagcccttgccgacaccaccatcgcctgcgccctgaccagccgccgccgcgaaattactgcgccgctgcaaaccccgcgcgatttggtatccgaattactgcagaccgcaaaccgaggcgagaaagtggcactggttttcggcaacgagactttcggcttgagcatcgaagaagtccaagcctgcaaccgactgatgaccatcaacggcaatcccgactatttctcgctcaacctcgcccaagccgtgcaggtcgtgtgctacgaaatcttcagccaaaccggttcgcccatgacccatcttcaacaagaagaccacgctgcgacccacgagcaaatcaaaggcatggtcgcccacatggaaagcgtgatgaacgacatcggctttttcaaccgccgcaacggcgagcgtctgatgcgccgtatgcagagcctgttcggccgcgccaatacgcaaaccgaagacatcgatatcctgcgcggttttttcaataccgtcagccaccgtatccataaaaaagactgattaaggccgtctgaaaacatttccagcttttcagacggcatgactgatattcggataagcatgaattacgccctagacgcattatggtggaaacttaccagccaacccgtccgcgaccttgcctcgctgctgactgcgccgcctttgtggcaaagcggctgcgaattgagcgtgcgagaactactgggagaacacggtttccgttaccttttggcattggatgccgatcccacgcggctgacggattacctcgcccaacgcgccccgttcggccaccgtctcggcatttatgccgaagagctgctggctttttggtttgccaatgcaccgcacgccgaactgctcgcgcacaacctcacggtttccggttcggacggcaatacgcaaggcgcggcggattttgtggcaaggcttaacggcaaaccctaccatatcgagctgacctgcaaatattacggcggcgacacggacagtcccgaagggatgcgcggattcgaccccaaagacacgctgttgggaaaagccgccaaactgaccgcccaactcggtctgccgcacacttcagacggcatccggaccttgcggcagcacggtttgccgcttaacgtaaaacccgtttccatcgtgcgcggcatcggattttttccacacggtttccatgcttttgagccaccgcttaatccatacggttggcgcggcatctatattcaagattgggcggaatacgggtttaaacgccaagaagtccgctaccatctgctcgaccgtatggcctacctcgcgcctgcgcgtgtcgccgaaaccgaaacattgaacgcaaccgaaatccgccgtatcgaccaaggcttgattgccgttttggaatgtcggccggacggcttttggcacgaaatcgaacgcattatgaaggccgtctgaaaccctttcccaacattaacgcgtatatctattgagaggcttagtgatggaaatctcatttcccatacaatttatgaaagagtcatccgagttaataaggatattggatatgataaatataacaacaacatgccaactaatattatgacgatccaaacaaataagtatggtaatttaataactacgaccccaggtagaatacaatgaagaataatgttaaaaattggacaactaaagaagtcaagcaatcattagataaatttaataatattttaattaaaaatacttttcttcttcagtatctgaaaaaagagttttcagcttcaagtgcttattgtttgtctatgctccctgaagaagaagatatatatgaaatattggttaatgggaatattattattgatttagaatttaataaacatacaaatgaaacagttgttattaatgttactgatgttgatgaatacttgaaaactttaaccaatgagagtggtagagtattttttacattagcaaaagaaatcggcaaacagaaaaacatttaacaagagcgaaatacaaattaaaaactcaatggagtgatggcatatttaggatagatatactgaacgaagaaaataaattttgtttttttcctcatgttttagggagtgattacaaaatgaaatcgctgatgtgattatatcggatgctgttcaagcgacctgaaaatagaacttttttcaggctgcctttgtagttaacggagaaatttagacaaatcccgattgcgcacttttaacacatctttcttattgcggatagaatactaagtaatgataaagatgctattgttattttaaggacgttagattgattatgaataacccacagtaagagaacccattacattatgaacgccgcacaactcgaccataccgccaaagttttggctgaaatgctgactttcaaacagcctgccgatgccgtcctctccgcctatttccgcgaacacaaaaagctcggcagtcaagatcgccacgaaatcgccgaaaccgcctttgccgcgctgcgccactatcaaaaaatcagtaccgccctacgccgtccgcacgcgcagccgcgcaaagccgctctcgccgcactggttctcggcagaagcaccaacatcagccaaatcaaagacctgcttgatgaagaagaaacagcgttcctcggcaatttgaaagcccgtaaaaccgagttttcagacagcctgaataccgccgcagaattgccgcaatggctggtggaacaactgaaacagcattggcgcgaagaagaaatcctcgctttcggccgcagcatcaaccagcctgccccgctcgacatccgcgtcaacactttgaaaggcaaacgcgataaagtgctgccgctgttgcaagccgaaagtgccgatgcagaggcaacgccttattcgccttggggcatccgcctgaaaaacaaaatcgcgcttaacaaacacgaactgtttttagacggcacactggaagtccaagacgaaggcagccagctgcttgccttattggtgggcgcaaaacgaggcgaaatcattgtcgatttctgtgccggtgccggcggtaaaaccttggctgtcggtgcgcaaatggcgaacaaaggcagaatctacgccttcgatatcgccgaaaaacgccttgccaacctcaaaccgcgtatgacccgcgccggactgaccaatatccaccccgaacgcatcggcagcgaacacgatgcccgtatcgcccgactggcaggcaaagccgaccgtgtgttggtggacgcgccctgctccggtttgggcactttacgccgcaatcccgacctcaaataccgccaatccgccgaaaccgtcgccaaccttttggaacagcaacacagcatcctcgatgccgcctccaaactggtaaaaccgcaaggacgtttggtgtacgccacttgcagcatcctgcccgaagaaaacgagctgcaagtcgaacgtttcctgtccgaacatcccgaatttgaacccgtcaactgcgccgaactgcttgccggtttgaaaatcgatttggataccggcaaatacctgcgcctcaactccgcccgacaccaaaccgacggcttcttcgccgccgtattgcaacgcaaataaaccggtttgaacaaaatgccgtctgaacccttttcaaagcgttcagacggcatttcatcaattatagtggattaacaaaaatcagtacggcgttgcctcgccttagctcaaagagaacgattctctaaggtgctgaagcaccaagtgaatcggttccgtactgtttgtactgtctgcggcttcgtcgccttgtcctgatttttgttaatccactatatttttgggaatctgttttaccccaatatataaagcaccatattaaggcggagtgtcttccccactttgacccgaacccggaaaagacaccgcccaagccaatcctgatgctgccccgacagccaaccattaaggaaatcctaatgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaggcggtgggaaattcaaatgcaaaaaacaaggatgatttgattcggaaatacaataacgccgtaaacaaatactgccgttaatcggctctagcgcaaacccgatgccgtctgaagcggcacggggtttgtcatttctgccagtaggttttgacgttgacgaactcgtacagcccgaattcggacaattcgcgcccgtaaccggaatctttgactccgccgaaaggcaggcgcaaatcgctgctggtatggcggttgataaacaccgatcccgcctgtattttttcggcaaaccgccaagcgcgttcggtatcggcggtataaatgcaggcaccgagcccgaacggggaatcattggcaagggcgatggcatgttcttcgttttcggcgcgcaaaatcagggcggccggcccgaatacttcttctctccagacgcggcaggcaggatttaccctgtctaaaaccgtcgcgggataaaaccagcctcgcccttgtgggatttttccgccggtcaggcataccgcgccgtttgaaacggcatcttcaacctgcccgtgaaccctgtcccgcaaatcttcgcggtgcagcggtgcaagcgtagtatcgggatgtttggggtcgcccattttcaatttagcgcattcggcaagaaacagcgtgataaaacgatcggctgcggcttcggttacgatgatgcgcttggcggcgttacacgattgccccgcatcgcggaaacgggaataacaggcttctgcggcggcacgctccaaatcagcatcgggcatcacgataaaggcgttgctaccgccgagctccaacacggttttcttaaggtttgcgcccgcgtgtgccgcaaggatgcgccccgtatgcgttgaaccggtaaacgccattgcatcggtatcttcaaccgccttgagcgtgcccgcctcatccagccacacgcctgccagaggaatgccgtctgaagccaaatcgaacagtgcctgactgacgcgtgccacgctgggcgcgggtttgacggcgcacgcgttgcccgcgcacatagcgggaacggcgaaacgcaatacctgccagacgggatagttccaaggcatgacggcaaacaccacgcccaaaggctcgaagcgcacctgactcaaactcgcctgcgtcgcgatggttttgtgggcaagcagttcgggggcaaggcgggcgtaatagcgtatcagttcgatagacttgccgatttccgcacggcattcgtgcaagcagcgtccgacttcctcacacaccatttccgcaaaacgctctttctccgcctccaaacggtcggcaaatttttgcaggcgcgcggcacgttcggttacgcccagttgcgcgaacgccccgccgcgcattttcaaatccgccagccgccgttcaaactccgcataatcttgagcggggcggcggtaaagcgtttcgcccgtaaatacattgacactgtgaaacatcgaatcaacctgccagttgcgggaatatcgttttcagtcccgacacaataatctccaccgataccgccgccagcatcatacccataatgcggtttaaaatcgtcagccccgtcgcgcccagcaggcggctgaccttcccggcaacgattaaaatggcataacaaatcgcactgaccaccaaaccggccgcgataatcaacgcgatgtcgccgtatgttttagccgccgaagcgtaaataatcacggtcgaaataccgcccgggccgatggtgatcggtatggcgatgggcacgacggcaatcgctccggcattgcgggcggggcgcgcctgccccgtttccggctgcgcgccgagattctgcttggcgggattgtcgttgccgttcatcatcgaaatggcgatcagcagcaccaaaatcccgccgccgacctgaaacgaaccgacgctgatgcccaaaaccttcagcagcgtaccgccgatcagcgcaaataccgcaatcacggcaaacacggcaacggcggccgtccgcgcgaccttcctgcgctccttcgtgctgtgcccgttggtcaggtcaaggtaaagcgacaacgcgctaaacggattaatcagcaccaaaaaagccacaatcagcttgccgatttccatgcccaatcccattatttccccctccttcaaacccgtgcggcaggcatccgatgctgcaaattgccgccgcaacggatttttccgttataattaaaaattcaagcaatacgccccatcatacccgaacgacggtatctttaccatcagacaaggatgcttttcatggcactgacacttgccgacgtagacaaaatcgcccgactctcccgactgcacctgactgcggaagaaaaagaaaaatcgcttcaagaattaaacgacattttcactatggtcgaacagatgcaaaccattaacacagacggcatcgaaccgatggcgcacccgcacgaggccgccctgcgcctgcgcgaagacgaagtaaccgaaaccgaccgcgccgccgaatatcaggcgggtgctccggaagtacgcaaccgtctgtacatcgtaccgcaagttatcgaagaataatccgaatatgcttcagacggcatcagcaataccgcccgaagccctttaaggatggaagatttatgacccaatacacattgaaacaggcaagcgtcctgttgcagtccaaacagatttccgccgtcgaactggcaagcgcataccttgccgccatcgccgaaaaaaatcccgccctcaacggctatatcaccatcgaccaagataaaacccttgcagaagcccgtgccgccgacgaacgtatcgcgcagggcaacgcctccgcgcttaccggcgtacccgtcgcctacaaggatattttctgccaaaccggctggcgcagcgcgtgcgcttccaaaatgctcgacaacttcatctccccctacaccgccaccgtcgtccaaaacctgctcgacgaaggtatggtaacgctcggccgcaccaatatggatgagttcgctatgggttcgaccaatgaaaactcattctacggtgcagccaaaaacccatggaatcttgagcacgtccccggcggttcgtcaggcggttccgccgccgtcgttgccgcgcgcctcgcccctgccgcgctcggttcggacaccggcggctctatccgccaacccgcatcgcactgcggcattaccggcatcaaacccacatacggcacggtttcccgcttcggtatggtcgcctacgcctccagcttcgatcaaaccggcccgatggcgcaaactgccgaagactgcgcgattctgttaaacgcgatggcaggtttcgaccccaaagactccaccagcctcgagcgcgaaaaagaagactacacccgcgatttgaaccaaccgctcaaaggtttgaaaatcggcctgcccaaagaatatttcggcgaaggcaacagcgccgatgttctgacggcattgcaaaacaccattgatttgctgaaagcccaaggcgcggaattgattgaagtttccctgccgcaaaccaagctgtccatccccgcctactacgtcctcgcctccgcagaagccagcaccaacctttcacgttacgacggcgtacgttacggacaccgtgccgcccaattcgccgatttggaagaaatgtacggcaaaacccgcgccgaaggtttcggcagcgaagtcaaacgccgcatcatgatcggcacttatgtactgtcgcacggctactacgatgcctactatctcaaagcccaaaaactgcgccgcctcgttgccgatgattttcagacggcatttgcacggtgcgacctcatcctcgcgccgaccgcacccactgcagccccaaaaatcggagcggatgcttcgccggttgaaacctacttgagcgatatctacaccatcgccgtcaacctcgccggactgcccgcattgaccctgcccgcaggcttcagcggcggcggactgcccgtcggcgttcagcttgtcggcaactacttcgccgaagccaaaatcctcggtgcggcgcatcaaatccaactcaacagcgattggcacggcaaacgacccgaatgaagcagaaccgcacctttaccttccccgattttcgcaccgtttacagctatgcgcctttatatcggctgcaacatttaaaatacacattgcgaaaatttttcggaaaaaaagaaatttacgccttcgagcagtttgtcaacgcatcccctatccgtcaggggctgttcctccactgcccgcaaaatgcctatccgctgctgcgcgaatttgttgacaggcgttttaactgcaaacgccgtttagatgcgatgacggcagattttctcatggcggaaaaactgttcggcacagacatcctgcaccaaatggaagactaccgcttccatttggtcttggcgcacctttcagacggcatcagcttgtggctcaaccgcaacgacaactgcgtcgaagaaggcgcgtggtctttatctttgcgcgacgaagcaggcaaccggctgtatatggcgactttcgcctttgtcggcacacacctgctgacagcctccgtacaagggccggcgggtgaagaagccaaagacaccgtccgccgcataaccaaacaactccacggcttgcgtccccaacaactgatggtaaccgccctgcaatatttcgccgccgtactcggcttggacggcgcaatgggcattgcacaaaaacatcaggtcaaactgcgctggaaacttaaaaagcgcgtcaaaatgaattacgacgcattctggcaggaatacggcgcaagtttggaacgggacggctactggcatctcccccaaacccccgcccgcaaagaccttgccgacatcgaaagcaaaaagcgttcgatgtaccgcaagcgttatgaaatgctggacaatatggttgcagagatgaaagacagtctgaaaacagaagcacgcggcatttcagacggcatccaaacggaaaaaccgccccgccggacagcctgacgcgaagactatcgaattgatattttagagaaagaagctcttatgacctgggaaaccgtaatcggcttggaaatccacgtccaattgaacaccaaatccaaaatcttcagcggcgcatcgaccgcattcggcgcagaacccaacgcgcacgccagcgtagtggaatgcgcgctgccgggcgttttgcctgtgatgaaccgtgaagtcgttgaaaaagccatcaaattgggtttggctttagatgcgaaaatcaatcagaaaaacgtgttcgaccgcaaaaactacttctatcccgacttaccaaaaggttatcaaatcagccagttggacttaccgattgtcgaacacggcaaattggaaatcgtagtcggcgacgatgtgaaaaccatcaacgtaacccgtgcgcacatggaagaagacgcaggcaagtccgtgcatgaaggcttgaacggcgcaaccggtatcgacctgaaccgcgccggcacgccgctgttggaagtggtatccgaacctgaaatgcgttccgccgccgaagccgttgcctacgccaaggccttgcacagcttggtaacctggctggacatttgcgacggcaatatggcggaaggctcgttccgcgtcgatgccaacgtatccgtgcgcccgaaaggtcaagaagagttcggcacgcgccgcgagattaaaaacctcaattccttccgtttcttggagcaggcgattaattacgaagcggaagcgcaaatcgagattttggaagacggcggcaaagtacagcaggcaaccatgctgtttgatcccgaaaaaggcgaaacccgcgtaatgcgcctgaaagaagatgcgcacgactaccgctacttccccgaccctgatttgctgcccgttatcatttcagacgcccaaatgcaaaaagccaaagcagaaatgcccgagctgccgaaagaaatggcagcgcgtttcgtggcggattacggcgtgtccgaatacgacgcgcgcctgctgaccgcaagccgtgcgcaggctgcctattttgaagaagccgccaaagaaagcggacaaggcaagctgactgccaactggatgaacggcgaacttgccgccgcgctgaacaaagaaggcatggaacttgccgacagcccgattaccgccccgcgcctcgccgcgctggttggcaaaatcgccgacggcacattaagcagcaagttagcgaaaaaagcctttgaagccatgtgggcagaacccgaagccaccattgccgaaatcattgaaaaacacggtttgcaacagatgaccgacaccggcgagattgaagccatggtggacgaagtgctggcaaacaacgccaaagccgtggaacagtttaaatccggcaacgaaaaagccctgaatgcgattgtgggacaagtgatgaaggccagcaaaggcaaagccaaccccgcgcaggttcaagagctgattaaagccaaactggcttaatccgttatcacacaggtcgtctgaaagcaaagttccaacgaaggtaaaacaggaaataagctttcagacggccttttatagtggattaaatttaaaccagtacggcgttgcctcgccttgccgtactatttgtactgtctgcggcttcgtcgccttgtcctgatttaaatttaatccactataacttaatctgctcaaaccataccaagacatgaaccacaccgttaccctgcccgaccaaaccacctttgccgccaacgacggcgaaaccgttttgaccgctgccgcccgtcaaaacctcaacctgccccattcctgcaaaagcggtgtctgcggacaatgcaaagccgaactggtcagcggcgatattcaaatgggcggacactcggaacaggctttatccgaagcagaaaaagcgcaaggcaagattttgatgtgctgcaccactgcgcaaagcgatatcaacatcaacatccccggctacaaagccgatgccctacccgtccgcaccctgcccgcacgcatcgaaagtattattttcaaacacgatgtcgccctcctgaaacttgccctgcccaaagccccgccgtttgccttctacgccgggcaatacattgatttactgctgccgggcaacgtcagccgcagctactccatcgccaatttacccgaccaagaaggcattttggaactgcacatccgcaggcacgaaaacggtgtctgctcggaaatgattttcggcagcgaacccaaagtcaaagaaaaaggcatcgtccgcgttaaaggcccgctcggttcgtttaccttgcaggaagacagcggcaaacccgtcatcctgctggcaaccggcacaggctacgcccccatccgcagcatcctgctcgaccttatccgccaaggcagcaaccgcgccgtccatttctactggggcgcgcgtcatcaggatgatttgtatgccctcgaagaagcacaagggttggcatgccgtctgaaaaacgcctgcttcacccccgtattgtcccgccccggagagggctggcagggaagaaatggtcacgtacaagacatcgcggcacaagaccaccccgacctgtcggaatacgaagtatttgcctgcggttctccggccatgaccgaacaaacaaagaatctgtttgtgcaacagcataagctgccggaaaacttgtttttctccgacgcattcacgccgtccgcatcataattccccggtataaagaggattcgagctttccgttcagaacacaaaaaacttcccgtccgtgttttccccgtgaaaaaatgccgtctgaaacccgattccggttttcagacggcatatgttttttcctgttcaaggcgacagccgctcgcgtatccagccaccatccagcaaacggtattggatgcggtcgtgcagcctgctcggtctgccctgccagaactcaagcaaatcgggaatcacaatatagccgccccaatgcggcggacgcggcacatgcagaggatgtttgagtccaaccgccgccgcctttgccaccaataccgccttgttcggaataacctcgctctgcgcacttgcccacgcacccaaacggctctgatacgggcgactctcaaaatattcgtccgacaacttctccgccagcctttcaacacgcccttccacgcgcacctgacgctccagctccggccaaaaaaacgtcatcgccgcaaatggatgagcatccagcgaacgccccttgcggctgtgataattcgtaaagaaaacaaaaccttcagaattaacttccttcagcagcaccatacggctgttgggcctgccgcgtccgtcaaccgccgccacattgaccgccgtcggctcgttgacctgtgcgcgtaccgcctcgtccaaccaccgctcgaactgctcgatcggattatcggcgcaatcggcttccgacaattcccgtttgctgtaatcttcccgaatattgtgcaaatccatttactgctcctcttatcatttgaaagattctactcccgcacgcaaaccgatttcaaccgtcgcacaaactttgccccgaccccaagccgcagcgacgatttcatccgcaaaaccgccgcatcaggtacaatatcgaaccgtccgaccgaggacggcattttatcaacccgtcctgccgcacacgccgcagaagaaccgccttatcaggcgagttaggaaaaatgatgtccaaacagcccaccagcaaacgccaatggcgcgacggcgcagccccgtctgccaagaaaaccgccaaaccgttcaaaagcaaagcccgtcccaaagatgaaacgggcaaaaccgcttcccaaccttacggacaaaaagcttcagacggcatcaaacctcaaaacgtccccaaacagcgcgccgccaaagccaaaaaactcgtcgtccgcaatcccaaccaaaaaattatggaacacgcgcgcgatttgaaagaacgccgcagcgacctgtcgcgcatggaacccgaacgcctgcaaaaagtgcttgccgcgtccggcgtcggctcgcgccgcgaaatggaagaatggattaccaacggctggataacggtcaacggcaaaaccgcgcaactgggcgacaaagttacccccgacgaccacgttaccgtcaaaggcagcatcatcaagctcaaatgggcggaccgcctgccgcgcatcatcctgtattacaaacaagaaggcgaaatcgtttcccgtgacgacccgcaaggccgcgtcagcatattcgaccgcctgccgcaggccgccagcagccgctgggtcgccatcggacgcttggacatcaacaccagcggacttctgattcttaccacctccggcgaactcgtccaacgtttcgcccaccccagcttcgaagtcgaacgcgaatacgccgtgcgcgtcttgggcgggctgaccggcgaacaaatgcgcgtcctcaccgaagaaggcgtgatgctcgaagacggcttggcaaaagtcgaacgcatccgcgaacaaggcggcgaaggcgcgaacaaatggtacaacgtcgtgattaaagaaggccgcaaccgcgaagtgcgccgcatttttgaaagccaaggactcaccgtcagccgcctcgtgcgcatcggcttcggtcccatcggactgcccaaccgcctcaaacgcgggcagttctacgaactcaaccccgccgaagtcgccaacatcatcaaatgggcggacatgctgctgccgggcgaacgccgccgcaaaaaagcctaaacccgccaaaacacaaaaatgccgtctgaaacatctgctgtttcagacggcattttattcgggcgttttcaggagaaaaggtcgagtgctttgacaaagaccatcaccacgccgtaggcgagcggtatgacggccaatgcccaacgccaccagaccgatatgccgccgccggaaactttttcgcccacaaggtaagcgtcggatatggcggtttcgtcatcggggttgccgctgtgtgcggcggttttgatgtctttttcgtggtgtttttcgtgtacggatttgacggcgaggttgcacaacaaaccgataatcagcaggcacgccatgatgtacatggttacgctgtatgcctgtgccgccggtatgccgctgtcgatttggctttggcgtatgtaattgaccagtaccgggccgatgacggcggcggttgaccaggccagcaggatgcgtccgtgaatcgcgccgacctgataggtgccgaacaggtctttcaggtaggcgggaatggcggcaaatccgccgccgtacatggaaataatcacgcaaaagccgatgatgaacagggctttgctgccgccctcgccgatggagggaacggcgaaatacagcagcgaaccgagtacgaagaagatggtgtaggtgtttttgcgtccgattttgtcggaaacgctcgaccacaaaaagcgtccgcccatgttaaacaggctcaggaggctgacgaagcctgccgccgcacctgcgccgactgctgcctgcctgcctatggaggtttcggaaaagagttcctgaatcatcacggatgcctgacccaatacgccgatgccggcagttacgttcaggcacaatacccagaacaacagccaaaactgcggcgttttcatggcttgggacacgttgacatgattgctgctgaccagcttgttttgcgttttcggcgcggtatagccttcaggtttccagccgtcggcaggtacgcggatggtaaacgcgccgaacatcatcagtgcgaggtaaagcagacccaatacggcgaaggtttcggcaaccccgaccgaagcagcgtttgaaaaggtgttcatcagtgatacggaaagcggcgaggccagcattgcgccgccaccgaaacccataatcgccaaaccggtcgccatacccggcttgtcgggaaaccatttcatcagtgtggaaaccggcccgatgtagcccaaacccaagcctacgccgccgatgacgccgttgcccaaatagagcaggaagaggttgtgcgtacgcacgccgaatgcggatacgaagaagcccaggctgaagcagcaggcggcggcaaatatggctttgcgcggccctacccgttccatccacgtaccgaacagggcggccgacgcgcccagcatcgcgagtgcgatactgaaaatccaacctacggtcgtcagcttccaatctccggccgccgattcggttatgccgataagtttggtcagcggcgcgttgaatacggaataggcgtaaatctgcccgatggcaaggtgtaccgccaatgctgcgggcggtacgagccaacggttgaaacccggcttggcaatgcttgcctcacggtctaaaaacttcataacatcctctttctgtcagttgaaaaataaaatttcatttgcccaatggaaacttattgaaaattataaaaaaatatcgggtcgggtttttatccgccccaagatgcgccgtctgaaacatttcgggtgtacggaaaggtttctgttttttccgacaaattcctgcggcttttcgcttccggattcccgctttttcaggaatgacgaattaaagattatcttaaggtcaagggactggattcccgctttcgcgggaatgacggcggcgggggagcggtttttccgattgggtttaaatgcaatcgaacaaatcctgctgcccttgttctttgcttacgcgcacgtcggtttcgccgtcggcgaagataatgtgcagcttctgcccctgcttcaaaacatcggcgttgcggatgacttgtccgcgtgtgtttttgacgacggaaaagccgcgctccagaatgtgctgcggcgaaacggcttcgagcaatgcggcttgggcagtcaggctttggcggcggtgggtaagcagttggtggaaggcgtgcgacagggccgtctgaaagcggtcgatgttttttttgcaaacggaaacatcaggacggcaatgtttcagggcttgggtttggcgttcgaaacgggcggtgtgggtacggacgttttgcgtcatcgagtaagacagcgtttgcgccagcttgccgattgaagcgcgctgttcgtcgagtttttggcgcggatgacggatttgccgcgccagccagtcgagtttttggctggcatcgaaatagcgttgttccaaaacggttttcagacggcattgggcttgggcgaggcggtgcagcgattcttggcggttggggctgaccagttccgccgcaccggtcggcgtgggcgcgcgcatatcggcgacgaaatcggcgagcgtgaaatcggtttcgtggcctacgccgctgacgaccggaaccgtgcaggattcgatggcgcgcacgaccggttcttcgttaaacgcccacaagtcttcaatgctgccgccgccgcgacagacaatcaacacatcgcattcggcgcgttgcgaggcggttttaatcgcttgggcaatttgcaattcgctgcctgcgccttgaacgggtgtcggataaacgataacggggatttcgggtgcgcggcgtttcaaggtagtaacgacatcgcgcaaagccgccgccgccagactggttacgatgccgatacattgcggacggacgggcaaaggtttcttgcgttccgccgcaaacgcgccttccgcctgcaactgcgccttcaaccgctcataggcttcgtaaagctgccccaaacctttgagccgtacttcgtttacggtaatctgaaattcgccccgcgcttcataaatactgatttttcctgatacctcgatatggtcgccttctttcaaaggcttcgccaaacgcaccgccgcacccttgaacatcgcgcaacgcacctgtgcgcggctgtctttgagcgagaaataataatgcccgctggcggcacgggtcaggttggatacttcgccggcaatccacaaaccggcaaggtggttttccaaaagacttttggcaaatgcgttcaactcggaaacggacaacacgtcagaatgaaaaaaatcagacatcgaatcaatcaaatagtaaaaaatatgaatatgttttgaagcctaaggcggcaccgggccgcctaaattgtcaacaatattataacacgcgccatcttgccgcccgccttttcccgtatgacttttttaagcggggaatgggaaaaatattcatcaacctgcctgcaatctattcaaattgcaccgccggcaggctatgatgcggatattttcgacaggaggaaaaatggatacgcaggcagttatcacacatatcgcccgatggttggacgaatacgccgcccgggcaaatgcaaaagggtttgtcgtgggcgtttccggcggcatcgattccgccgtcgtctccgcactcgccgcccgcaccggccgccccacgctgcttctggatatgccgatacgccaacaccccggccagcttgagcgggcaaggctgcacatccgcaatctgcaacggcaatatgccaatgtaagcgcgcaaacggtcgatctgaccgacaccttccagacctttgaacaaaccgtcggtgctcatcagacggcatttgacagtcagccgctttccctcgccaacgccagaagccgcctacgtatgctgaccctgtactactacgggcagatacacggactgctggttacggggacaggtaataagattgaagatttcggcgtgggcttttttactaaatacggcgacggcggcgtggacatcagcccgattgccgacctgaccaaaacgcaggtttaccggcttgccgaagcattgggcgtggacgaggcgattcaaaaagccccgccgaccgacggcctgtgggatacggaacgcaccgacgaagaacagatgggcgcaagctatcccgaactggagtgggcaatgggcgtgtacggcacgcgcaaacccgaagattttgaagggcggcagcgcgaagttctagaaatctatacgcgacttcaccgcgccatgcagcacaaaatcaacccgattcccgtatgccgcattccgcccgaattgctgggctgaaacacggaaatgccgtctgaaacggaaaaccgtatttcagacggcatggaaatatccgactcctatcccttaagaatcgagtacgcgggcaaacaaaatatcgttttccaaatgaatgtggtcgttcaaatcctccaccatttctttcgccagcgcgtaaagccgcgtccagcttccgcaagccccttctggcggttggaaattgtcggtcagctctttgagccgtgcgatggcgcggtcgtgttcttcgtgttcgtgcatcatcacgccgatgggcatcgccgcaccgcgtccgacaccctgattaatcatcggaaacagcatcctttcctctttcatcatatgcatcagcagttcgttctgcatataggcaagcagctcggcaatttccgccggaaaggtgtcggcatgaacttgggccactttttgcgccagcggcaccaattcttcaaattgtgcacggtggacattgtggtagcgttgcaggatatgatcgacggttgcaccaaagggggcggtctcccaaacggaaaaatcagtcatcgcagtgttccttttacagggtttcgggtttggttttgaacattcatactttaagaatcaattcaaacggagcatacaccgcccgcgcgcttctgtacagcgtcaaacgtattccttacattttgctaataaaagtaattttcagaaataaaatactgtccgaaccgttttttagaatttgcaaaggcgattggggcggtacagaaaaactattatcccgcccgcccacttgaaatttttatgcccaagccctatcctgcacgctatcgtgccaatcccaaccgaaaaggaaaaataatgagcagc

SEQ ID NO: 36 - DNA, 20352 bp, Neisseria meningitidis
ttataatgaatcataactatcaaatatatcgttaaactggatggattaaatacctttaaaatgcagcttaacctacatcaataaagtgccacaaaaagggaaaattggaaactaaagcaatggcggtcgggttgtaatttattataacaatatgatttatatgtaataaaaaacagattaagcaaagggctcgtcggcggtgcgaatgtaattccgcttggcgtaataaggcagatatgttaaatttagaaaaaattacgcttgcccggattgcaccttaaacaggctgcggaagcggcaggataaaaatctttattcccataaattcatggagactctcatggacacacaaacttacaactacaaagtggtgcgccagttcgccatcatgactgtagtttgggggattgtgggtatgttggtcggcgttatcgtcgccgcccagctttttgctcctgccctcgacttgtctaatatcggaccttggttccacttcggccgcctgcgtccgctgcacaccaatgcggttattttcgcatttggcggttgcggcctgatcggcacatcatactacgttgtccaacgtacttgtaatacccgtcttttcggcggttggctgccggcatttaccttttggggctggcaggcggtaatcgttgccgccgtcgtcagcttccctatgggttggacccaaggtaaggaatatgccgaactggaatggccgatcgatattctgattactttggtttgggtggcttacgccatcgtattcttcggtacgattgccaaacgtaagattaaacatatttacgttgccaactggttctacggcggctttattttggcggtcgcacttttacacatcgtcaacaatatcagcatcccggccggtttgatgaagtcataccccgtctattccggtgcgattgatgctatggttcaatggtggtacgggcataatgccgtgggcttcttcctgactgccggcttcttgggtatgatgtactatttcgtacccaaacaagcagcccgccccgtttactcctaccgcctgtccgtcgttcacttctgggcgttgatttttacctatatgtgggcgggtccgcaccatcttcactacactgcgctgcctgactggacgcaatctttgggtatggttctgtctttgattctgttcgcaccctcttggggcggtatgattaacggcatcatgaccttgtccggcgcgtgggacaaactgcgtacagacccgattcttaaattcctgattgtatccttgtccttctacggtatgtctacctttgaaggcccgatgatgtcgattaaaacggtcaatgcattgagccactatacggactggaccgtcgcgcacgttcatgcgggtgcgttgggctgggtaggctttgtaaccatcggttccgtctattacatgattccccgtctgttcggcaaagaacagatgcacagcaccaagctggtagaagcacatttttggattgcgaccatcggcgtggttctgtatatcgctgccatgtggattgccggtgtgatgcagggtttgatgtggagttctttgaacgatgacggtacgctgacctactcgtttgtcgaatccgtaaaacgcaccatgccttactacgtgatccgttttgcaggtggtttattgtatctgagtggtatgtgcattatggcgtacaacgtgtaccgcacagccatcggtggtaaagcagtcgatgccgaaatccctgcggtttcccaaacacagcaccactaaaatactaagaaagataggctaccaaaatgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactcgcaaatgattcgtccgttccgtgcggaaaccgagcgttacggtcattactctgttgccggagagtcggtttacgaccatccgttccaatggggttccaaacgtaccggtcctgatttggcacgtgtgggcggtcgctattccgacgaatggcaccgtatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcacctgaggctttggcaaacaaatccgagctggatgctgtagtcgcctatctgcaaggattgggtctggctttgaaaaacgtaaggtaacatcatggatattaacggtattcgtgctctcttcacggtatggatctttatctgtttcctgttggtactctatatcgtcttcaacaggcggaataagaaaaactacgataatgccgcaaacagcatttttgatgaaaaccaagatgcgcaagataagaaaagcgaaaaccgttaatattgtgataacggagcaaaacaatgaacacaacatcccaatttaccagtaatttctggaatatatatattgcagttattgtcttactgagctttatcgctttggcttggctgctgctgtctcaaaatgttgtcaaacgtccgaagaagggcgaagaagtacaaactacgggtcatgagtgggacggcattgccgaatacgacaatccgctgccccgctggtggttttggctgtgtgttttgacgtggctgttcggtatcggttatttggttatgtatccgggtgtcggcgactacaaaggtctgctgaaatggaccagccataaccaatatgaaaaagaggtcaaaaaagccgatgagcaatacggcaaactgtatgccaagtttgcggatatgccgattgaaaaagtggcaaaagaccctcaagccaagcaaatcgcccaaaacctgtttaacacttattgtatccagtgccacggctctgatgctaaaggctctaaaggttttccgaatctgaccgatagcgattggttgtggggcggtgatcccgataaaatccacgagaccatcgaaaaaggccgtgttgcgactatgcctgcctggggtcctgctttgggcgaagaaggcgtgaaagacgttgcccattatgtgatgtccctttcaaaacccgaaggtcagtatgatgaggaacgtgccgcgcgcggacaagccttgttcagcggtccgcctgccaactgtttcacttgccacggcgataagggacaaggtatccaaggtttgggtccgaacctgactgatgacgtgtggttgtggggcggtacgcaaaaatccattatcgaaaccattaccaacggtcgcagcagccaaatgcccgcttggggacatttcttggataaagacaaactgcatattatgactgcttatgtatggggtctttccgataaagacggtaaagctccggtgaaaaaagccgagcctgcaccgactcccgcaccggcggcagaacccgcagcctctgctcctgcagaagcagcacaagccgtgtccgaagccaaacctgccgcagcagaacctaaagccgaggaaaaagctgcacctgctgccaaagcggacggcaaataggtttatgaaaccgtttgtgccgcctgccatggcaatgcgattccgggtattccccatgtaggcatcaaagccgattgggccgaccgcatcaaaaaaggcaaggacacgttgcacaaacacgcgatcgaaggtttcaatacgatgcccgcaaaaggcggtcgcggcgatttgagcgatgatgaggttaaagctgcggttgactatatggtcaaccagtcaggcggcaaattctaacttgactgagtttccgatattatcggttatgaaaatccagattcagtattgaatctggattttttgttttaacgggcatccggttttaaacgcagactgcctatttgttgtaatgaattttgactttagtcataaagaattagtctttattgtttataatcgcgcatcatcacgatagccctattttcaaaaggacgattaatggatacacaaatcaaaactgaagccgacaatcagagcaaccggcgttatctgaccgtttggcggtggcatttttatgccggtctgctggttatgccttttcttaccctgcttgccgttacgggtttgggtatgctgctgtttgccaatattaccggtaaggagggcgagcggattcatgttgtgccgcaggcaacggtacaacctctgtctgttcaggcggaagcggcacgcagtgccgttaatccggaaacttcgtccgtcgttcagtatattgcgccgcgtgccgatgatatggttgccgtgttccgtgtcaacaatgagggcaaagcaacgatggtcgcggtcgatccttatacggcaaaagtggtcagtaccatgccgcgcaatcagggttggtattacacgatggatgaaatccacagcgatatgatgctcggtgcggcaggcgattatcttttggaaacggcagcttcactgaccattattatggttgtcagcggcttgtacctttggtgggtgaaacggcgcggcatcaaggcgatgctgctgccgtcaaaaggcagggcgcgttcttggtggcggaatctgcacggcacgtttggaacttgggtgtcgttgattttgctgttgttctgcctgtcgggtattgcttgggcgggtatttggggcggcaagttcgtacaggcttggagtcagttccctgccggtaaatggggtgtcgaaccgaaccccgtttcagtcgtgccgacccacggcgaggtattgaatgacggcaaggttaaggaagtgccgtgggttttggagcttacgcctatgcctgtttcagggacgactgtgggcaaagacggcattaaccctgacgagccgatgacattggaaaccgtcgaccgctttgcgcgggaaatcggtttcaaagggcgttatcagttgaatttgcccaaaggcgaggacggcgtatggactttgtcgcaggattctatgagttacgacatgatcagcccgtttgccgaccgcacggtacatatcgaccagtacagcggcaaaatccttgccgacatccgttttgacgattacaacccgttcggcaaatttatggcggcaagcattgcgctgcatatggggactctgggctggtggagcgtgttggcgaacgtcttgttctgccttgccgtcatttttatcggtatcagcggctgcgtgatgtggtggaaacgccgtccgaccggagcggtgggcatcgttccgccggcgcagaaagtcaagctgccggtttggtggatgatggcattgccgctattggcaatcgcactgctcttcccgacctcactgcttgccattgccgtgatttggctgttggatacgctgctgttgtcgcggattcctgttttgaggagatggtttaaatgaccaaatgccgtctgaaaggttcagacggcattttgtttgaaggcggacgggggaaaggctatataatcccgaatacttgaccacagcttctgtttgaaatcatgttttatctgtatcaatccaaccgtcttgaaacgctggcggcattgtttgcccgcattcaaaaagtcaaaccgctgaaatcggctttacagcccgaacagattattgtgcagagtcaggggatgcgccgctacctcaatacctgcctcgcccgcgatttgggcgtggcggcgaatttgtcgttcagcctgcccgccggcctgacgtggaagctgatgaaaaaactgattcccggtattccggaactcagcccgtttgcgcccgaagtcatgcgctggcggctgctggatttgttccgcagcgaggcatttcggaatacggcagaatttgaagatgtgaggaatgtgctgcaagactatctgggcagcggcgaatcggcagattaccagcttgcgggacagcttgcggacatattcgaccaatacctcgtgtaccgtcctcagtggatagacgcttggcagcagggcaggcggctcggtttgggcgacgacgaaatctggcagtccaaactgtggcgttacctcgacgacggcaggcagagcgcgccgcaccgtgtcgcgttgtgggaaaagctgttggaatctttgagcagtgataagctgcccgagcgttatttcgtgttcggcatttccacgatggcgccgatgtatttgcaacttttgcacaagctgtccgaacattgcgacgtgttcgtgttcgcactcaatccgagcgggatgtactggggcaacgtcatcgaagcggcgcaaatcctcaaaggtggcggcgatcccgatttaactcaggcagggcatccgctgctcgcctcattgggcaagcaggggcgggactttttcgactttttgaacgaaatggaaatagaaggcgaaacgccggtatttgaggaaggcgggcgcgatacgcttttacacgccctgcaaaccgatattcaaaacctgaaaatgccgtctgaaatggcgggaagcgtcaacacgggcgacggctcgatacgcatcgtctccgcacacagccctttgcgcgaattgcagatactcaaagacaagctgttgaaaattctgcatgaacatcccgattggcagccgcacgatatcgccgtattaaccccgaatatcgaatcctatacgccttttatcgaagccgtgttcggacaggcgcagcccggtgcgcaggcattgccgtattccgtgtcagacgtgaaaatcagccgccgccaaccgctgtttcatgctttgtcatgcctgttcgacttgttggaaagccgatttgaagtcgataaagtgcttgtgcttttagaaaccgcgcccgtgttgcgccgtttcggactgactgaggacgatttaccgcttttgcacgacatggttgccgatttgaacgtccactggggtttggacggagaaatgcgcggcggcacggatcagctgttcacctggaagcaggcggtagaacgcatgatattgggctggatgctgcccaaaggcggcaatccgatgtggcaggatgtcagcgcgtggtatgccgacgtgaatcaaaccgccatgttcggacgttttgccgccttcctcgaaaccctgacggatattgtacggatatggcggcagcccgcaacggtcggcgaatgggtggcgcgttgccgggatttgcttgaaacattgttccaagctgaagccgatgaccaaaagtcagtccaaaaccttgaaaacgaatgggtcaaatggcaggcggaaaccgaattggcgcaattttccggacagttgccgccgcacaccgtcatccgccatatccgacgctttctcgacagcgaaagcgaggcaggctttttacgcggcggcatcaccttttgcagtatggtgccgatgcggagcctgccgttcaaagtcatctgcctgttgggtttgaacgacggagattttccccgtaataccaaagccgccgtattcgacctgattgccaaacatcccgccaaaggagaccgcgcccgccgcgatgacgaccgctacctgttcctcgaagccctcatcagcgcgcgtgaaatcctctacctgtcctacatcgggcgcgacatccgcaaagacgaagagcttgccccgtcttccctgttgggcgaactcatcgataccgttgccgctatggcgggcatcggtagccgccaacttgcacaaaacctgatagaacagcatccgctgcaagccttctcgcgccgatattttcaagaaggcggacgttcagacggcatattcggcacgcgtaccgactacgccgccgcgctcggacaaacgcccgaaccgccgcaaccctttttcgatcaacccgtagaaaacgccgaacctgttgccgaaatcggacaggacgaatttatccgtttctggcgcaaccctgtcaaagtatggcttcagcagcagcttgcgtggagcgaaccccatatcggcgaagcctgggagcctgccgaacccttcgagccgcaacacgccgatcaaatcgccgaaatctacatcgaagcacggtgcgaaggacgggattttgcccaaaccgccgcccgcatcggggcggaaagcctcctgccgtcgggagagttgggcagactttggcagcaggacttccaaactgctgccaaacaaatcgacacggcggttttaaacagccccaaactgccaccgctttcatatgccataccgtcggacgggcaaatcctgaaaggcagcttgggcaatctgtaccgctgcggacaagtgttttacgcctacggcaaacccaacgcgccgcaacgtatcgcttttctgctggaacacctgatattttgcgccgttatgccgtctgaagccgaaatgcggcaaacctttatcgtccaatccggagaaaccgaaatattggcggaaatcgcgcaagacagggcattgcagctattgtcggaatggatggcgtttttcaatatcgggcaaaaccgcccgctgccgttttttgccaaaacctcgcttgccaccgccgaagcgtttgcccaaaaacaagattgggaagccgccctgaaaaaagcccaaaccgcctaccacggcagcaaagtcagcaaagggcagaaagactataccgaagtcgccctcgtgttcggcaacgcaagccaaaacccgctcgaacagcccctgtttgaaaacctcgtccgtctgcttgccgacacgcttgccgcagcggaaaaaaaggaagaggccggagaagcctgacgggatagaaaggcaaatgccgtctgaaagcgtttaagcatttcagacggcattttgtttatcgtgtttaaggtgcgggatagaatgtgggcgcgccgggaccgacgggcaggcccaaaacaaatacccaaatgcagaataaggcaatccacgcaatcaagaagaaagcggaatacggcaacatcatagaaatcagcgtacccacgcccgcatcttttttgtatttgatcaccgtcgccataatcagcccgaaataactcatcatcggcgtaataatattggtaacggaatcaccgatgcggtaagcggcttgaatgacttcgggcgcgtagccggccaacatcagcatagggacgaaaatcggcgcagttaccgcccattgcgcggaggcggagcctatcatcagattgataaaagcacaaattaaaataaaaccgataaacaacacgctgccgcccaagccgacttcttttaagaacgtcgcccctttaacggcaatatattgcccaatattcgtccaattaaaaaatgcgacaaactgtgcggcaaaaaagatgatgaccaaataaagccccagagtactcatcgattcggccatcgcattaacgacttcctgttcgccgcgcaaacttcgggttacccggccataaacaatgcccggcagtgcaaacaacaagaaaataaaaacaacaatcgattttaaaaacggcgaaccggaaaccaatcctgtttcaggatgacgcaaaataccgtcggcagggacgatgctccaagccaatagggcggataaggcaacaaacaccacgccagcccaaattaatcctttatattccaaaggcgtgatttcattggaatgccgaatgtctttttcttcttgtgacaaatctgattgataagggcccaattgcggttcgacgattttttcagtaacaaaataaccaatcaaagcaatcacaaacgtactggctaccataaaaaaccagttggcttcagggcctacgacgtagtcgggatggatgatttgcgccgcctgttgggtgatgcctgccaagagcggatcgattgtgcctaagaacagattggccgaataaccgcccgaaacgccggcgaaagccgcagccagaccggcaagcggatggcggccgagggaatgaaagatgatggcggacaaagggattaggacgacatagcccaattcagaagcggtattagataaaatccctgtaaaaacaaccataaaagtagtgagtttgcgtggcgattttgtgagcaataagcgcattaatgcggaaatcaagcccgatttttccgcaatccccacgcccaataaagaaaccaacaccgttcccaacggcgcgaaaccggtgaaatttttaacggtatgcgtcaggattttgataaaaccgtcggcattgagcaggctgacaatgtaaatcaaaccgtcatcggcacgtcctttcgcaccaacagggcgcggatcggggacggatagtccgaaatacgcaccgacggcagaggcaatcagcaataacacaatgaaaataataaaaagcgtaaccggatgcggcaacatattgcccagccattcgactgtgcgtaaaaatcgtccgtcccgttgcgtatcggtttgactcatctgcttctccttaaaaaaatatattgagtgcattaaatttttgaatgtaacatgaagtgttttgtaagcaaactaaaataatcgcatatgtatataaccgcaatagattaaaacagaaaatgcccacatcgttattctcataaaggcggtaatccgaaaacttgacgttaaagccttatcaggaatgactggaactcaaaaaacggtttcccgttttcgcggaaatggcgggattttcagtttttatttgcaaaaatgctggagaaaaatgcagtttacattttgaatggtattgttattaattgtaaataaatattggaaggtaaatgatatgaaaaatgaaattcaaaaaaatatggacaaatataatccctggcatgaagatgattttgagtcgtatgaagacattgccagagatgtatcgctgacgacagataaaacgttcattgaacattatttgttagaagtttattcagaagaaaacggacattttgaccaagagaatgtccatgcaatgatagaagaaattaaaaatgcaatttagtgaatatgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaataagattgagcataaaattttagtaacctatgttattgcaaaggtctcaatatgtatttttagaagaaggctttgtgtcattttgatgccgtctgaaagggtttgttcgtttcagacggcattgctaccaaggcttgattatttccggcgcaggtcgggatggttttccaagttgtccatcattatcccgatgatgcgcggggcggttttgcccaaatcgaaacgttcgcaggaagagaaccaccgccaaatcagcccgtccaaggttgatttgatgaagataactgccgtttccttgtccaaatcgtcagccaaatcctgattttccaccgcttcggtcaaaacggcggtaattttctcgcgccagattgcctgatgcttgcgggcaatggcgataacggcggcgttttgctccgtgtgttcgcattttaaaaacaggatgttgtggaatttgtagtagatgtcgttgctttgcagccgctcgaaaaagtgcagcagcgtgtggcggaataccgcccaagaccctccttcggcatcttcggcatcttgcgcgatgcagttttcgatgtcgtcgcagatacgttggaacagcgcgtcgaacaagtcttccttatttttgaaatgccaatagagcgcgccgcgcgttacgccggcggcttgggcgatttcgttgagcgaggtgcgcgcaatccctttgcggtaaaaggtttccaaggcggcaagcatcaggtgttctttggtttttaaggcttcggttttggtttttctcataatggcggtttcgtttcgggtcggtttgatgagggcggattataaaaaagactttgtaaccatgcaatcgtgtatgtataatgaaacccatgaaattgagactacatctcaactttgaaaacccatgaaacctgcttcgcaacccgtttgaacatcgggttggcgaagcaggcggtttttatatcctgaaatatagtggattaacaaaaatcaggacaaggcggcgagccgcagacagtacaaatagtacggaaccgattcacttggtgcttcagcaccttagagaatcgttctctttgagctaaggcgaggcaacgccgtactggtttttgttaatccactataagaatgcctgttgattggcaaaaccctttacatcaaaccagacagataggataaataatggctttttatgcttttaaggcgatgcgtgcggccgcgttggctgccgccgttgcattggtactgtcgtcttgcggtaaaggcggagacgcggcgcagggcgggcagcctgctggtcgggaagcccctgcgcccgtcgtcggtgtcgtaaccgtccatccgcaaaccgtcgcattgaccgtcgagttgccggggcgtttggaatcgctgcgtaccgccgatgtccgcgcccaagtcggcggcatcatccaaaaacgcctgttccaagaaggcagttatgtccgtgccggacagccgctgtatcagatcgacagttccacttatgaagcaggtctggaaagcgcgcgcgcgcaactggcaacggctcaggcaacgcttgccaaagcggatgcggatttggcgcgatacaagcctttggttgccgccgaagccgtcagccggcaggaatacgatgctgcggtaacggcgaaacgttctgccgaggcaggcgttaaagcggcgcaggcggcaatcaaatccgccggcatcagcctgaaccgttcgcgcattaccgcgccgatttccggctttatcggtcagtccaaagtttccgaaggtacgttgctgaacgctggcgatgcgaccgtactggcgaccatccgccaaaccaatccgatgtatgtgaacgttacccagtctgcatccgaagtgatgaaattgcgccgtcagatagccgaaggcaaactgctggcggcggatggtgtgattgcggtcggcatcaaatttgacgacggcacagtttaccctgaaaaaggccgcctgctgtttgccgatccggccgtcaacgaatcgaccggtcagattaccctgcgcgccgccgtaccgaacgatcagaatatcttgatgcccggtctgtatgtgcgcgtgctgatggaccaagtggcggtggataacgcatttgttgtgccgcagcaggcggtaacgcgcggtgcgaaagataccgtgatgattgtgaatgcccaaggcggtatggaaccccgcgaggtaacggttgcgcaacagcagggtacgaattggattgttacgtcgggtctgaaggacggggacaaggtggttgtggaaggcatcagtatcgccggtataacgggtgcgaaaaaggtaacgcccaaagaatgggcgtcgtctgaaaaccaagccgccgcgcctcaatccggcgttcagacggcatctgaagccaaacctgcttctgaagcgaaataaggaaggcatcgatggctaaattttttatcgaccgccccatttttgcgtgggttatttcgattttcattattgcggcgggtattttcggcatcaaaagcctgccggtttcgcaatatccgtccgtcgccgccccgaccatcaccctgagggccacttatccgggcgcgtccgcgcaggtaatggaagacagcgtgctttccgtgatcgagcggaatatgaacggcgtggaaggtttggattatatgtccacttccgccgattcgagcggcagcggcagcgtgagcctgacctttacgcccgataccgacgagaatctggcgcaggtggaagtgcagaacaagctttccgaagtattgagcacgctgccggcaactgtccagcaatacggcgtaaccgtatccaaggcgcgttccaatttcctgatgattgtgatgctttcgtcggatgtgcagtcaaccgaagagatgaacgactacgcgcagcgtaatatcgttcccgagttgcagcgtatcgaaggcgtggggcaggtacgcctgttcggcgcgcaacgcgcgatgcggatttgggttgatcctaagaaactgcaaaactacaatttgtcgtttgccgatgttggcagcgcgctgtccgcccagaacgtccagatttcagcgggttctatcggttcgcttcccgccgttcgcggacagacggttacggctaccgtaacggcgcaagggcagttgggtacggcagaagaattcggcaacgtcatcctccgcgccaataccgacggttctaatgtttacctgaaggatgtggcaagggtcggactgggtatggaagactattcttcctcaacccgtctgaacggtgtaaataccaccggtatggcggtgatgctgtccaacagcggcaatgcgatggcgacggcaaaggcggttaaagaacgcatggcgacgttggaaaaatactttcctcagggtatgagctggaaaaccccttacgatacttccaaattcgtcgaaatttcgattgaaaaagtgattcacactttaatcgaagcgatggtgctggtgtttgtcgtaatgtatctcttcctgcaaaacatccgttatacgctgattccgaccatcgtcgtaccgatttcgctgttgggcggtttcgccttcatctcttatatgggcatgtcgattaacgtactgaccatgtttgcgatggttttggtcatcggcatcgtggtcgatgacgcgattgtggtggttgaaaacgtcgagcgcattatggcgggtgaaggcttgccgcccaaagaagcgaccaaaaaagcgatgggtcagatttcgggcgcggtcatcggtattaccgccgttctgatttccgtgttcgtaccgttggcgatgttcagcggggcgacgggcaatatttacaaacagtttgccctgacgatggcgtcatcaatcgcattctccgccttccttgcgctgacccttacccctgctttgtgtgccacaatgttgaagacaatcccgaaagggcatcacgaagagaaaaaaggtttcttcggctggtttaacaagaaattcaacagttggacgcacggttacgaaggccgggttgccaaagtgctgcgtaagactttccgcatgatggttgtctatatcggcttggcggttgtgggcgtgttcctgtttatgcgcctgccgacttcattcctgccgaccgaagaccaaggcttcgtcatggtcagcgtgcaactgcctgcaggagcgacccaagagcgcaccaatgcgactttggcgcaagttacccaactggcgaaaagcattcctgaaatagaaaacatcattaccgtttccggcttcagcttttcgggcagcggtcagaatatggcgatgggttttgccatattgaaagattggaacgagcgtaccgcgcccggcagcgatgccgttgcgattgccggcaagctgacgggtatgatgatggggacgcttaaagacggttttggcatcgccgtcgtcccgcctccgattctggagttgggcaacggttcgggtctgagcatcaacctgcaagaccgcaacaataccggccataccgcattgctggcgaagcgcaacgagttgattcagaaaatgcgtgccagcggtttgtttgaccccagcaccgtccgtgctggcggtttggaagactcgccgcagttgaaaatcgacatcaaccgtgccgcggcggcggcgcaaggcatttcgtttgccgacatccgcaccgcattggcaagcgcgctgagttcgtcttatgtcagcgacttcccgaaccaaggccgtctgcaacgcgtgatggtgcaggccgacgaggatgcccgtatgcagcctgccgatattttgaacctgaccgtgccgaacaaatccggcgtcgccgtaccgctttccaccattgctactgtttcttgggaaaacggtacggaacagagcgtacgcttcaacggttatccttcgatgaagctgtccgcttcgcctgcaaccggcgtttccaccgggcaggctatggcggcggttcaaaaaatggttgacgaattgggcggcggttacagcctggagtggggcggacagtcgcgcgaagaggcaaaaggcggctcgcaaaccctgattttgtacggtttggcggttgcagccgtatttttggtacttgccgcgctttatgaaagctggtcgattccgctggcggtcatccttgtgattccgttgggtttgatcggtgcggctgcgggcgtaaccgggcgcaacctgtttgaaggactgttgggcagcgttccctcgttcgccaacgacatctactttcaagtcggtttcgttaccgtgatgggtttgagtgcgaaaaatgcgattttgattatcgaatttgccaaagaccttcaagcgcaagggaaaagcgcggttgaagccgctttggaagccgcccgcctgcgtttccgtccgattatcatgacctcgttcgcctttattttgggcgtggttcccctgtatattgccggcggtgcaagttctgccagccagcgcgccatcggtacaaccgtattctgggggatgctcatcggcacgctcttgtccgtgttccttgttccgcttttctatgtggtggtgcgcaaattcttcaaagaaaccgcgcacgaacacgaaatggcagtaaaacacgccgccgaagcgggcatcaccggttcggacgacagccaacattaagcaaccatgccgtctgaacgcccacgggttttcagacggcatcaggacttttttatggatactacattgaaaaccaccttgacttctgttgcagcagcctttgcattgtctgcctgcaccatgattccccaatacgagcagcccaaagtcgaagttgccgaaacgttcaaaaacgataccgccgacagcggcatccgcgccgtcgatttaggttggcatgactattttgccgacccgcgcctgcaaaagctgatcgacatcgcactcgagcgcaataccagtttgcgtaccgccgtattgaacagcgaaatctaccgcaaacaatacatgattgagcgcaacaacctcctgcccacgcttgccgccaatgcgaacgactcgcgccaaggcagcttgagcggcggcaatgtaagcagcagctacaaagtcggactgggtgcggcatcttacgaactcgatctgttcgggcgtgtacgcagcagcagcgaggcggcactgcaaggctatttcgccagcaccgccaaccgcgatgcggcacatttgagcctgattgccaccgttgccaaagcctatttcaacgaacgttacgccgaagaagcgatgtctttggcgcaacgtgttttgaaaacgcgcgaggaaacctacaagctgtccgaattacgttacaaggcaggcgtgatttccgccgtcgccctacgtcagcaggaagccctgatcgaatctgccaaagccgattatgcccatgccgcgcgcagccgcgaacaggcgcgcaatgccttggcaaccttgattaaccaaccgatacccgaagacctgcctgccggtttgccgctggacaagcagttttttgttgaaaaactgccggccggtttgagttccgaagtattgctcgaccgtcccgatatccgtgctgccgaacacgcgctcaaacaggcaaacgccaatatcggtgcggcacgcgccgcctttttcccatccatccgcctgaccggaaccgtcggtacgggttctgccgaattgggtgggttgttcaaaagcggcacgggcgtttggtcgttcgcgccgtctattaccctgccgatttttacctggggtacgaacaaggcgaaccttgatgtagccaagctgcgccaacaggtacaaatcgttgcctatgaatccgccgtccaatccgcatttcaagacgtggcaaacgcattggcggcgcgcgagcagctggataaagcctatgacgctttaagcaaacaaagccgcgcctctaaagaagcgttgcgcttggtcggcctgcgttacaagcacggcgtatccggcgcgctcgacttgctcgatgcggaacgcagcagctatgcggcggagggtgcggctttgtcggcacaactgacccgcgccgaaaaccttgccgatttgtacaaggcactcggcggcggattgaaacgggatacccaaaccgacaaataaccggtcgggcaataaaatgccggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccggatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggccgtctgaaacgataaggtttcagacggcatttctttctttatagtggattaacaaaaaccagtacagcgttggctcgccttagctcaaagagaacgattctctaaggtgctgaagcaccaagtgaatcggttccgtactatttgtactgtctgcggcttcgtcgccttgtcctgatttttgttaatccactatatgtttgacggttgcggtcaggctgcgcggcgtgccgtaaacgtgaatgtcgggcatagggcggtagcgtttgttgaacacgttttcaaagtccaaaccgatgcgggtggatttgccgattttgtaatgcgcggtcaaatacagtgtggcgtaggggcgttgggtcaatgcggctgcggcggcagggaagaaaccgccatacccgtcggcatcccgaagccgaatacggcaacggcaagcgcaatcagcagcgtataaagccccgcctgatagcctttcagcttcaggacggtcagcgcggcaaagaaaaagacgatgggtaagagtgcggcggcggcagtcagatacaggctgccgccgattgccgtgtagttttgaacccaagtttccataattgaacatctccgaaaatatttttctaatcgtcggcaatagtggtcaaaccaattaaagcaacgttgcattactttacgaaactttaatatttaggtcaatatatttttgggcggttcggcagatttgaatcggagcttttgtttaaatcctgtcaaaacaaatatttgcatgaacaaaaattgtagtttggtgtagttttttcttgtgtttcgggggcggtgcgaggtaaatrccgttgacggcgggaacggcgtgtcattagaatccgccctgattggtcagtccaatttgatgtttgatgtatagtggatgaacaaaaaccagtacggcgttgcctcgccttagctcaaagagaacgattctctaaggtgctgaagcttcaagtgaatcg

SEQ ID NO: 37 - DNA, 32051 bp, Neisseria meningitidis
atcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatagggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataaaaatggcaatttggaattatcggtactaccttatcccatcagctgctatcagaaataaatttaatgcaaataaagatatcatacttgatgagtatcgatctaatggttttcagaattttaatgagaataaaagttttgaaaattactttatcgataatgatgttatattattatcaataataaatgaagcaaaaaaacagcttaaattgaaagaatcttgggataaagacgcaatcatgttttgtgataattttggtaatagtcttaccgtttggccagatgatatagagtgcgaacttgatttaagatttgattatactaaatttattcagaaaaccattgattgggcaataaaatataattgtctacttgtaatagaaaaaacaggaaatgtagtttcccctaatataaataatctgatgtatgaaataaaagcatatttggaaagcaagccgtggcccatatgaaacctaaactcaacaagtaggatgtgtgcggaacgcacgtatgcggttctcaaggtttgagctaagaggccgtctgaaaacagaaaaactgtttcagacgacctttcttttaaccagttgccacagcaaccggacaaaagcagcctacctccacatccatataggcaatacaggggagatattttgtaaattctacgaatattttacctgctaaacagggtaggatatggtatgaagcgaacattggcttaataaacactatgtcaagatcgaatcaggctggtactagattgttgtattccaattatggattgctatatataacaactgatcattatatctctgcaacacggtttgtagcttggaaataggagtataacttatgcaattagagattatcggtagtaaaatttatacggaacaagattttcataatcaaatttcaaaaatattttctatacaagattattatgggaacaatcttgatgctttatgggatttattaagcacaaatgtagaacgaccgattactttggtatggaaagatgctatgttctcaaaaaatcaattagaaaatatatttattgaaatcgtaaatgttctagaaagagttaagaaacaagatgaggattatggattcgaagaaaaatttaattatattttagagtaagtaaaccctaattacattacgtacacaggcttaaaactccccagagccaattaagcaagccgtaacccatataaaacttaaactcaacaagtagcatgtgtgcggaacgtacgcatgcggttcttaaagtttgagctaagaggccgtctaaaaacagaaaaaccgtttcagacggtctttgtttaacgccaccgatccagcgggttacaaagcgcagtcaatgccgctgcgccttatgcctccgaagcaataggcagaacatttggacacggtgaaaacaaaaacgaaaccgcccaagccgtcggacatttccttttaggagcagctattgcccgcgtcaacggtggtaattttgctgccggcggctcggcagcagttgcagctgaaaaggcggcggaacatcttgcccaacagtataacgacggtaaaaccgcaatcgatccgcaaacaggcgagttcaatgccaacctgctgccggaacatatcaaagaggaaatcaaatcaaagagcggggtgattgcatcgctgacgggcgcggccgtgggcggcacgccggtagatgcgcaaaccggaggtgcggtcggacagaatgcggtggaaaacaacctctatctgacatcggaagccttaaagaaggacaagcagacagctcgtaaaatttattccgtcataaaagagcaagtcaagcatgaatgcagttccacaggaagaattaccgaatgtcgtcaaaatataggacgcattatcgaatttacccaagacaaacgctttgacagtaggtttaaggacttaaaaaaagaatccttatattacctaaataaacatcctgatttagtagcctcttatttgaaggctgaatacgaaaagctggatagggaagacaaaagtatcctgcaccgctacatctcacccggggctgaaatcgtttcgggcagtttgggggttgttctttcaggagtagccggaggcggatcttgtgccgagactttcggcttaggctgtgccgccgctttggttggtgtaacgtcttcctacgatcatgtcattactgggacgaaaaacttcggaaaaaaagccagcgagcaacgaccgacgattgcggttcaggccttgaagcagttggggctgtcggagcaggctgcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatagtaatatttatgaaaaattaggagattaatgatgaaaagaattaagtgcttttgtgataaatttccatcaggagatacatttagaatgtgtatcattctggatgactatgataatagggttgattattatgtaggaatatatgattacattacgtctaccttaatgagcgatatttactatcgatccacgattgatgagcatttcaagattatagaattaatagaaaataatccaaatgaaatttatgatgatggcggtggtcaacaattttgcctagaatttcatcatgataaggtcattttttaccacaatgaatttgatgaagaagatggttatccagtattaagctgttcgctgcatacttttaaaactgctttaattgcttggaatgcttttttgcaattgcctaaaagtattcattcggtggtggagactgtgattgaggaataagcataattagcttaatgaatagaatcagcgatatagattggactgcaaatccacgcttatacgctgtgccatgattaagatgttagaacttgtattgaatacaagttctcataaacgaatggcagtaagcatttgatttagataaaatccttgaattagaataatcaggtctaagagctcgacaggacaaatgaggctggcaaccaaggatttggcggaagccattaggaaaggacaggttcgcaaatcaagctttaacacagaacaattaagggcaattgaaaaaggagaatctaaaataccggattacacttggcatcatcatcaagatacaggaaggatgcaattgattcgtgaaggcttgcatcatgataccggccatattggttgggaagcaatgaacaaaggaaggtaactatgtggaaaatcataaaagaggatagtgatgatttagaatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaacgatattcggctttcagacggtatttttgatataaagcgggtaactaaaagagcgtttgacggcaaaggaagataattatgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaacgatattcggctttcagacggtatttttgatataaagcgggtaactaaaagagcgtttgacggcaaaggaagataattatgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaagccatttccgccgctcagacggcattttcgccccttttgtttacaaacccttaaaatccctttacactcaaaatccgttcaacatcaaacaaaccccgctatgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggatttgtccgccctaaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgttgaccgcgacagccggaaactgctgattacccctaaaaccgccgcctacgaatcccaataccaagaacaatacgccctttggaccggcccttacaaagtcagcaaaaccgtcaaagcctcagaccgcctgatggtcgatttctccgacattaccccctacggcgacacaaccgcccaaaaccgtcccgacttcaaacaaaacaacggtaaaaaacccgatgtcggcaacgaagtcatccgccgccgcaaaggaggataaaccgtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccgttgaccagtggatgcaggaaaaccccaatgccgccgaaaccgtcgaagccctggtcaacgtcctgccgtttgccaaagtcaaaaacctgacaaaggcggcaaaaccggggaaggctgcggttagtggggatttctcagactcctacaagcataacactgcttcaagattatctcagtctgtagatggagaaatgtttcaaacccgcaatgttgattttaaagcaaaatctattgggactaaaattcatgatggagctcaagggaaacatatttcaggacatagaaactacattgaaggtaagagtactttaaatcaaaacattaatcctcaagaattgttgaacggaatacattcaggtgcttatccagttatttctaaaggagcaagaggaaatcctgttgttgattttgggtatcctataggcagcgatgggaaatcaggattaagtaccaattttggtacgattcattcaggtaaaaatggagttcacattgttccggctaaccctaaaaccattaaaaaggtgcaatagttatgaatatattaccaagctggctgcgagtcggtatgaatatagcaatgctgggcatgatacactcagatatcaggttaattaccgtagattacgaggaaggaagaaggtttttaaaaatcaaaaattatttatcaagagaagccatcacagaagaccatgaagatatggaatatttgattacagagttatggtctatgtgtggagaatattttgatgaagctgactttgaatgtatttattctaatcattcttctatggagttaaaccaaataaatggtgcagtattcaggagaaaggaattaatttcgcaagcgtaggttaaaaaaaccaacaatcacaatgtcttctgaaaccgtgtttaattttcagacggcatttccttcatttgaaataggatattgagaactgagttcttcaaaaatcctacacctgctccttccacggcagcaccttggtcaaaacggcagacggctacaaagccattgcccgtatccgaaccggcgaccgcgtcttcgccaaggacgaggcaagcggaaaaacgggatacaaacccgttaccgcccgatacggcaatccgtatcaagaaaccgtttacattgaaatttcagacggcatcggcaacaaccaaaccctgatttccaataaaatccacccgttttacagtcaaggaaaatggatacaggcaggtcgtctgaaaaaaggcgacaccctgctttccgaaagcggcgcaaaacagacggttcaaaacattaccttcaaacagcagccgctcaaagcctacaatctgaccgtcgccgattggcatacctacttcgtcaagggcagtcaggcggaaacggaaggggtttgggttcataatgattgtccgtatgataaaggcaaccaacgatataaagacgcttcttatcatggcaaaaatgataattctgtgaaaagtagagcaccaacaaacggacaagcagctcttgataattccgttcaagttaaatcaacttctcctcgaagagttggggttgataaagccaataatgaaatcgttgtattaaacaaaactcaaacttttaataacggttctgcggaatatcacgggcatgtcagaagttggcaagatttgcataccgatcagaaaaatgctttaaaaaaagcaggattggattagttaattcaaaaggaaaaattaaaaaatgactgataaaagtaaaacagaaaagttgatttcttctgatgataaacaaagtgttatagatggcattcttgatatggtatttaattccaaagcatatgaagtaccgtggatttctgagaaattgatggaattatcgaaaaataaagacttggatattgccggattatcgctaacctgtttcggacatctcgccaggctacattcaaatatcggtgattacgataaagttattcctttactacattcaaagcaagatgatccagagcttcaaggtagggctgaagatgcgttagaagatatttctttatttttatctgaaaatcattaggaaccgtaggtcgggttgaaaacccaacaatcaaaatgccgtctgaaaccgtgtttaattttcagacggcatttctttcatttgaaataggatattgagaactgagttcttcaaaaatcctacacttgctccttccacggcagcaccttggtcaaaacggcagacggctgaaaagcaaacaccgtccgtcgtgttgccgtttgcggatgagtacgggtcaaccccaatgccgccgaaaccgtcgaagccgccttcaacattgccgccgccaaagccgcaaagttggcaaaaacggtaaaaccggggagataaaagccgatggcaggaaagtaaatgtgaggatagacagtacggaggcagacctgctttatccggcagggcaataagaaaacaaaaattagatatggaaaacgattgtgaagattaaaccattacaattttctaacaataatcacagattttatgtggacaaaatttgtgttaccgaacaagatgtgaacattttggcatccgaccgaaattatgaattaaatattgaaatatttattgacaatataattcattttcaaataacggatgaatcttataaagtaaaattttcagaatatttatttgaaaataaagaaaaaaatgattgggatagaaatcctgctataaattattttttcgagataatagatgatagttatatggactggttgaaagaagaaagttttgatttttttgaaaagaaatattataaggcttatattttcttttttagcgattctgtaatagaagttatcagctcgacagaacctgtattttattcaaaataacaaattatcaaacaaagctctgattaaaaacccaacaatcaaaataccgtctgaaacgatattcggctttcagacggtatttttgacacaaagcaggtaaccaaaggagtgtttgacggaaaaggagaagctaaaataccggatgtatcggttgggaagcaatggataaaggtaaataattatgtggaaaattagtaaagaaaattgtgaagatttaggatttgcaatagtctgtatgttctatgatgctattaatctttctgaatttaaattatggttggatatagttgtcagagatattcctattgatacaattccattgtatatttttgatttgattgattttgataagagtataggggaaatttatgatgtaattggagtcgttaattatggttacatttcaaatgatcaaaaaaatgcattaacgggcattgccttcttaagggggatagatgtctatgatccgcctatttcaaaagaaaaagcattaaaagccttagagaaatatcctgaaatttatcagaggtttcagcatttctttccttttgtagagcttccgcttttttaaaagacaatatgccgtctgaaaagttttcagacggcattttttatttcttccagtaggcgggggtgaagaggatgaagacggtgaagatttccagcctgcccaagagcatggcggtaacgcagatccatttctgcatcacgtccaaaccggcgtaattgccggcgggcccgacttcgcccaggccggggccggcgttggtgatgcaggcgatgacggcggtgaaggcggtggtaaattccataccgctcgccatcagcaggaagctgaagaggacgacggtcataaagtagatgaagatgaaggacataacggtcagcgcgaggcggtcgggtatggccttgccgctgattttgacggtgcggacggctttggggtgcagcagcaccatcatttcgcgcaggctgaatttgaacaggacgagggcgcgtatggttttgatgccgccgccggtcgagccggagttggcgaggatgttggcgaggaaaaacatccacagggaaatcaggagcggccattgtgcgaagtcggtgttggccagcccgtttgccagtccgatggagacgaagttgaaggcggtgtagcgcagggattcggtaaaaccggcgtaatagccggtgtgccacaggtacagggcggcggcaaggatgctgccggagagcagcagcagcatcgtccggcattcttcgtctttccaataggttttgaggctgcggctgttgagggcggcgaaatggttggcaaaattgatgccgccgacaatggtgaaaacgatgatgaccgcttcgatgaggggggagttgtaataagctatgctggcatcgtgggtggaaaacccgcccagcgagagggtagccatcgcgtgacagacggcatcgaaccagcccatcccggcaaaatgcaggcaggctgccgcgaggatggtgatcagggtgtagccgaaccaaagttttttcgccacttgggaaatgcgcggcgacattttgctttctttgtcaatgccggggatttcggctttgaataactgcgtgccgcctacgccgagcataggcaggatggcgacggcaaggacgatgatgcccatcccgcccagccagttgagcatatgccgccaaaagttgacggagggggcgagcccgtcgacgtgggggatgacggtcgcgccggtggtggtcagtcccgacatcgattcaaaaaatgcgtcggtaaagcccatattcgggaaatacaggtacatcggcatcgcagccatagcggcaaacgccagccacaacatcaggacgagggtaaagccgtcgcgcgggcgcagttcgcgcctgaaccggagggtggcgagccggacgatgcacgagccggaaagggtaacggtcgcggtggtggcgaaggcggtgtacgcgccgtccgaaaaggcgtaggagagggcggcgggtatcagcaggataaaggaaaacagcatacccagtcgggagaggacgtgggcgatgggcaggattttgtgcatagtggggcggtccgttattttgcgaagcttttccagtctatgccgccggcggcttggacttgggtaatttcttccgtttcgaggttgacggcggtcagctgtccgccccacagcgcgccggtgtccagcgagatgacgttgtcggcattcgtgtagcccagcgaggaccagtgtccgaagatgatgtgcgtcgaggttttgccggtcgggggctttgaaccacgggcgcaggtaaggcggcatttttttcactgtggatttgtagtcgaaatccagttcgtttttaaaggtcagggcgcgcatccgcgtgaaggcgttgacgatgaagcgcaggcgggcatagcctttcaaaccttcgtcccacgcggccggtttgttgccgtacattttggagaagaatttgacgtattttttgccgcgcagttcggcttcggcttctctagcgagcgattcggctttggttatgcgccattgcggcaggatgccggcgtgtaccatcacgcggctgccctcgcgtatcaacagcggttgcgcacgcagccagtcgagcattttttttccgtcggggtgtttgagtatgggttcgattgtgtcgctgcgtttgggcgcaccttcgccgcagccgacagcgagcaggtgcaggtcgtggttgccgaggacgatttgcacgctgttttcgtgccggatgcagaattgcagcgtttcgagggatttcgggccgcggttgacgatgtcgcccgtcagccagagggtgtccgtgccgtggttgaaaccgattttgccgagcagcgcggtcagttcgtcgaaacagccttgtatgtcgccgattgcgtaatgtgccattgcagatgttgtgaagtgggaaagtgttgcggttcggacggcatggttttgaaatatcatgcagtccgaacgtggaattatgcgttcaaaacgaggacggcttcggcttcgacctgcacgcctttgggcagcgaggcaacgccgacggcggcgcgggcggggaagggctcggcgataaattccgccatgacttcgttgaagacggcaaaattgcccaagtcggtcaggtaggcgttgagtttgacgatgtcggccagcgtgccgcctgccgcttcggcgacggcttgcaggttttggaacacttggcgcgcttcggcgcggaaatcgccgttgccgacgacggtcatcgtggcgggatcgagggggatttgaccgctcatgtaaacggtgtcgcctgctcggacggcttggctgtacgcgccgatggcggcgggggctttgtcggtgtggatgatggttttggacatttcggattcctcaaaaaatagggcggcagaagccgcagcattcgggattatcgtacaaaaccgccggcttgtgtagttgcggtggcagaaaacaaaaccgccgaaggctcggcggtttgcagaataaggcgcatatcagaatttgacgcgcacaccggcggacagttcgccggaacggacgtttttgacagtgttgactttgccgatgtagttgtagcggtagccggcatccaaatcgacattcggggtaacggcatagcttacgcccgtcaatacgccgaggccgatggaggtttggctgaagctgtcgctgccgcccaagtcgacggaggcgcggttgaggctcaagcgcgcgccgagatacggtttgacgggcgattgggtgtcgaagtcgtaaatggcggacgcgccgatgctgtaaagtttgaaatcggtggatggggctttatagtttttgtagcgcgtgtaatcgacggcgaagcggaggtcgttgatgcggtagcctgcggagatgcgcgggctgaagcctttggcagaacctaaagagcttgaggcttttgcgtgtgcggcatcggcttggacgtaaaagccggatgcgccttccgccagtgcggcggccgggagagcgagggcaatcagtgtggcaagtgcttttttcatattttggttcctttatggtcagttagaaaaattgttaagaatccgttaaagaatcctgctgtattatacttaaattttctttttgcatcgtaatattttcaatacttcaagatacgtagcggtatccggctgctttgccgacggcaaagccgttaacccgcgcgttgcctttaaatggtggcggcggcatcacgcggcggatgggtgaaacttgcaaacggtttggaaaaaacagcggtatctgtcggattgttgcaggtgcaggcatacggttttgtgtgcgtctgtgccttaagcgtcggacatttccggcggcggctgtgccgtctgaaacgcccggcgggggatgcggctgcgttttccatcgataagcatattttccggacgcgttcggggcgggttttcccgggcggccgccgatttgtttgcgcttatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaaaacactgcagcaaatcgtttaaaaacaagcgtcctttttcggtcgggcggaatacggcagggtcggtttccagcaggcctttttgccttgccgtttcgatttgcgccatgattttggcactcggtacgcccgtgcgctcctgcaacatcgcggcgggtacgccgtcggtcaggcgcagggcgttcatcatgaattcgaacggcaaatcttcggcagcgacggttttgcgttcgacggcttcactcggttggctttgcattaaggcgaggtagtcgttggggtggcggcggcggacggtgcgctcgatgcggtcgggataggaaattttgccgtgcgcgcccgcgcctatgcctaaataatcgccgaactgccagtagttcaaattgtggcggcactgcatggctggtttcgcaaaagccgatgtttcgtagtggacaaaacccgcgccttccagcgcgccgtgtaccgcgtcttcgatgtcgagggcggcttcgtcttgcggcaaacctttcggcggcgtatgaccgaacggcgtgttcggttccatcgtcaggtgatacgcgctgatgtgggttgcgcccgtagcgatagcggtttgtacgtcgtccaatgccgtctgaacggtttggttcggcagggcatacatcaagtcgatattgactttatcaaataatttcaaggcggtatcgatagcggttaaggcttccttaccgttgtggacgcgccccagccttgagagcatatcgtcgttgaaactctgtacgccgatagaaagccgcgtaatacccgcgtctttaaatccttgaaacttctcgatttcaaatgtccccggattggcttccaaggtaatttccgcttccggctgcaagcgcaacagcgaacgcacgccgcttaacaaacggtcaatcgattccgcctgaaacaggctgggcgtaccgccgccgaaaaagatcgtttccaccggcctgccccaaatattgggcaattcaagctgcaaatcggtcagcagcgcgtcgatataggcggcttcgggcaatccgtttttcaggctgtgggaattgaagtcgcaatacgggcattttttgatgcaccacgggatgtggatgtaaagcgacaggggcggcagggcggtgagtcgggtgcggtttggaaaggaaatggtgtgcatggtgtggttcggaaaagtgggcaatgccgtctgaaggcggttcagacggcatgggttcagccgagcagggtaagcagttcggcttcgctgaggacggaaacgcccaaggcattggctttttccagcttgctgcccgcggcttctccggcgacgacgtaatcggtttttttggacacgctgccggaaactttgccgcctgcggcttcgattagggattgggcttggtcgcgtttgagggtgggcagggtgccggttaacacgaaggttttgcccgccacggctttattgatgccgtctgaaccttgcgccgcctcgtcttcagacggcatttgcgcgaagaaggttttcaggttttcgagcagggcggcgttttgtggttcgctgcgccacgcctgccagtcggtggggagggctttgtcggtttgcagcccttctatgtttttgccggcgagttcccataaggcttgggctttgttttcgctgattttgaaaccgggcaggcgggcgatccagcgttgcggttcggcgtggcgggcgggcgggatggtaacggcttgggtttgcggggcaacgcctgcggcgagcagttcgtctatcatcgcctgctgttcggcttgggcgaagaagtgggcaatggaacgcgccactaccgtaccgatgtcgggcaggcaggcgaggacgggttcgggggcgcggcggacgcgttccaatgtgccgaatgcctgtgccagcgttttggcggtgcgttcgccgacgtggcggatgccgagcgcgaacaggaagcgggcgagttcgggcgttttgctggcttctatgcctgcgaggatgttttccgcccacttgactggttgttttttatgtttgcccgacgcgccgaccgaactgccttcagacggcatttgatccgattcggcaacggttttgtccgctgtttccttcattttttgcaaggtcgggatgtcgaggcggtagagatcggcgaagtggcggacgaggtcttgcgcgacaagctgttcgatttgtttttcacccaagccgtcgatgtccatcgctttgcgcgaggcgaagtggattaagccttgcgcgcgttgtgcctgacaaagcataccgccgctgcatcgggcgacggcttcgccttcttcgcgttcgatttcgctgcggcagatggggcagtgggtcggcaggcggtagggcttgtggagcggaacggattgggtttgattggcggacggtgtttcggcaaacaaatcgtcctgccgatgcccgatgccgtctgaaacggcaacggcggtttcccgcatcgggcggcgttcaaaaatcacgcgcacaacttcgggaatcacgtctccggcacggcgtacgacgacggtatcgccgacgcgaacgtctttgcgcgatacttcgtcctgattgtgcagggtggcgttggtaacagttacgccaccgacgaatacgggctgtaatcgggcaaccggcgttaccgcacccgtcctgccgatttgcacgtcaatcgcttcgacaatggtcagggcttcttcggcagggaatttgtgggcaaccgcccaacgcggcgcgcgggagatgaagccgagttcgtgctgttgcgccaagctgttgactttgacgaccatgccgtcgatttcgtagggcagttcggggcgtttttgctgcatgtgttcgtaaaacgccaatacttcgtcgatatttttgaaacagccgaaattgccattgggcagactgaagccgagtgcttggaaataggcgagttcctggatgtgttcttccgcgacgaaaccatcttgctggcgggcgacggagtaggggaaaaagtgcagtttgcgttgcgcggtgatgcgcgaatcgagttggcgtaggctgccggcggcggcgttgcgcggattggcaaagggtttttgcccgttttcggcttgtcttttattgagggcgacaaaatcggctttgagcatcagcacttcgccgcgtacctcgatgagttcgggcgtattttcgccgtgcagccgcaaggggatgttggatacggttttgatgttttgggtaacgtcttcgcccgtcgtgccgtcgccgcgcgttgccgcctgcaccaatacgccgtcgcggtagagcaggctgatggcgaggccgtcgaatttgggttcgataacgtattcgggattgccgccgtccaagccgtcgcgcacgcgttggtcgaaggcgtacatttcggcatggtcgaacacgccgttttcatcttgcggggaaaaagcgttggtcagcgacagcatcggcacttcgtggcgtacttcggcaaatcccgccaaaggctcgccgccgacgcgctgggtcgggctgtcgggcagtttgagctcgggatggtttaactccaacgcttcgagttcgcggaacaatttgtcgtattcggcatcgggtacgctgggcgcgtcgagggtgtagtattcgtaggcgtagcggttgaggaggtcggtgaggcggcagatgtgttgtgcggcaaattgttttatatcactatcagacggtttaagaagattggtaaagttagtgttatgttttgagtttggattcatgagagaaggttttcagacgacctttgtctgatacgggatgaaacgggcaaaggtcgtctgaaaaatgataggttgaaaacagctgaattttacccgaaaaaaagcggatatgccgtaacgacatatccgctttgattgcattcgattttaggagaacaggcgcaatgcggttttgccgcccggttcgataccgactttgagcatctcggactgacgcgccaatacataagtgcgcacgtctttgagccattgggtcgaaacttcttccattttgtcgttgaccagattcaggttcaactggccggacaggcgtaccgccaaatccataaacaaatcgtcgaaggttttttcgcctgccggagagtgcgggatgtcgagcagcatactgaagcctttgtaggactggttgtccaaaagggcgttggtaaacggctcgttgttgagcgagcagatggagaacatggtcgagcccgacgtgtcggtatagtggaacgcgccgtcgtcttccaaaacgaaacccacgcccgttacggcggaacgcagttctacgccgctgatgctggtcggggaaaccaaatggatggcgatggtctggtcgacgcgcgcgcagaatgcgtccagtgcggaagccacttcgataaaggcggcaaggtcggtgtgcagcgtctgaccgcccatgctttgtgcgaatgcgtccacctggcggttgaatgcggagagttcttcctgcgaggcaagtccgttgcggctgactgcctgaatacccacgataaatgcctgatagcggatgcccgggatgggttcggcaatctggaaatggtcgtccatggtgcagccgacaatctggtagcggcagcggttggaaaggcgcggcagtgcgtgcagttctttggcttcggtcagcgcgatataggagatgaagtcgaagcgcacgtcaaaccagggtaattcgacttttgacagttctttgagcgtaatcagcggttttgcaggtgtttgcggaacgggtgcaggttttgccggcgcgtcggcaggtttcggtgcggaatgtccggtttggggttcggaaacggtgtgggcggagttgccgataatgccgctttcttccaaggcggtttcgatttcggttttgaacggggaggcttttgcctgtttctgcttggcgatgtagacggcatcctgttcttgcaggttgcgcatggcggggtcttggggttttgccgtttttttgaccgccggttggggtttcggcatcatgactgacccgccggacggtttgccgtcgcggacatggctggttttgctgttgagcagggcatctttgtcggagtgtccgaactggtcgcgcacttttttgcggtattggttttcctgatacatgttgtaggcgacaacggcgaggacgacagctagaaacagtacgatgtaaatcatggcaatcacttgttaaatttcgggatgcaggatacgcaaagtgcgggtactgcggttaaatcgggcttgcactgcggttaaatcgggcttgcgtttccggcagtctgacggaacggccgattataacgtttgaattataacgaaaattgcagggtctgacagcagtgtgtcgaaataagcggaaattttccgaaatgccgtctgaaatctgtggttttcagacggcatttctgtccacgagaaaccctttctcccgtatccgccgccagtcgaaaaaatggccggggtcggttttgcggccgggcgcgatgtcttggtgccccgttaccgccgtgacggggtagtggcggcagattgcgtccaacaaggcttcgagcgaacggtattgcgcttcggcaaacggttcgaaatcgcagccttccagttcgatgccgattgaaaatgcgttgcatttttccctgccgccgaatgaagatacgccggcatggtatgccatattgtcgcaggaaacgaactgtaccgtttctccgtcgcgtttgattaagaaatggctggatacgcgcaaagtgtgtatcaggctgaagaacggatgtccgtcggggtcgagccggttggcaaacagcttttccaccgcatccgtgccgtattcgaacggcggcagcgaaatgttgtgcaacacgatcagggaaaccgtttcccccgtttccctcgggctgaaattgggcgacggggtatggcgtatgctttgaagccagccgttttgccagtgtgcttcggcgtgattgtccatgatgttcttcctgtccggcgggcaatttgggttatactgtcgcccgaattttaagacgtattccgaatgctgggaatcctaccatgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataaaccatgccgtctgaaaagtttgtgttttcggacggcatacccttaccggaactgcaagcatgaaaccgcaattcatcactttggacggcatagacggtgccggcaaatccaccaaccttgccgtcatcaaggcatggtttgaacggagggggctgcccgtgctgttcacgcgcgagccgggcggaacgccggtcggtgaggccttgcgcgaaatcctgctcaaccctgaaaccaaagccggtttgcgtgcggaaaccctgatgatgttcgccgcgcgtatgcagcacatcgaggaagtcatcctgcccgcgctttcagacggcatacacgtcgtgtctgaccgttttaccgacgcgaccttcgcctatcagggcggcgggcgggggatgccgtctgaagacattgaaattttggaacattgggtgcagggcggtttgaagccggatttgaccctgctgctggatgtgccgctcgaagtgtcgatggcgcgtatcgggcagacgcgcgagaaagaccgtttcgagcaggagcaggcggatttctttatgcgtgtgcgcggcgtttatctcgaccgagccgccgcctgtcccgaacggtacgccgttatcgacagtaaccgcaacttggatgaagtcagaaacagcatagaaaaagtgttggacggacatttcggctgctgatgcggcaaatattgaaacaagcgcatccgcccgcgccgaaaatcaaacggcagtgccgcaggtgaaaatggcggtatgcgccaaactttcggcatgatagaattacgctcggttacaaggcaggatgcgtcggcaatattaacgaaccgcccgtaacatgatgacccgaaagcgtttcggacagtccgattcaaatctttttctcgcaacaggattgacacatggaaaactcattgaaagaagccgccctcaagttccacgaattccccgtgccgggcaaaatttccgttaccccgaccaaatctctggcgaccgacaaagatttggcgttggcgtactctccgggcgtagccgctccttgtatggaaatccatgccgatccgcaaaatgcctacaaatacaccgccaaaggcaacttggtcgctgtcatttccaacggtacggccgttttgggcttgggcgacatcggcgcgctggcgggcaaacccgtgatggaaggcaaaggcgtattgttcaaaaaattcgccggtgtggacgtgttcgacatcgaaatcgatgaaaaagacccgcaaaaactcgtggacatcatcgccgctttagagccgaccttcggcggcatcaacctcgaagacatcaaagcacccgagtgtttctacatcgaacgcgaattacgcaaacgctgcaaaatccccgtattccacgacgaccagcacggcacggccatcattaccgccgccgccgtattgaacgccctgcgttttaccggccgtaaaatcgaagaagcgactttggtgtgttccggcgcaggtgcggccgcgattgcctgcttgaaccaattgctggatttgggcttgaaacgcgaaaacgtgaccgtttgcgactccaaaggcgtgatttaccaaacccgcgaagacaaagaccgtatggacgagtccaaacagttctacgccattgaagacaacggccagcgcgtgcttgccgatgccgtcaaaggcaaagacatcttcttgggcctctccggcgcgaacctgctgacgcctgaaatactgaacaccatgaacgaaaaacccatcgtgttcgctatggccaacccgaatccggaaatcctgccgccgctggcgaaagaaacccgtccggacgtggttatcggtaccggccgctccgacttcccgaaccaagtgaacaatgtattgtgcttcccgttcatcttccgcggtgcgttggatgtcggcgcgacgaccatcaacgaagaaatgaaacgcgcctgcgtgtatgctttggcggatttggcgatggaagaagtaaccgaagaagtggttgccgcttacggtaagaaatttgaattcggcgcggaatacctgattccgactccgttcgattcccgcctgctgccgcgcgttgctacggctgccgccaaagcagcgatggaaagcggtgtggcaacccgtccgattgcagatttggaagcttacgctgccaagctgagcgaatggaagctgtaagccgtttgcggtttaaaatgccgtctgaactgttttcaggcggcattttgctgtcagattgatatagtggattaacaaaaatcaggacaaagcgacgaagccgcagacagtacaaatagtacggaaccgattcacttggtgtttcagcaccttagagaatcgttctctttgagctaaggcgaggcaacgccgtactggtttttgttaatccactataaatgaaagatactgaaaaatgaaagagatgaaacctgtccgttatcatattggcgatatgcccgagacttcaaaacaaaccgcctcccgtcatgacgacagggcagtgggtgttgacgatgattgttttcatgattcctttggtcaatttttgtttgggtgttcggcagaggcaacccgaaccgcgccaatttctgtaaagcgcagttgcttatttacctgattggttcgcttatcggtttggtcttcgcgttgtttataggtgggtctgtatcaggtacgcatgattaatgccccgggctgattttgcttcgaggatttgtatcgaatatgccgaattgtttcaaatttcataccgttatcgaacggcattggcaaaaaccttatccggttttgtcttttctgcttaagccgctctccgggctgtttgccaaaattgcggcaaaacggcggacggattttttatcgggaaaacggcaaagcgaaaagctgcccgtgcctgtggtcgtggtcggcaatattcacgcgggtgggacggggaaaacgccgattgttgccgcgctggtgtcgggtttgcaggaaaagggcgtcaaggtcggcatcatcagccggggctacgggcgcaagagcaaggcggttcatgtattgaatgctgagagccgagcggaagatgcgggcgatgagcctttgctgctgttccgcaaaaccggtgcgccgacggcggtgggcagcagccgtgcagaggcaggcagggcgttgctggcggcgcatcccgacatcggactgattgtggcggacgacggtttgcagcattacgccctgcggcgagatgtggaaatcgcggtgtttccggcggcggatacggggcgcacggatttggatttactgcccaacggcagtttgcgcgaacctttgttgcggctggattcggtggatgcggtcgtcgtcagcggcggcaaggcggatgcgctgtttaggccgtctgaaaatatgtttcacagccgtatcgaagcgggacggatttaccgtttgaacaatccgtccgaaatactggacacaggccgtctgaaaaatcaaaccgtcgtcgccgtggcaggtattgccaagccggcgcggttttttgattcgttgcggaatatgggcattaccgtgaagcgaaccgtcgcgctgcccgaccacgccgacatttcggcggcagatttgcccgatgcggacgcggtcattattacggagaaagatgcggtcaaattttcagacggcatttgcaccgataatgtttgggtgttgcccgtttgtgcgataatcgaacctgatttggcggcgtttgtgttggagcggttggaagatgtaccgaaggccgtctgaaagcacggtttgggcggagtgattacggatttgaataagaacgcctcgcgccatcattcccgcgcaggcgggaatctaagtctcgaattttcaggaatgcctaggaggctccagaaatcccaaatctccggatttccacttggacaggaatgagaaaaccggtcgtattttttatctgcattaatcattcattaaaggattgaatattaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataaatgatagccgtctgaaatattgaagagggcatccgattgattgaaccatcaaacccgaaagcaaccctatggaaaaaaaattcttagacatcctcgtctgccccgttaccaaaggcaggctggaatatcatcaggacaaacaggaattgtggagccgtcaggcgaagcttgcctatccgattaaagacggcattccctatatgctggaaaacgaagcgcgagcgttgagcgaagaggaactcaaagcatgaccgaattcgtcgtattgattccggcgcggctggattcgtcgcgcctgcccggaaaagccttggcggacatccacggcaaaccgatggtcgtgcgcgttgccgaacaggcggcaaaaagtaaagccgcgcgcgtcgtcgttgccaccgaccatcccgatattcagacggcctgtcaggcgcacggtatcgaagtcgtcatgacttcaaaccggcacgaaagcggcacgacgcgccttgccgaagcctctgtcgcgctgaagctgccgccgcatttgattgttgtgaacgtacagggtgacgagccgctgattgcccccgaactcatcgaccgcaccgccgaagtactcgtcgaaaacaacgtccaaatggcgaccgccgcccacgaattgcacgatttcgacgaattgatgaatcccaacgccgtcaaagtcgtcctcgacaaaaaccgcaacgccatctacttcagccgcgccccgattccctatccgcgtgatgcgatacgtgccggaaaacgcgaaatgccgtctgaaaccgccgtcctgcgacatatcggcatctacgcttaccgcgccggcttcctgcaacgctatgccgaaatgagcgtttcgccgctggaaaccatcgaatcgctggaacagctgcgcgtcctgtggcacggttatcccattgccgtcgaaaccgccaaagaagcccccgccgccggtgtggatacgcaagaggacttggacagggttcgcgccgtatttcagaccgtataaaacaggttcaaagggaaaagatatgcagcaacatattgaaaagtggcaacacttgagccgggaagaacagaaaatccttgctgaagtatggggtctcgtgcaaaacgacgatcaggaggttcactatgaaatgctcaaattgaacgcacccgatgaagccagcggcgaattttggttcagaatggcagaaacactcagcaccctgccgcccaaccgttccctcggccttagaatgaacggcggcaggctggcgaccgccgtatccatcctttccgtcatgattgaagacaatcccgacataccgcagctttgggcgcaaaaaattaccgcgctcaattatagtggattaaatttaaaccagtacggcgttgcctcgccttgtcgtactatctgtactgtctgcggcttcgtcgccttgtcctgatttttgttaatccactatatttggcacacgggcacaaagcccgtgccgacggtttggcacaacagcccgacaaagcggcagaagccaacgaggaggaatacctgaccaaagccctgtcgcaaaacctgctgtcaacattggatgtcgcgcttgcacgttttcctgaagacgcgtggtttcaggaaatcaaacaggatgcacaaaagcattttgcttgaggatgtggcagtcaggaatatttccattcaggaagaaaagaagtgcctgattgggtataatcagggtaaatcttattttatttcaaaagattaatatttgctttctgtttttccttgacggtatcggaaaagttgattatagttacagcttccttaggagtaatggctgagaggctgaaggcacttccctgctaaggaagcatgtggggtcaacctgcatcgagggttcgaatccctcttactccgccagataaaaaatagacgctgtgttttacagcgtctattttttatgcaattttatagcgggttggtgcaaaaccagtatggtattgccctgtcttgattctgaattttgttatagtggatgaacaaaaaccagtacggcgttgcctcgccttagctcaaagagaacgattctctaaggtgctggagcaccaagtgaatcggctccgtactatttgtactgtctgcggcttcgtcgccttgtcctgatttttgttaatccactataatccgagatgcttgccgtttatttccgcctcgttcaaacggcggctctgatttgcgcggtttctgtttgccgtattcgcctatccgtaccgcaaatgttatactgggaaaaatttactgattgtgttttacggcatatttgccgataggatggaagagacaaatgagcagaatccggcaggcttttgccgctttggatggcggaaaggcattgattgcctatattacggtgggcgaccccgatattcggacaactttggcattgatgcacggcatggttgcaaacggtgcggatattttggagttgggtgtgccgttttccgatccgatggcggatgggccggttattcagcgtgcggcggagcgggcgttggcaaacgggatttcgctgcgcgatgtcttggatgtcgtcagaaaattccgtgaaaccgacacgcaaacgccggttgttttgatgggatatttgaaccctgtacataagatgggttatcgggagtttgctcaggaagccgcaaaggcgggtgtggacggcgtgttgacggtggattcccctgtcgaaaccatcgatccgctctatcgcgagctgaaggataacggggtcgactgtattttcctgattgcgccgacgacgacggaagaccgtattaaaaccattgccgagctggcaggcggatttgtctattatgtttcgctcaagggcgtaacgggcgcggcaagtttggatacggatgaggtttcgcgtaaaatagagtatttgcatcagtatatcgatattcccatcggtgtcggtttcggcatcagcaatgcggaaagtgcacgcaaaatcggccgggttgccgacgcagttattgtcggcagccggattgtgaaagaaatcgaaaacaatacaggcaacgaggctgccgccgtcggtgctttggtaaaagagttgaaggatgccgtgcgctgacggcggttcctcatcctgaatattttaggagttgtccatgagctggttagataaaatcctgccacccaaaatcaagaatcgcggaaaagacggttcttccaatgttcccgagggtctatggcacaaatgcccgtcttgttcggcaaccgtttattctaccgagttgcagcagaacaatcaggtttgtccgaaatgcaaccaccacaatccgttgtcggcacgacaacgcctgaacctgcttttggatgaggatggcagggaggaagttgccggaaatgtcaaaccgacagatcctttgaagtttaaagacggcaaaaaatatccggatcgtttgagtgcggcacgcaagctgaccggggaagatgatgctttggtggtgatgaaaggcaagatgaacggcctgcccgtcgtcgttgctgcgtttgagttccgctttatcggcggttcgatgggttcggttgtgggcgaacgattcgtacaaggtatccgtcgggggtatgccgacaattgtccgttcgtctgtgtgtcggcttccgtcggcgcgcgtatgcaggagggtgtaaactcgctgatgcagatgacgaaaaccagtgccgcgctgcatttgctgacggaaaaacgcctgccatttatatcggtgttgaccgatccgactatgggcggcgtatccgccagcttcgcatttttgggcgatgtcgtgcttgccgaaccgaacgcgctgatcggttttgccggtccgcgcgtgattgagcagacggtgcgcgaaacgctgccggaaggcttccaacgcgccgagttcctgctggaaaaaggcgcaatcgaccagattgtcgaccgccgcgatatgaagcggcgcatcagtgatttgattacgctgttgtgccgtcaggacaaagtttccgccgcctgatggctgatgaatcgagtaccgtctgaaaccgatgtttcagacggtatttttgtgtctggttatttgttgtgcggctttatcgatggggcatagcgtccggcacgttctttcaggcgttgtaccaaacctttcgtgtcggcgggtacaccgccctcgcagaatgcctgatacaggacggtgcgcagtgcgtcgttgcggcttaatgtaccgcctatcggtttccattcggcgtttcggggctgtatccagcggcggttgaccgtgtcgccgtagccgaacactttataggaggaaggtttgccgttgccgaacctgatggagaagcgggcgcagaatatgcctttggcagtcaggttgtcgtagcctttgtcggagcggatattgagaatgtagcggatgctgccgtcgggcgcgggcataatttgcaggctgtcgagcaggattttcggctgtttgccgtaattttcatccacataaatgtcgaaccagccgtccgagtgcgtatcgggcagcggcggcagtttggcggtatgttctttaaattcgcgggcggcggcctcttcgggcgtttcgcggtagcgggtgttgatcggcgtgtctttttggctgaagccggcagcgagggacgtgccggcggcgagtgcgagcagcaggagggcggtgcggcgcataagtttctccaaattgaaaacggcgttattttatgggttggcaaagggggctgcaagcaactggggtataatctccccccgattcccattttttaaacggtacaaacgatgaacagcgaaactttagacgtaaccggattgaaatgtcccctgccgattttgcgggcgataaaggctttggcgcaaatgcagcacggcgacctg

SEQ ID NO: 38 - DNA, 1041 bp, Neisseria meningitidis
agacaaactttttgaacagcatgacggcaaactcgaaagcatggacgggcgggaacaggagctggatttgatttggcggacagaagccgatatcggtaacggcagcatactgcaatttgtctgcaactggggtttccccgccgcccgaaaagacctgttccgttctgaaaaaaatcggcgcggtacacagcgcaatgctgatccatcgggcggcagacgcattggacaaagaaatccgccgcctccaatcggaaggtaaaaacctgaaagaaatgtgggatataacatctcgacaacaaaaccgcctcactgctgaacagtctggatgaacaatattggcaagaccccgacaaactgtatctgctgggatggcaatactattccagcaaccctgttcagacggtggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacataaaagc

SEQ ID NO: 39 - DNA, 5034 bp, Neisseria meningitidis
ccggcaaacaccggcgcgtcccatccgtgcagaaaaaaggatacggaaaaggataaacgccataacgtgcggcgtttgctataatccgccccttcattaccgcagcccgccgaaagatgccgatggcaaaaccgctcaaataccccgtttccgcactggtcgtcctttatagcggggacggcggcatcctgctcatcgaacgcacgcatccggaaggattttggcagtcggtaaccggcagcctcgaaccgggcgaaaccgtcgcccaaacggcaaggcgcgaagtttgggaagaaaccggcatcctgctggcggacgggcagcttcaagactggcacgacagcacggtttacgaaatctaccaccactggcggcaccgctatccaaaaggcgtgtttgaaaaccgcgaacacctcttctctgccgaaatcccgcgtgatacgcccatcgccctgcaacccgaagaacacgtctcctacggttggttcgatatggaagaagcagcggaaaaagtattttccccgtccaacaggcgcgcgattttggaactgggcaggtttttgggcaaacggtaacacgcgcccgtacaccctttcagaggcatcgggcgcattttcagccggacgtttgtgctatactttcaaacttcacactttcccaaacaaaggaaaccaaatggcagacttcaaccaaatcctgacccccggcgacgtggacggcggcatcatcaacgttgtcaacgaaatccccgccggcagcaaccacaaaatcgaatggaacgcaaactggccgcattccaactcgaccgcgtcgaacccgccatcttcgccaaaccgaccaactacggcttcattccccaaactttggacgaagacggcgacgaattggacgtgctgctcgttaccgaacaacctttggcaaccggcgtattcttggaagcgcgcgttatcggcgtgatgaaattcgttgacgacggcgaagtggacgacaaaatcgtctgcgttcctgccgacgaccgcaacaacggcaacgcctacaaaactttgtccgatttgccgcaacagctcatcaaacaaatcgagttccacttcaaccattacaaagacctgaaaaaagcaggtacgaccaaagtcgaatcgtggggcgatgcggaagaagcgaaaaaagtcatcaaagaatccatcgaacgttggaacaaacaggcataacgcccgccatgccgtctgaacgccgtttcagacggcatttttccaagctctagggaataccgtcccaatcggctataatccgaacataccgtttccgaccgaacgccatgaaccgccgaaaaatctatctgttgtctgttgccctcttcacactggcatttatgctgctcgtcctcttgggtgcttatctgctgaccgtcggcagcaaagccttcgccgtcgcctcctttcttttcgcattcggcgcactgttcggacaaatcggcagcctcgccctctacctgcggcacaaatccctacgcgccgcccaatccgccacaaaggaaaaccgctatgtctgaaaaaccggaaaaaatcgttttggcaagcggcaatgccggcaagctcgaagagttcggcaacttattcaaaccttacagcatcaccgtattgccgcaatccgcattcggcatacccgaatgccccgaaccctatcccacctttgtcgaaaacgcgctggcaaaagcacgccatgccgccaaatacagcgggctgcccgcactcgccgacgacagcggcatctgtgccgccgccttaaacggcgcgccgggcatccattccgcacgttacgcgggcgacaatcccaaatccgataccgccaacaacctgaaacttgccgccgaacttgtcggcaaggcagacaaaagctgctgctatgtctgcgtattggtttttgtccgccataaagacgacccgcgcccgattatcgccgagggcgtatggcacgggcagtggaacgacacgccgctcgggcaaaacggtttcggttacgacccgtatttttatctgcccgaacacggcaaaaccgccgccgaattggatacggaggtcaaaaaccgcgaaagccaccgcgcgcaggcacttgccgaactcttacgcaaactcgccctttaaacatcaaaacaatacaaaggaaaaagaatgaaacccatacggaaagccgttttccccgtcgcagggatgggaacccgcttcctgcccgccaccaaggccagcccgaaagaaatgctgcccatcgtcgacaagccgctgatccaatacgccgtagaagaagccgtggaagccggctgcacggaaatggtgtttgttaccggacgcaacaaacgcagcatcgaagaccatttcgacaaggcatacgaactcgaaaccgagttggaaatgcgccataaagacaaattgttggaacacgtccgcaacatcctgccgccgaacattacctgcctctacatccgtcaggcggaagcactgggcttgggacacgccgtcttgtgcgcccgcgccgccatcggagacgaaccctttgccgttatccttgccgacgacctgattgatgcccccaaaggcgcgctcaaacaaatggtcgaagtgtacgggcgcagcggcaacagcattttgggcgtagaaaccgttgaagcatcgcaaaccggctcatacggcatcgtcgaaaccgaacagctcaaacagttccaacgcattaccggcattgtcgaaaaacccaagcccgaagacgcgccctccaaccttgccgttgttggacgctacatcctcaccccgcgcattttcgacctcttaaccaatcttccgcgcggcgcgggcaacgaaatccagcttacagacggcatcgccaagctgctcgatcacgaatttgtcctggcgcacccctttgaaggtacgcgctacgactgcggcagcaaactgggctacctcgaagccaccgtcgcctacggtctgaaacatcccgaaaccggcgaacccttccgccggcttttggaaaaataccgcaccgaataaccccatcaaggaatccttatgcacgacaaaacctggtccggacgtttcaacgaacccgtttccgaactcgtcaaacaatacaccgcctccatcggtttcgaccgacggcttgccgaatgggacatccaaggctcgctggcacacgcgcaaatgctgaaagaaaccggcgtgttggacgaaggcgatttggcggacatccgccggggtatggcggaaatcctcgaagaaatccgcagcggcaaaatcgaatggtcgtccgatttggaagatgtccatatgaacatcgaacgccgcctgaccgacaaaatcggcgacgcgggcaaacgcctgcacaccggccgcagccgcaacgaccaagtcgccaccgacatccgcctgtggctgcgcgaccagattaccgttatacaaagcctgattcaaagccttcagacggcattgctggatttggcggaacaaaacgccgaaaccgtcatgccaggctttacccacctgcaagtcgcccagcccgtcagcttcggacaccatatgctcgcctacgtcgaaatgctcggacgcgataacgaacggatggcggactgccgctgccgcgtcaaccgtatgccgctcggcgcagccgcccttgccgggacgacctacccgattcagcgcgaaatcaccgccgagctattgggctttgaacaaatctgccagaactcgctcgatgccgtatccgaccgcgatttcgccattgagttcacagccgccgcctcgctggttatggttcacctgagccgcctgtctgaagaattgattttgtggatgagcccgcgtttcggctttatcgacatcgccgaccgtttctgcacaggttcgtccatcatgccgcagaagaaaaaccccgacgtgcccgaactcgtgcgcggcaaatccggccgcgtcatcggacaccttatcggtctgattaccctgatgaaatcccaacccttggcgtacaacaaagacaatcaggaagacaaagaacccttgttcgacaccgccgacacgcttatcgacacgttgcggatttacgccgatatgatgcgcggcgtaaccgtcaaacccgacaatatgcgcgccgccgtgatgcagggcttcgctaccgccaccgacttggcggattatctggtcaaaaaaggcatgcctttccgcgatgcccacgaagtcgtcgcccaagccgtgcgccacgccgaccaagcgggcgtcgatttgagcgaactgccgctcgaagtcttacaaggtttcagcgatttgattgccgacgacgtttacggcgtgctgacacccgaaggcagcttaaacgcccgcaaccacttgggcggtaccgcgccggaacaagtccgcttccaagtgaaacgctggcgggaaatgttggcttaacccccaaatgccgtctgaagaaatgttcagacggcatttttaaaaggcaagaacacgatgaccgatacggatacccaagccgaccgcttcgaacagatgatgtggcaggcggtggacaaactttttgaacagcatgacggcaaactcgaaagcatggacgggcgggaacaggagctggttttgatttggcggacagaagccgatatcggtaacggcagcatactgcaatttgtctgcaactggggtttccccgccgccgaaaagacttgttccgttctgaaaaaaatcggcgcggtacacagcgcaatgctgatccatcgggcggcagacgcattggacaaagaaatccgccgcctccaatcggaaggtaaaaacctgaaagaaatgtgggatataacatctcgacaacaaaaccgcctcactgctgaacagtctggatgaacaatattggcaagaccccgacaaactgtatctgctgggatggcaatactattccagcaaccctgttcagacggtggcggattcgcatataacgtgggccaatctatgtataataggaattccagaaggagtagaaaaagataagggaatggaaaatagg

SEQ ID NO: 40 - DNA, 17381 bp, Neisseria meningitidis
catgaaaatgcaggcagttgttgtgaataaaaatgtagcgggcgatgtggaagtaatcgaacgcgaggttcgcccgttggaatacggcgaggcattggtcgaagtcgaatattgcggcgtgtgccacaccgacctgcacgttgcggcaggcgactacggcgaaaaaccgggccgcgtgttgggacacgaaggcatcggtttggttaaagaagttgccgacggtgtgaaaaatctgaaagtcggcgaccgcgtcagcatcgcttggctgttccaaagctgcggctcttgcgaatactgcaataccggccgcgaaaccctgtgccgttccgtattgaacgcgggctacaccgccgacggcggtatggcgacccactgtatcgtgagtgccgattacgcggtcaaagtccctgaaggtttggatcctgcgcaagcttccagcattacttgtgccggtgtaaccacttataaagccattaaagtttccggcgttcgtccgggacagtggattgccatctacggcgcgggcggtttgggcaacttgggggtccaatacgcgaaaaaagtattcggcgcgcacgttgtcgccatcgacatcaacgacgacaaactggcgtttgccaaagaaaccggcgcggatttggttgtcaacgccgccaaagaagacgctgccaaagtgattcaggaaaaaaccggcggcgcacacgctgcggtcgtaaccgccgtatctgctgccgcattcaactctgccgtgaattgcgtccgcgcgggcggacgtgtggttgccatcgggctgccgccggaatcgatggatttgtccatcccgcgtttggttttggacggcatcgaagtggtcggctctttggtcggcacgcgcaaagatttggaagaagccttccaattcggcgcggaaggtttggttgtgccgaaagtccaactgcgtgctttggatgaagcacccgccattttccaagaaatgcgcgaaggcaaaatcaccggccgtatggtgatcgatatgaaaaaagaatgcggctgcggccatcaccactgatttgacgtggcagtacacatcgaaatgccgtctgaacgctgttcagacggcattttttatggatttggatttgattttaatctgttctgtttgaaataccgtctgaaaacccatatcgcaacacttcattaaaaacggcaagattcagccgttctgcaacccgttcaaacggcttccgccatttccaacgcctgtttgatgtccacggcgacgacgcgcgagacacctttttcctgcatggttacgccgaccagctgctccgccatttccatcgtcaggcggttgtgggagatgtagaggaactgggtttgcgccgacatttctttgaccagcctgcagaaacgcgaggtgttggcgtcgtccagcggggcatcgacttcgtccaaaaggcagaacggagcggggttgaggctgaacagagcgaacacgaggctcatggcggtgagggctttttcgccgccggagaggaggtggatggtgctgtttttcttgccgggcggacgcgccataatggacacaccggcggtcagtaggtcgtcgcctatcattttgagagtggcttcgccgccgccgaacagggtcgggaagaaggtttggactttgctgttgacggcatcgaaggtttctttgaaacgcgctttggttttgtcgtcgatttgggcgatggcttcttccaaaagggtgatggctgcctgcacgtcttcgctttggctgcggtagtagccgtcgcgttcgcgcgcttcttcgagttcttgcagggcggcgaggttgaccgcgccgagtgcttcgatttgttgcgaaaggctgccgatgctgctgttcaatactttcggcgattctttcgccaacgcttcgagcgcgtccaaatcggcggcgcgttcggtcaggttttgatggtagcgtttggcgttgatcagggcttcctgctgctgcaacaaggcggtttgggtggcggcctgaagctgcggcagcttggtttgcagggtttgcactttagcgtattgctccctgccctgttcctgaatctgcgcgagtttctcttgcacaacaatatattcttcgtccaaggtctgtacggcttcgcttaattcttcaagcttgatgtgctgctcgtcgttttggaactcggtttcataggcgagggcaagctcttgctggcgttcctgccagtcgagggtttgctgttcaagctgggcgatttgctgccggtagttttgtttttgctggttgagtttgtggacggcgacttcggcaagcccgtattggcggttggcttccaacagggcaagctgcgcctgtttcagacggccttgctgctcttggcggctgtgcgcggtggtttgctgctggtgttcgagttcggcggcggcttcctgcaaggtaacgatgtcgtctgaaagcccgtcggacgtgtgttgcaacacggtctgttcttccgccaactgcgccagttcgcgctcgatgtgttcgcggcggatttgcccttggttggtacgcgctaagagttcggcggcgcgttgctgtgcttgactgtattggcgcgtgtgctgctgttgctgctgcatcaggtttttatgttgcacttcagacgagcgcacggcagcttccgcctgtttgaacgcggcttcggcggcggaaagttcgggggcgaggttttccagttcggacgcgatgccgtcgaggcgcgctttttgggcaatcaggctttcctgcgcgggtttggcatagagcaggacgctgactttatcgacctgatgaccttcgggcgtgagccagatttggtgtgcgcccaaatcgttttgatgcgcgagggcatagctcaaatcgggcgcgcacaatacgccgtcgagccagtagtgcaatgccgtctgaaacggcggctgcgcttggatttggttcagcaatgcctgtacgggcagggattttttgatgccgcctgagaggtcgtctgaaagccatgccgcctgcccctgcggcaaaggctcgggcggcacgaaaccttgcggcacggcgcgggcgtgcaggcgttcggcaagaatgacggacaaggcgtgctgccactcggcgggcgcggtgatgtgttgccacagttgcggcgcggcggcgtggtcggttgcctgccagaaatcggcggcttcctgctgttgcgacaggatttgcgacaacgcctgctgctgcgcctgcaaggtgatgtgttgctgcttcaggctttggaagcggtttgaggccgtctgaaacgcctcgcgggcggcgtgtaaggcttcttcggcggcaatgatttgttcttcgtaatgctcttgctgactttgcaacaaggcggctgcttcctgcgcggcggcggtttcggcttcgtcgggcaggtttaaggcttggttttcctgtttcagacgacctttgcgctcttcgtgcttggcaatcgtttgttcggcatgggcaagctgctgctgcttcaacgccagttcgcggcggatgcggtttgcctcgtcctgctgggtttggaaggcggcgttgagcgtggcttgggcttcttccaattcgggcagacgctcctcgtgttcggcaacctgcatcgcccattccgccagctcggtttgtttttcttcgacctgcaactcgttttcttcaagctgcacgcggatttgctgctgctcttgatgaatgcgttgtaactgcgcctgcgctgcctgcttgtcgcgttcgatgcgttggtgcaggttttgctgatggcggatttgttcttccaaacgggcaatctgctcgcgcaacacgccgcgcttgttgctcaattcatgcactgcctgctgctgcgactgttcggcagtctgcaaggcgtgtacttcgtcgtttaacgcctgaacctgcgcggcggtttcgtcctgctgcgcctgcaaagattgatgctgcgcggtcgccttatcggcggcggcaagcgattgccgccattgggcgtaatcgagcaaatcctgttgctgattcagctgcgcggtcagggatttgtagcgttcggcggtttccgcttgtttttccagcttttccacctgacgcgccaactcgttctgcaaatcgcccaaacgctgcaaatgctcgcgcgtgtctttcagacgaccttccgtctccttgcggcgttccttatatttggacacgcccgccgcctcctcgatataggcgcgcaactcctccggccgcgcttcgatgatgcgcgaaatcatcccctgctcgataacggcataaccgcgcgcgcccacgcccgtacccagaaacaaatcggtaatgtcgcggcggcgcacggtctgattgttgatgaaataagtcgattcgccctgccgcgtcagctgccgcttgatgctcacctcggcatactgcccccacgccccctgcaaactgtggtcgctgttgtcaaacaccagctccaccgaagccctcggcgcaggacggcgcgtcgccgcaccgttaaaaatcacgtcctgcatactctcgccacgaagctgcttcgccgaagcctcgcccaacacccagcgcaccgcgtcaatcacattcgacttgccgcagccgttgggcccgataaccgcgacaagctgccccggcacatgaatcgtggtcgggtcggtaaaagatttgaagccggagagtttgatatgggtcaggcgcataatggtcggaaaaaataaaaaagaagcgtattttaacggaaatcccgccgcaccaccccatatcttgccggcaaaaccttaccgcatcccgcaccctcgatgccgtctgaagccttcagacggcatttttaacgcgcccgaaccccggttccgccaatgcccgatgcttggcgcggcatttgccgtattgccccgccgccgggcgcgttataatccgccccgacatccgcccgattggaaacctgcctatgaaacccgcctatttcatttccgacctgcatttgagcgaaaagcagcccgaactgaccgcgctgctgctgcgttttttacgttcttccgccgccgggcaggcgcgggcgatttacattttgggcgatttgtttgatttttgggtgggcgatgacgaagtttccgagttgaatacttcggttgcgcgtgaaatcaggaaattgtccgacaaaggcgttgccgtgttcttcgtcaggggcaaccgcgacttcctgatcggtcaggatttttgccggcaggcgggcatgacgctgctgccggattactcggttttggacttgttcggctgcaaaaccctcatctgccacggcgacactctgtgtacagatgacagggcataccaacgtttccgcaaaatcgtgcatcggaagcggctgcaaaaactgttcctaatgctgcccctgaagtggcgcacgcgccttgccaccaaaatcaggcgtgtcagcaaaatggaaaaacaggtcaagcccgccgatattatggatgtcaatgccgcctttaccgcgcggcaggtacgcgccttcggtgcggaaaggctgatacacggacacacccaccgcgagcatatccatcacgaaaacggctttacccgcatcgttttgggcgactggcataacgactatgcttcaatcctccgcgtggacggggacggcgcggtattcgtgccgctggaaaaatactgaaaatgccgtctgaagcctttcgggcggctttttttacacgcccctttcccacactccctccgccgcatcatcactatccttaacccgcattaatagccattatcgataaaatgcttgaccgattacataagattacgtaaagtgtgcaaacgcataacaattggtcttaccaatttatcttttaaccaaaatatcgggtgtacgggatttgaacgtctttccaaacctcgacgcgccttatgatgcaaatgcctaaaaaggattcgttatggcacttttcctcagcatattccccatcgtcctgctgatttggctgatggtgaaaaaaaacagtatgccctcctacgtcgcgctgccgattaccgcagtgctgatttacgccatcaaacttttctacttcgacgatgcgggcatgctgctcaacgccaccgccgcttccggcctcgtcaaaacgctcacgccgattaccgtgattttcggcgcgattatgttcaaccgtatgatggaaaccacgggctgcatcgatgtcatccgcaaatggctggcgaccatcagcccgaaccccgtagcgcaactgatgattatcggctgggcttttgcctttatgattgaaggcgcatccggcttcggtacgcctgccgcgattgccgcgccgattctgatgagcttgggcttcaacccgttgaaagtggcgattttcactttggtgatgaactccgtccccgtctctttcggcgcggtcggtacgccgacctggttcggtttcgcaccgctgaacctgagtgccgaagacatcctcgccatcggcaggcagaccggcgtaatgcacttcttcgcaggtttcgtcatccccgtcatcggcttgggcttcatcgtaccttggtctgaaatccgcaaaaacttgggcttcgtcgccattgccgtcttctcctgcaccattccttatgtcgcattggcgatggtcaacgaagaattcccgtcgctcgtcgccggcgcgatcggcctgatggtgtccgtattcgccgccaaccaaggctggggcttgagcaaagaccacgccaaagacccgaatgccgaaaaagtgccgttcgcccaagtcgccaaagcactcgcccctttgggtatgctgatcggcatgctggtggttacgcgcatcaaacagctcggcatcaaaggcattttgaccagcaaagaagaatggttcagcttccaactgccgtttgatttgtccaaaatcaccgtcagcgactccctgacgattaccttcggcaatattttcggacaagatgtcagcgcgtcttaccaaacgctgtacgtcccggcttggattccgtttgtgctgaccgtttggatttgcatcctgctgtataaaaccaaattcaaagatgcctggacgatttattccgtaaccttcaatcaaaccaaaaaaccgctgcttgccctgatgggcgcgctgattatggttcagctgatgctggtcggcggcgacaattcgatggtgaaaatcatcggtaaggaatttgccgcaatggcgggcgaacactgggtttatttctcgccgtatctgggcgcgatcggtgcgttcttctccggttccaacaccgtgtccaacctgaccttcggcccgattcagcagcaaatcgccttggataccggcctgtccgttaccctgattctggcgttgcagtccgtcggcggcgcgatgggcaatatggtgtgcctcaacaacatcatcgccgtatgtaccgtattggatgtgaaaaattccgaaggtgcgattatcaagaaaaccgttatcccgatggcgatttacggcgtgattgccgtcgtcgcggcaatgattttcttcctctaggcgaaacgccaccatccatagcggcagcacgcggggaacggaaaccgccgttcaccgtctgggcggcgcgtcgggcagaatcccggtgccggaacaagcccgccccgccaaacaaatgccgtctgaaaccgaaaaaggcttcagacggcatttttccgccgtttgcgttcaggcgtaatgatgatgcggcatcttgccgtcaaggcggtagcgcgtgccgcaatacgggcaggcaacgctgcccgattctccttcgcacaaaggcaaaaacactctcggatgcccgttccactgctcgttgccgggtcccgagcaatacagcggcagattttccggcaacacggaaatttcctgcggattcagattgtccatttgattttcctttgcgtggttggcgtgcgcctattttacgccatcggcaggctaaaggatattttcggcgcaaagccgcaatccgctataatccccacttttcagacggcataccatgactgcgcttacccttccggaagacatccgccaacaagagccatccgccctgctctataccctcgtttccgcctacctcgaacacaccgcccaaaccggcgacgaatccctctcctgcctgtccgacgaccagcacacgctgaccgcattctgctacctcgacagccaagtcgaagaaggcggcttcgtgcaactcatcgcatccggttacggcgaatatattttccgcaacccgcttgccgacagcctgcgccgctggaaaatcaaagccgtgccgaaagtcttggacaaagccaaagccctctacgaacaacacggcaaaaccatcgaaacgctcgccgacggaggcgcagacatcccttccctgcgcaaacagttccccgaatttgaagaatgggacggcgcatactacgaagccgccgaacaagacctgcccctgcttgcagaacacatacagtcaaactgggaaaccttcgcccatatcgggcaggcgtgattgcgtctgtttccagcccgtgtaaaacagcgtaaaatcggcaaacccgaatgaccttccgtccccatcaaggagcaagctatgttcttcaagcacatcgaagccgcccccgccgatccgattctcggtttgggcgaagcgttcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaatggtttggaagaagatgcctacggcttgcgcgtgttcttgaaacacaatacagaattgctgattgccagctcttattccaaaaacttcggtatgtacaacgagcgcgtcggcgcgttcactttggtggccgaagatgaagaaacagcagcccgcgcccacagccaagtcaaaaccatcatccgtaccttgtattccaacccggcttcacacggtgcgaacaccattgcgctggtgttgaaaaatgatgatttgaaagcacaatggattgccgaactcgatgaaatgcgcggccgcatcaaagccatgcgccaaaaatttgtcgggttgctcaaagccaaaggtgcaagccaaaactttgatttcattatcaaacaaaacggtatgttctctttcagcggcttgactcccgaacaagtcgaccgcctgaaaaacgagtttgccatttatgccgtccgctccggccgcatcaacgtcgccggcattaccgacaacaacatcgattatctgtgcgaaagcatcgtgaaagtactgtaaaaagcacagccatatgaaaatgccgtccgaaccttaaccagttcagacggcatctgttttttgttaaaaaacaataaaccataacaatttcaaacaagctaaaaacatctataaaatcaaccaaatatgatgaactcaaataaaaaatacgaatatcatcattctcaaattcaaaatttgaacgccacagtattatccgaagccacaaaaacctttccgccgtcattcccgcgcaggcgggaatccgggaatccaatgctgcaagaattgattagaaacaactgaaaccgagcaaactggattcccgcctgcgcgggaatgacgaaataaggcgagtgaaactgatgaaacaaattgattaaaaacaataacttatattattttatttaaattttcgataaaatcaattttccgtattcaatactgctccaatcaattcccgcgcaccgtcgtccgccaatttcttagcgacagcgcgtccgagcgcgtcggcatattcggcaggggcttgcgcgtccgcccgcaacacaaccgaaccgtcggggtgtccgaccaagccgcgcaaggtcagcaagccgttttcttccgtgcaatatgcggccaaaggcacttggcagcttccgcccaaagcgcgtgcgagggcgcgttcggcggtaacgcaggcattggtaacaccgtggttcaagggtttcaaaacttcatacaaatcttcgcggtgcgcggcaatttcgatacccaatgcgccttgtccggcggcaggcaggctgtcggattccgacaaaatcatgcggatgcgtccgtccaatttcagacgctgcaaaccggcggcagccaagataattgcgtcgtattcgccgttatcgagtttggacaaacgggtttgcacattgccgcgcaaaggtttgataagcaaatgcggatagcgcgcacgcaactgggcttcgcggcgcaggctggatgtgccgacaaccgcgccttcgggcatttcttccaaacgcgtgtattggttggacacaaacgcgtcaaacggattggcgcgttcgccgatggcggcaagcgcgaaaccttcaggcaaatccatcggcacgtccttaatcgaatgcaccgccaaatcggcgcgcccgtcatataaagcctgttccaactctttgacaaacaagcctttaccgccgacttttgacaaagttttgtccaaaatctgatcgccgcgcgtggtcatgcccaaaatctcgacttcgcaatcgggatacagagccttcagacggccttggatatgctttgcctgccacatagcaagcaggctttcgcggctggcgatgacgagttttttcgggttcatgttcaatgcgttcaaagaatggaaacggcgtgaagtctatcatattttgaacgtttcttcagacggcaccgtcaggtctatgttatatttacacccacaaaacacgaaacccgccacaatgaaacgcaccaaaaaataccctttcttaacgttgcagcggcaacgtttccatttgaactttgaaaacgcctcttccgccgccggcatcccagccgaacgcgatttctaccgctgggcgtggtctgccttgaaaaatgaataccgccgcgccgacatcagcctgattcttctggacgaagaagaagcccgagcctacaaccgcgactaccgcggcaaagattacgccaccaatgtattgagtttcgcgctcaacgaaggcgaaatcctgccctgccaagtttcggaaaaactgtacggcgatttgattatctgcccgcaagtggttttgaaagaagccgccgaacaaggcaaaacacccgagcagcattttgcccacctgaccatacacggtactttacacctgatgggctacgaccacatcgaagacgacgaagccgaaataatggaagccgaagaaatccgcctgatgcgggcggcaggcttccccaacccctaccaagaggactgacattaaaatggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttccgaacgctggcgcatccatgcagctaccgaaatcgaagacatcaacaccttcttcggcacggaatacagcagcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaagcaccgccgtttctgcacagtttaggatgacggtacgggcgttttctgtttcaatccgccccatccgccaaacataaaaatgccgtctgaaaccgttgcaagtttcagacggcatttcgcttatccgcttattttttgctcaaagtcagccccgtccaaccgaataacagggtcaaagccaaactcaaatagcagaaaaaggcatacggcagatattcccaaaccggcacgcccagcgcgtggctgatgaacacgccgcatacgctccacggtacgagcgggttaatcaccgtccccgcatcttccagcgtccgcgacagattgcgcgaatgcagaccgagcttatcgtaaacgggtttgaacgtttcacccgacaacaaaatactcaaatattgctcgccgatcaggaaattaaccccgaccgaagtcatggcaacgctgaacgtcgcgcgtccggcattcgtcaagaaggtacggatggcctccaacagggaaggaatcacaccgagcgcaaacaacagtccgcccaaactcatcccgagaatcacgatggtttgcgtgaaaaacatactttccaaaccgccgcgcgaaatcagtttgacaacatctttaaacgcttcgccttcgagtttgtagccgccgtaaaaccacgcaccgagctgacgcagatcgggcgtgctgtgcagatacgttacagcaacggcaaccatgacggtaaagagcatggcgacgacggcgttgatgcgcatcaatgccaaaatgaccaacagcgcaaacggaatcagcgaatagccgtgcaccaatcccgtggcttcaagctggctgcggaaggattcgacgctgttcaaatcctgcgcggcgacattcggcaaaagccaaagcatcagtgccgcactaatgagccacgcggggatggtggtgtacatcatatttttgatgtgctcaaacaagtcgatgccgacgatggacgcggaaatacccgtcgtatccgaaagcggggacattttgtcgccaaaaaatgcgcccgaaacaatcgcgcccgccgtcatcgccatatcggcctgaaacgccgccgccatccccataaaggcaacgccgacagtggcgcaggtggtcaggctgctgccgatggacacgccgatgacggaacacagcgcgaaggaggaaaaataaaaataagtcggggaaatcagtccgaaaccgtaatacatcagcgtcggaatcgcgccgctcatcatcagcgcgctgaccatcagcccgatgaagaaaaacaggtaaatcgcgcccataccctgattcaacgcgcctatcatgccctgctgcatatcgttgtatttcaaaccgcgcgccaagccgtacaaaatcagcacgacgatggcggcaataatggacatatgcggcaaccactccaatgaaatgatggtatagcccatcgcggcaatcagagcgacgacgacggcaagtgcctcaccgcgcggcatatcgagtaaggatttgaaagcgaacatgattctttgcccgatttgatataaagttaacggattctaacacaccataccgaatccgcccgacgttttcagacggcattttagcgttttacaaaagccggacagaaacaaaacggcaattttctcaatttaaattaatttttttgaaatataattttttatttttttgtttgttgacatataagacttttatggattgaagtattaaaacctcggcacacacgccgcaaacaccggtacgcaaaaatgccgtctgaaagatgttcagacgacatttctcaagaaaaagattatttgtccgccctatatccgtacaccgcaaaaaacacgatatacagataacagatgacggaaacgacaaacgaagacatcagggtgtaagtatctgccacccagccctgcacgacaggaacgaccgcaccgccgacaatcgcggtacacagtacaccggaagccgcgttggtaaattttcccaatcctttggttgccaaagagaaaatcgtcggaaacataatcgagttgaaaaaaccgatggcaagcagcgaccacatcgccacatccgcattgccgctacccgtcgccatcgcgacggcaagcagtacgaccgcagccgatgcgttaaacgccaaataacggttgggcgcgaatttcgccatcaccgccgaaccgaggaaacgtccgaccatcgcgccgccccaatagaacgacaggtaatgcgcggcagaagcatgatccagccctttcagataacccaatacgttgaccatcaacgaaccgatagacacctccgcgccgacatagcagaaaatgcctgccgtaccgaacacgagatgtttgtattgccatacgctggttttgccgtcgtggttgtgcgcgctttcctcggcggcaattttgcgcgcgtcgggcagccggatcattttcacgaaaacggcaaggataatcagcagccccgccagtcccaaatagggaatctgtacggaagaaatctgttccgccttgctgacggtttgggttgcgtccgccagaatcaggaacgcgccgatttgcggcgcaatggtcgtacccaaagcgttaaacgcctgaaccagcgtcagtgttgccgattccttgccgggtttcgccagcagggtaacataaggattaccggcgacctgaagcagcgttacgccggaagccaaaataaacaacgcgcccaaaaataccgcgtaagaatggctgcccgcagcaggataaaacagcaggcatccgaccgccgtcagcagaaagccgccgataacgccgtttttgtagccgactttgccgacaaaagcccccatcgggatggacatcaccgcataggcggtaaagaaacagaattggatcagcatcgcctgaacgtaagacaggtcgaaaatttctttcaaatgagggataaggatgtcgttcatgcaggtaataaaacccatcatgaagaacagcgtggtcaagacgaccaatggggacgtatgattgttttgtgattgcgcagacatgatttgcctttcgtggtgtcggaatattacccgtttcaagaaaatagaaattgacatttcttaacggcaatgcaaatcatactgatatttgaacattttgcaaactttatcggatgcaggcaatgcgccgatctgaaattcaagcagcagaaattaatattttacagttgcttgcatagattttaatagattttaaaaaatccggcggacttgcaaaaaccgttcccaataaaatgaaaatccgccgccgtatccggaaaattcggaaatgccgcatcgtggcatcaaaaccggagcggaaagaatgtcgtatgcccgacaaaaaaggggcatacggctgtgccgtattttttgcaccgtcctccgcccttcggcgggggcgtgaaaatagagtggattaacaaaaatcaggacaaggcgacgaagccgcagacagtacaaatagtacggaaccgattcactcggtgcttcagcaccttagagaatcgttctctttgagctaaggcgaggcaacgccgtactggtttttgttaatccactataccgtacaatccgtcgccgattgttacctgtttgagactgtttgcaatgataccctcctacacctacgccgccctcgccttttccgcattcacttccgccaccctcctgcccggcacatccgaagccgcctttgccctgttcgtccaccgctttcccraacacgcatacggcgcgttgctgtgcgccggccttgccaacggattgggcagtatggtttcctattggatggggcgtttgctgccctcccgaaaaatgccgtctgaaaaaacactgaatctgatgcggcgtttcggtatttggctgcttgcgtttacctggctgcccgtcgtcggcgacgcactgccgcttgccgccggctggctgcggttgaatccgtggacaagcgggctgatgctggttatcggcaaaacggcgcgttacgccttcattctgtggggaatgcaatattacgccgcctgaaccatacgttataatgccgaacacacaaacccaccgtataaaaaaatgaacagacacatccgccaagaaatcttcgaacgcttccgcgccgccaacccccatccgaccaccgagctgaatttcaactcccctttcgagcttttaattgccgttctgctttcagcgcaggcgaccgatgtcggcgtaaacaaggcgacggcgaagctgtttcccgttgccgatacgccgcaggcgatgctggatttgggtttggacggcgtgatggaatacacgaaaaccatcgggctgtataaaaccaaatccaaacacattatgcaaacctgccgcatcctgctggaaaaatacaacggcgaagtgccggaagaccgcgaggctttggaatcattgccgggtgtggggcgcaaaacggcaaacgtcgtattgaacacggcgttcggccatcccgtcatggcggtcgatacgcatattttccgcgtatccaaccgaaccaaaatcgcccccgggaaagatgtgcgcgaagtcgaagacaaactgatgcgcttcattcctaaagaatttctgatggacgcgcaccwctggctgattttgcacggacgctacacctgcaaggcactcaaaccgcaatgccaaacctgcatcatcaacgatttgtgcgaatatcccgccaaagcctgaccgccgccgcccttcaaaatgaaacgcttgaaaattcggacggacgttgtagaattttaacctatgccgtctgaagccgacaaaatgcgcttcagacgg

SEQ ID NO: 41 - DNA, 10577 bp, Neisseria meningitidis
gcaggtcgtatctagaggatccccggcaatttccctttatctgctttgaaaaacggtgcataatcccgagcaaaaccgcaatcaggagcaattatgcaaaactatctgacccccaatttcgcctttgccccgatgattcccgaacgcgcttcaggcagccgcgtttgggatacgaaagggcgtgaatatattgatttttcaggcggtatcgccgtcaatgcgctgggacactgccaccctgcccttgtcgatgctttaaacgcgcagatgcacaagctgtggcacatttccaatatctatacgacgcgtccagcgcaggaattggcgcaaaaattggttgcaaacagttttgccgacaaggtttttttctgcaactcgggctcggaagcgaatgaggcggcgttgaagctggcgaggaaatacgcccgcgaccgtttcggcggaggaaaaagcgaaatcgtcgcctgtatcaacagttttcacggacgcacgctgtttaccgtgtccgtcggcggtcagccgaaatacagcaaggattatgcacccctgccgcaaggcattacgcacgttccgttcaacgatattgccgcgctggaagctgccgtcggcgaacagacctgcgcggtcatcatcgagccgatacagggcgaaagcggcatcctgcccgccactgcggaatatttgcaaaccgcgcgccgtctgtgcgaccggcacaatgcgttgttgattttggacgaagttcaaaccgggatggggcatacgggcaggctgtttgcctatgaacattacggcattgttcccgatattttgagttcggcaaaagccttgggctgcggctttccgatcggcgcgatgctggcgacagaaaagattgccgccgccttccaaccgggcacgcacggctcgactttcggcggcaacccgatggcgtgtgcggtcggcagccgcgcattcgacatcatcaatacgcccgaaactttaaaccatgtccgtgaacaggggcagaaacttcagacggcattgctggatttgtgcaggaaaacgggcttgttctcacaagttcgcgggatggggctgctactcggctgcgtgttggacgaagcctatcgcggacgcgcatccgaaatcaccgccgccgccttgaaacacggcgtgatgattttggttgcgggtgcggacgtattgcgtttcgcgccttcgctactgttgaacgatgaggatatggcggaaggtttgcgacgtttggaacacgcgctgacggaatttgccgcgacatcagacaatccgtaaaactcaaatgccgtctgaaggcgggaaggcttcagacggcatcagaaacaaaaaaccgcttcagaaacgtggttcaacgttccgaagcggttttgtttgccatcaggactcgaacaccaattccggttccctgccctcttcgatgactgccttaccgaccaccacttttttcaagcctttcaaatcaggcaggcggtacatcgtatcgagcaggcagcgttcgacgatggacctcaggccgcgcgcgccggttttgcgttccattgcctgacgcgcgatggaacgcaatgcgccttcttcaaactccagttcgacattttccataccgaacaacgcctgatactgcttgaccaaagcatttttcggctcggtcaaaatattaatcagcgcgtcttcgtccaattcttctaaagttgcaatcacaggcaaacgtccgattaattctggaatcagaccgaatttaatcaagtcttccggttcgacgatgccgaacagcttggtaatgtcggcattttcgtccttgctgtgaacggacgcaccgaaaccgataccgcctttttcagtacgctggcggatgactttttccaagcctgcaaacgcgccgccgcagataaacaggatgttggtggtatcgacgttgataaattcctgattcggatgcttgcggccgccttggggcggaacgctggccactgtaccttcaatcagtttcaacaaggcttgttgcacaccttcgccggatacgtcgcgggtaatcgacgggttgtcgcttttgcgtgaaattttatcgatttcgtcgatatagacaatgccgcgctgggctttttcgacatcgaaatcacatttgcccaaaagcttggtaatgatttgctcgacgtcttcgccgacataacctgcttcagtcaaagttgtggcatccgccatcacgaacggcacatccagtttgcgcgccaaagattgcgccagcagggttttacccgatccggtcgggccgataagcaggatgttggatttcgacaattcgacattagctcctgctttaggatggcgcaggcgtttgtaatggttgtacaccgacaccgccaaggctttcttggcttgttcctgaccgataacgtggtcgttgaggttggcgacgatttcggcgggcgtgggcagcttgccggattcttccggctcccctccggcactttccgaaggcgtgccgtcatttccgtcttcatgcaatatttcaatacagtttgagacgcattcgtcacagataaaggcgttttcgccctcaattaaatgtttgacgtgtgatttggattttccgcaaaaggaacaagtacggttttcgttggacatggctttctttacaatgtatgcgttacagaaaacggcacgtgccgttcgggttgccaagtataataactatatccgttcttatcaatgtattaccttaaaatcccgccgattaggctataatacgccctttcgcaaccgccccggcggcaaaaatgccgtctgaaaccaaatctgaaatctgaggatattcatgagaaaaccccaacgcggctatgcccgccaagaccgtgtcaaagaacaaattatgcgcgagcttgccgaactcgtccgtaccggactgaaagacccgcgcgccggcttcattaccgtcaacgaagtcgaagttacccgcgattacagccacgccaccgtgttctacaccattttaaaccaagacgcgcgcgaaattacggaagaagtgctggaacacgcgcgcggacacctccgcagcgaattggccaaacgcatcaagctgttcaaaacgcccgaactgcatttcaaatacgacgaatctttggaacgcggtttgaacctgtccgcccttatcgaccaagtagcggcggaaaaaccggttgaagactgacggatatgcccatgccgtccgaacatcgaaccatgaatacaggcaaaccccaaaaacgtgccgtcaacggtgttttgctcttggacaaacccgaaggcctttccagcaacaccgcgctgcaaaaagcgcggcgtttgtttcatgccgaaaaagccggacataccggcgtgctcgaccctttggcaaccggacttttgcccgtctgcttcggtgaagcgaccaagttcgcccaatacctgctggatgccgacaaagcctacaccgccacgctgaaactcggcgaagccagcagcacgggtgatgccgaaggcgaaatcattgccaccgcccgcgccgatatttccttagccgaatttcagacggcctgccaagcactgacaggcaacatccgccaagtgccgccaatgttttccgcgctcaagcacgaaggcaaaccgctgtacgaatacgcccgcaaaggcatcgtcatcgaacgcaaagcgcgctacattaccgtttacgccatcgatattgccgaatttgacgcgcccaaagccgtcatcgacgtacgttgcagcaaaggcacctacatccgcaccctcagcgaagacatcgccaaacacatcggcacgttcgcccacctgaccgccctgcgccgcactgaaaccgccggctttaccatcgcccaaagccacacgcttgaggccttggcaaatttgaacgaaacagaacgcgacagcttgctgctaccctgcgacgtattggtttcacactttccccaaaccgttttaaacgattatgccgtccatatgctccactgcggacaacgtccgcgtttcgaagaagacctgccttccgacacgccggtacgcgtttacacggaaaacggccgctttgtcggtctggcggaatatcaaaaagaaatatgccgtctgaaagccttgcgcctgatgaacacggcggcatccgccgcctgaacggcggttaaaaatacaggctgtgcttgaataatgtgttgatatttccgcaaaatcccgacacactcggacacccgccccgcttatcgcaactttgcgaacgcccccggaaacagcaaagacatcaaataattgattttattagaatctatttgcaaagccatttgccgttacacaagaatggcacattaaaataactgatgaggatttataacgatgaagacagacattcaaaccgaattaacccaagccctactaccacacgaaaaagtatgggcgaacgaagaaaaaaccattttagccaaaaacatcctgttggatttggtggaaaaaaccgacccgaccattatcggtttgttattgagtaatgatgagttaaaacgccatttctttgtggaagtgaatggtgtgctggtgtttaaattgcaggatttccgttttttcttggacaaacacagcgtcaataattcctacacaaaatacgccaaccgcattggtttgacggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgaaaaagacaagaaatcttttttaatcaaacccttgcttttgatgaaattgatcggctttttgacgcaaaagcattctcaaaattctctcgctataccgcagacggcaaacaagccgttggcgaaatcaaacgacattcagacggcacacccgccgaaaatctcattatcaaaggcaataatctgattgccctgcattcgcttgccaagcagtttaaaggcaaagtgaagctgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaacgaacaggcatatttgaaaattttaatggatgaagttttcggaaatgaaaatttcatctgcaattttatttgggaaaaaaagacaggtgcgtccgatgccaaacagatagcgactattacagagtttgtcttatgttactcaaagaactttaaaacagttaaattaaataaaaacacgttttcttatgatacagagagatacaaattaagtgataagtttgaacaggaaagaggcaaatattatatcgacaatttagatagagggggattgcagtatagtgacagtttgaattttgcaatccaatgtccagatggcacttttacgtatccgaatggcaggactgaatttgtcaatgatggctggatatggaaatggagtaaaaataaaattgattgggcaataacaaacggttttttggagtttagaaaatcaaagtctaaaaaatctggatggagtgtatgttataaaaactatatgttggttgataacgaaaacaagccgatagaacgttctgctccctataagaacttaatacaggatatcttaaatacacatgcgacagatgaattgaaaaaactgttcggcagcaaagtttttactactccaaaacctgagagcttattgcagtatcttattcaaattgccacatccgaatccgacatcgtcttagactaccatcttggtagtggcacaaccgccgccgttgcccacaaaatgaaccgccaatatatcggtattgaacaaatggattatattgaaacgcttgctgttgaacgcttgaaaaaagtgattgatggcgagcaaggcggtatttccaaagccgtgaattggcaaggtggtggcgagtttgtttatgccgaacttgccccatttaacgaaaccgcaaaacaacaaattttggcttgcgaagattcagacggcatcaaaacgctgtttgaaggtttatgcgaacgctatttcttgaaatacaacgtcagcgtaaatgaatttagtcaaatcattcaagagcctgaatttcaatctttgccattagacgaacaaaaacaaatggtgcttgaaatgttggatttaaatcaaatgtatgtttcattatccgaaatggatgacgaacaatttgcagattgcctgaacgatgatgataaagccttaagccgtgcattctatcaatcagtaaaaaatcaagcggagaaaaaagatggcgaataataaaacgttgtttgaagtgattgaaaatgaacgtaaagcggttaaaaaatacaagcctgaattacttgaaatgccagaatttacgtccaaaaacttaaaatatgatttttttgaatggcaaaaatctgcccttgaaaactttttgatttttgaccgcacttcaaagctagacgatttccctgatttaaaaaataagccaacgcatttgctgttcaatatggcaacaggtgctggcaaaacgatgatgatggcggcgttgattttgtattattttgaaaaaggttatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaattatcaaaaacacaatgtgattattaccaactccgaaaccaacaaaaccaaaaccgaaaaaaccgacagcgaaacagaaaaattgctgaataatttggaagcggctgataatccgattcgtgccatttttacggtggacagattaaccgaaggttgggacgttctgaatttgtttgatattgtgcgtttgtatgaagggcaaaacggcggcggttcaaataaaaaatcaggcaaaacggctgccgctactgtatcggaaaagcagttgattggtcgcggcgtgcgttattttccatttgcgtttgaaggtaaacagccgaataaacgcaaatttgacaacgatatgcaacacgaattgcgtattttggaagaattgttttattacacgcacgatgagcaatctcgctatattacagaactgaaaaacgagttacgaaaagacggttatttgcctgaaaaagacgatgataaggtattggcaacatttaaactcaaatctgaatttgccgataatcaggattttagagagttgttaatttgggcaaataaaaaaatccccaatcccaatgccagagccaataatgcagacagcytgaaagccaatccgcaaacgcttccattccaagttcacggcaatcaactgttgcaggaaacgcaatttacagccgatgaaaatgatgaaatagcccgacaaatcgacacacaaaataattttactcaaatcataaaaatgagtgaaatggaacggcacattttcaataaatccctgcatatcaaaggaaaaaatggtcaatctttattccattttgaccgcttgcaaagcaaactcaacatttacaatcgcaatgaattgcaaaataacttgttaaaagattgacaaattgaatttttgggattagggcaagacaaacagatcagcccagatgacaaacttgcaggctgcctaaaaatcttggaaatggttgaaaaacatttgaatgaaagtgatatgccatttatcggtacaaaagaatttacgcctaaaaaattgtgggaaatttttggcacaccaaaacaaaaatgggtcaaaaaagatgatataaaaactgccattgccacgcaaaatgattggtatgtgatggataattttgctggaacgagtttggaagaagcgttaattcaatttatttcagagcatttgggcgatttgaagtctaaatatgatgttcatttaatccgtaatgaagaagtgtttaaattgaataacttttccgatggtgaaggatttatgccggactttattttattgctgaaaaataaacaaaaatcttcttccaatggtgtggatgactttttgcattaccaaattttcattgaaccaaaaggtgagcatttggtggaaaatgattcgtggaaagacgcttttttaaaggcaattacagcggaatacgggacggataagattctgcaaaaagatacaccgcattatcgtttgatcggtttgccgttttttactgacaatcaggaaaatgaacaatttacaaagtcattccctttaggggcggcatcgcttgaaaaatagagtggtgcattgcaggcaaccccgtttgacaaaacttcctttacaaaagggcgttttgtcagatatttaatcaacacattattaaaatacagccaaattttaatgccgtccgaaccctgtgttcagacggcatcgtatttttcagtatctaaaccgtttccctgccccaatctttgcctctcaaaatcgaagcatcgacatcttgaatatcgcggtgtcccgtaaacgccatagatatatccatttctttatacaggatttccagcgcacgggttacgccttcttctccatacgcgcccaagccatacaggaacgcccgacctatcattgtacctttcgcgcccaaagcccacgccttcaaaatatcctgaccgctgcggatgccgctgtccatccaaacttcgatgtcgctgcccactgcgctgacgatgtcgggcaaggctttgatggcagacacggtatcgtcgagctgtcgaccgccgtggttggaaacaatcaatgcgtccgcgccgcttttcgctgctttttccgcgtcttcaggttccataatgcctttgataatcagcttgccgccccacaaatctttaatgcgcgccacatcgtcccagctcaggcgcgggtcgaattgttcggaagtccatgaagacagcgaagacaaatcgccgacgttcttcgcgtgtccgacgatattgcggaacgtgcggcgttccgtgttcagcattttcatacaccattcgggcttggtcgccagattgattaaattggcgatggtcggtttcggcggcgcggacaggccgtttttgatgtctttgtggcgttgccccaaaacctgcaaatcagcggtcaataccaatgccgaacatttggcatccttcgcgcgcttaatcaggttttccataaactcgcggtcgcgcatcacataaagctgaaaccaaaatggtgcggaagtgttctcggcaacgtcttcaatcgagcagatagacatcgtggacagcgtaaacggaatgccgaacttctccgccgcccgcgccgccaaaatttcaccgtcggcgtgtgccatacccgtgaaacccgtcggcgcaatcgccaccggcattttcacatcctgcccgatcattttggtttccaggcttcggccttccatattgaccaatactttttgacggaagcggatgtctttgaaatccgaagtgttttcacggtaggtagtttctgtccacgaacccgaatcgatgtaatcgtaaaacatacgcggcattttgcgcttggcaacgcggcgcaagtcttcgatgcaggtcattttgctcaaatcacgtttcatttgtcgcc

SEQ ID NO: 42 - DNA, 44608 bp, Neisseria meningitidis
agggtgaagtggtcggggcgtgcttcgcttaaagtgatatcgaagtattcgttttgtttcagtttgtttttgtcgtaggttttaaacgtccctttttggcggtagtaacgttccatggtctgcgcgttgtgcagcagggtcgtcctgacttccgacaggcggacgcgccggatgtaggttttataggaagggtaggtgatgagcgtcaggatgccgaggatggcgacggcaatcatcagctcgagcagcgtaaagcctttttgaacgtttttcatagcaatgtgtttccatttgtttgtcggtcgacggcattataacgccgtatcggaaatggcggaatatgtaaacggattgaaattttcgggaaagcagattgtataagccatttaaaacaaatggttatttttattgtcggcagtttgccgccttggatggggcagggacttgcggtagaatccgcttccgatttatgggattgacgcatacagagaattgaaaacatggcaaaaatgatgaaatgggcggctgttgcggcggtcgcggcggcagcggtttggggcggatggtcttatctgaagcccgagccgcagctgcttatattacggaaacggtcaggcgcggcgacatcagccggacggtttctgcaacaggggagatttcgccgtccaacctggtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataaacgaatatgccgtctgaacacggaaacggtttcagacggcatttgttattgatttacggaatattatgagcttgatcgaatgtaaaaacatcaaccgctatttcggcagcggcgagaaccgcgtccatattttgaaagacatcagcctgtcgatagagaagggcgattttgtcgccatcatcgggcagtccggttcgggcaagtccacgctgatgaacatactcggctgtttggataccgccggttccggttcgtaccgaatcgacggcatcgaaactgccaaaatgcagcctgacgagctggcggcattgcgccgcgaacgcttcggtttcatcttccaacgctacaacctcttaagctcgctgaccgcaagggacaacgtcgcgctgccagccgtctatatgggcgcgggcggcaaagagcgttccgcgcgggcggacaaactcttgcaggatttgggtttggcaagcaaagagggcaacaagcccggcgaactctcgggcggacagcagcagcgcgtctccatcgcccgcgccctgatgaacggcggagaaatcatcttcgccgacgagccgaccggcgcgctcgataccgccagcggcaaaaacgtgatggaaatcatccgcaggctgcacgaagccgggcataccgtcattatggtcacgcacgaccccgacatcgccgccaatgccaaccgcgtcatcgaaatccgggacggcgaaatcatttccgacacctcgaaaaatcccgaaatccccgcaagcaatgtcgggaggattcgggaaaaagcttcgtggtcgttttattacgaccagtttgtcgaagccttcagaatgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattgaggttggacaaagatgccgtctgaagctgcaggaccggtcattttggagcagaaacttattggataaaaacggtttcttagattctacgttccagattcccacttgcgtgggaatgacggcggcgggggttcgatgattgcacacaacgctcgagtcccgtcattcccgtaaagacgggaattcggttcgttcggctttgcttgtttcggataaatcacggtaactcaatattccagattcccgcccgcgtgggaacggcggcggggcttcgtattgttcaatttattattttcaatcattcaatgggttaggatgtgtttgttggcttgctaactttcagggcggattggttttcaggcggcatttcccgcaaaaaaggcttggaattttccaagccttttttgcggatggattattgatttttgcggatgatttcctccagttggggcatcgggctgtagccgctttggctgcgcccgttggggaagacgagggtcggcgtgccgttgaagccgaattgttcgcccaaggaagtggtttccgcgacgggattgtcgcagatgctgccgccgaccgggaatttgcctttacgcatccaatccgtccacgctttggcgcggtcgggctgacaccataagatttgcgccttgcgcgcggcatcggggtgcaggccggcaatgggcatcataaagctgtaaaccgtcacgtcggtcattttttcaaactcgtgttccaagcgtttgcagaacggacaatcggggtcggagaagacggcgactttcagcttgccgttgccgcgcacttctttgatggctttgtccaaaggcagggaggcgaagtcgattttgttcaaatcggcggcgcgttcttcggtcaggtttttgcgcgtgtcgatgttgatgagttcgccgacgaacatatagccgccttcggcatcggtgtagataatctgcctgccgctgacgacgacttcgtaaatgcctttgaccggtgtttcgctgacgctcaacactttcaaatcttgggcggaataggttttttccaaacgcgctttcaaagaggcggcaacggatttgccggcggactcggctttgacggcgggttcggcgttggcattggaaacgggcgtttgcccgcaagccagcagcgggaggacggtaaagggggtcaagattttgattaacttggttttcatataaagatgattgcgcgtgttggaaaagcggaattgtatcaaatctctgttgcgcctgcattgcgcctaggctcaatttatcgtctgaaaatagcttccggctgttaaaatacgcaaaaaatgatttgcttgtttgtatgatttaccaccgcatcgccgtaaacgtgccgctttcagacggccttttgacttattcccattccgatccgcttcctccgggaacgcgggtgcttgtgcctttccgcaataaaaccgtggtcgggatggtgtgggaaacggatattgcgcccgatatggatatggcgcggattttgagtgttcagacggcctttgtggaagaaaagccgttgcctgaaagctggcgtgatttgttggcatttacgtcgcgttattaccactatccgactgggcaggcggtgtttgccgcgctgccgcagggtttgaaggaaacgcgcgcggtggaaatgccgcagccgccgttgttttatgctttgaacgaagcgggcagggcgcaaacgccgccaccagctcggttcaacaaaaaagcggctttgtgggacgcactgctttcgggcggaatgacgatggcagcgttgaagcaggtaaacgcgcaggcggcgaaattgattgaagattgggcggagcagggttggattgaaacaacggaagcggcgaaacctgtattgaggtcgtaccacgggcaggcttcgcactctgaatttgtgttgaatgccgaccagcaacaggcttccgatgaaattcagacggccttcggcagcttccagccgtttttgctgtacggcatcaccggcagcggcaagaccgaggtgtatttcgatgcgatggcgaaagtgttggcgcaggggcggcaggtgttgtttctgttgcccgaaatcaacctcacgccgcagcttttgaagcgggtggaaaaccgttttgccgacgtgccgaccgccgtgttgcacagtcagatggcggcaggcaagcgcacgcaggattatttgcgcgcgatgttggggcaggcgaaattggtcatcggcacgcggctggcggtgttcacgccgatggatgatgtcgggctgattgtggtcgatgaggaacacgacggctcgttcaaacaggacaacgaattgcgctaccacgcccgcgatttggcggtgtggcgggcgaagcagggcggctgcccgatcatattgggcagtgccacccccagcttggagagctggcacaaggcgcaaagcggcgcgtaccgcctgctgcaactgaccgaacgcgcccataccgccgcgcaactgccgcaagtggacatcctcaacgtaggccgtctgaaacttgacaacggcttctcgccgcaagccttgcagcttttgaaacagaactttgaagcaggtggcatgtcgttggtgtacctcaaccgtcgcggcttcgcgcccgcgctgttttgcggcgactgcggttataccttcggctgcccgaactgctccgccaaaatggtgctgcaccaacgcgcccgccaactgcgctgccaccactgcgaccaccgcgaacccatcccgtacaaatgccccgactgcggcaaccaagacctgaccgccgtcggccacggcacgcagcgcgtcgaagaaaccctgcgcaccttcctgcccaaggcagccgtcgtccgtgttgacagggacagcaccgcgcacaaaaacgactgggcggatttgtaccgccgcatcgccgacaacaaaatcgacattttggtcggcacgcagatgctcgccaaagggcatgatttcgcgcggctcaacctcgttatcgtgttgaacgctgacggcagcctgtacagcgcggactttcgcgccccggaaaggctgttcgccgagctgatgcaggtgtccggcagggcggggcgcgccgacaaacccggcaaggtgttgatacagacccaactgcccgaacatcccgtcttcgccgccgtcaaagcgcaggactacgccgtgtttgccgaaaacgaattgaacgagcggcaaatgttcgccatgccgcccttcggtttccagaccgccgtccgcgccgacgcgccgcgcgttgccgatgcgatggagtttctcaatgccgccaaagaaaccctcgccccgcttttgcccgaaagcgtttcacagttcggcgccgccccgatgctgatggtgcgcctcgccgaacgcgaacgcgcgcaaatcttcctcgaatctccgtcccgacaggatttgcaccgtgccgtgagtttgtgggcgcaggtgttgcagcaaaaccgcgacggcaaaatcagatggtcggtggatgtcgatccgcaggaggcttgattattggcaatccgatgccgtctgaaaaccgtttcagacggcatttttattccggatcgtctgtaaacgcattcgcccgaaatatcggtataaacgtgaaaagatacagtacgaatacggcggcggtcagaatcgcaggaacggtaatgaaaaatatcgggttcacgttcatcaagaaagcgcgcgagacggcggcggcgaaaaggatggggacggcaatgcggcagagtttggggtagtcgagtttggtaaagccgctgtgccacagtccggcggtcagccacaccatcatcacgccgcccatcatgccgccgagggtaatcaggtgcaggggcgcggaggcgggcaggttttgtaatttcgccgcgcctgtccacaaatagcctgcggcggcaaagagttggagcaggtaataagtgcggacgtagtgtttacgtaagagttcgtgatggtgaagctcacgcagcttggcgagcaggatgaagccgacggcgagcgcggtaaaaccggcggtttgcgcgggcagccaaagttcggcggcggcgtgcaagagcaggaaagtaatggcgatgtttttataaacgatatttggaataaaaacagggtctttcagacggcattctttcagggcttccgcgcccaaaagaatactgacgcgcacggatacgaacatcaccgccgccatatttagatgcacttgcgcgcgcaacaggttcaaatcgccgctgacggcatatgccgtctgaaaaacagtgaacgcggcaagtaacattagcagggcgaagttgtcggtgtttcggtctagccaaatcagccgggcgcagaacagcagcaacaccagccaataggcggcgacgaaaaacgaggcagtttgcggcgaaaagggcagtatagcggatgcggcgagcaataatgccgccatcaaagtcgcgacaggtttcaggttacccgaaaaacccgtccagtccaacaaagccgcagtcaaaaaaccgccgtatgccgccggcagcataagttccaagaaaatttggcggtgcaggacgatggcaccggggttgatgaaaaacaccagcgcaccgagtatggcaagcaccgccgcgccgacgaaaaacggccgcatagcaactgtatttttcaccccgtcgggcaaaaataccaaaactcaaatcaagccgtccggataccgttttcggcggtatcgttttcggcaaaataatcacgcatccgggcattcgatatcgtcagcagtttgcgcatacatgccgtaacggcaaccttatacggcttacccttggacagcaggcgttggtagaaatcccgaataagcggttcaaaacgtgtcgctgccacggtagccatatacagtgccttacgcaccgcagaccttccgccaaagcagcggcttttgaatttggtttcctcgctctccctcgggtgcggggcaatgccggccaaactcgctatccgtttgtgcgacagccgccccaattcgggcagcatcgccatcagcgtagccgtcgttatcgaaccgatgcctttgatttgctccgccacttgggctttgccgtcaaaatgcgtgtgggtgtggtcgtcgatttgtttgtccaattcgtcaatcagccggtcaaaatgggcaatcagttgtttgacgcttccgacttgcgtttcatgaacctaatgcagacggtttttctcggcagtccgcatatccaccagttggttgcggcggttaaccaaggcttccaacacttcttccacttcggtgggcgggtggtagggcatggtttgcgaaccttctttctgcgtcatcatctgtgcgaagaaggcgagcattttggcatctttggcgtcggttttggtcagcggctgcgattgggcaaactgatgcgtctgacgcgggttggcgataatcacggctatgcctgctcggcggatggctttggcggcggggatttcgagaccgccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgactcacttggtgcttcagcaccttagagaatcgttctctttgagctaaggcgaggcaacgacgtactggtttttgttaatccactataacagcaaccctgtcgccgtcattcccgcaaaagcgggaatccagtccgttcagtttcggtcatttccgataaattcctgttgcttttcatttctagattcccactttcgtgggaatgacggcggaaggtttttgtttttttccgataaattcttgaggcattgaaattccagattcccgcctgcgcgggaatgacgattcataagtttcccgaaattccaacataaccgaaacctgacagtaaccgtagcaactgaaccgtcattcccacgaaagtgggaatctagaatctcagactttcagataatctttgaatattgccgctgccttaaggtctggattcccgcttgcgcgggaatgacgaatccatccgcacggaaacctgcaccacgtcattcctacgaacctacatcccgtcattcccacaaggacagaaaaccaaaatcagaaacctaaaatcccgtcattcccacgaaagtgggaatctagaaatgaaaagcaacaagcatttatcggaaataactgaaaccgaacagactagattcccgcctgcgcgggaatgacgaatccatccgcacggaaacctgcaccacgtcattcctacgaacctatatcccgtcattcccacaaggacagaaaaccaaaatcagaaacctaaaattcgtcattcccgcgaaagtgtgaatctagaaatgaaaagcaacaggcatttatcgaaaataactgaaaccgaacagactagattcccgcctgcgcgggaatgacggctgcagatgcccaacggtctttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttaaatttaatccactatataaaaaatttccagagaaccgatacaacagttggaacttgggtttgggaatattacggtagatgaacttggaacctctgttatgctatggtcttttatctcaattgaaaaaagcgcgaatcaaacggttcgcgcttttttcagacggtattaattattttttgtcgtcttttacttcttcaaagtcggcatctacgacatcatcgtctttctttgcagaagcattggcttgttcgctttcgcctgcttgggcttcagcttgtgcttgagcgtaaaccatttcccccagtttttggctggctgcgcccagcgcctcggttttggcatcgatagcggctttgtcgtcgcctttaactgcttcttcggcttctttcagcgcggcttcgattttttctttctcggctgcgtcgagtttgtcgccgtagtcggccaaagattttttcacagagtgaatcagggcttcggcttggttgcgggaagcgaccaattcagtcagttttttatcttcctcggcattggcttcggcatctttcaccatgcgttcgatttcttcttcgctcaaacctgaagaaccttggatggtgatgttggctgctttaccggtgcctttgtctttggcggaaacgtgcaggatgccgttggcgtcgatgtcgaaggttacttcgatttgcggcataccgcgcggtgcaggtgcgatgtcgcccaagttgaactgacccaaagatttgttggcagaagcgcgttcgcgttcgccttgcagtacgtggatggttactgcgctttggttgtcttcggcggtagagaacacttgcgacgctttggtcgggatggtggtgttcttctgaatcagtttggtcatcacgccgcccatggtttcgatacccaaagacagaggagttacgtccagtagcaatacgtcgctgcggccgccgctcaatacttcgccttggatcgctgcgcctacggcaacggcttcgtcagggttcacgtctttgcgcggttctttgccgaagaaggctttaacggcttcttgtactttcggcatacgggactgcccgccgaccaagattacgtcgtcgatgtcgccggtgctcaagccggcatctttcaatgcaattttgcaaggttcgatagagcgggtaatcaggtcttcaaccaggctttcgaatttggcgcgggtaattttcatcgccaagtgtttcgggccggttgcgtccatggtgatgtacggcaggttaatttcggtttgctggccgctggacaattcgattttggctttttcggcagcttctttcaggcgttgtagagccatcacgtcttgtttcaaatcaatgccttgttcttttttgaactcggcgatgatgtggtcgatgaggcgttggtcgaagtcttcaccgcccaagaaggtatcgccgttggttgccaatacttcgaattgtttgtcgccgtcgaggttggcgatttcgatgatggaaatatcgaaagtaccgccgcccaagtcatatacggctactttgcggtctttgttgtcgcctttgtccataccgaatgccaaagcggctgcggtcggctcgttgatgatgcgtttcacgtccaaaccggcgatacggcctgcgtctttggtggcttgacgttggctgtcgttgaagtaggcagggacggtaatcacggcttcggttactttttcgcccaagtaagcttcggcggcttctttcattttacgcaggacttctgcggaaatttgaggaggagacagctctttgccttgtgcttttacccatgcgtcgccgttgttggctttgatgatttcgaaaggcatagattcgatgtcgcgttggacttctttgtcttcaaatttgtggccgatcaaacgtttggcggcgtaaatagtgtttttggcgttggttaccgcttggcgtttggcaggcgcaccgacgaggatttcgccgccgtccaaataagcgataacggacggcgtggtgcgtgcgccttctgcgttttcgatcactttggtttgaccgttttcggaaatggccaaacaagagttggttgtacctaagtcgataccgattacttttgccatgtggataatcctatttgattttgcttattttgagaaatatgttggaacattttgtcccgatgggctgtaaatagggcgggcggcgggctgtttcaagctacagcatggctataagtatataactttatgaatatattggttttatatttgatttaatacatttggctccaatgcattcaagcataatgtttcaaatggcaggcaggtttattcatagacgatgccggcgagcatttcctgttcgttcaagttgccgtactctttttcccagtcgtgtgaagactcgatgatgtcgcattctttggaaagggagacttgttctgcatccatatctttggcgttcagtatgttgaattgttcgcacagggatgcggataaagtgatgtcgggctgtttggcttcagaacggttttcttggaaggcaaagcagaatgcggtaaatgccgcagtatagataagatatttgccggttttcttcatttttctatcctttttctgtcaattcaggattaaacctatggaaaaatctgaaaaattatgtattaagtaagaaaaatcataatttaaatttagtttatcataattgttccgttttttggatagctaaggaaaatatatttcatgtttactttagatgattgaatgaaggggagtggaaggatatttatggaaacctttaaagacagactggtttttttatggaaaagcgaagcgaggcaggcaaaaatcgcatccgatattgaaatgacgattgcgggcttcagcaggatatggaatgaaggcggtctgccaaagtctgaaacattgaaaaaaatcaagcagttgaaggggtgtagtatcgattggctgctgaccggggagggtaatccgtttccggatgaagccccaaaaaaatcccttgcttacgatactttgggcaatgaagtcgatacggacgagtttgtcttcgtgccgagatatgatattcgggcggctgcgggatacgggcagtttgtcgatcatgaggaaccggtatttacaatggcgttcagacggcattggattgagaattatgttacccgcgatacgaaaaacctgtctgtaatttccgtcaagggggattcgatggagggggttttgaatgacggcgattcgattttggtcaatcatggtgaaaatacgccgagggacggtctgtatgtgttgcggattaatgaaaatctgctggttaaacgtttacagattgtaccgggcgggattatcaatgtgatttctgcaaacgaggcttatcctgcttttgaaatcaatttgaacgatttgaccgatgatgtggagattatcgggcgtgtcgagtggttcggcaggacgatttgagtttggggcttgaaattgcaggcggtcaaacttatctattggaacaattcctttttcaaaggcgaagcctgcttgcctttgaagggggtttgagagagaatgcagaaaatattatattaaggaataacaccatgtcggatgaaagccctattatttttactgacagctgctgtgccaaagttgccgatttgattgccgaagaaaacaatcccgatttgaaattgcgggtttttgtcaatggcggcggctgttcgggtttccagtacggatttacttttgacgaaatcaaaaacgacgacgattttgaaattgagaaaaacggtttggtctttttggtcgatccgatgagctatcaatatctggtcggtgcggaaatcgactatacggaaagtttgcagggttcgcaattcgtcatccgcaatccgaatgcggaaacaacctgcggttgcggatcgtcgttttccgtatgaccgcttggtttgtgtgatgccgtctgaacgttcagacggcatttttacttttagaaaatatattatcgggatgaattcacatataatccgattgtttgaagatgaatcgggtttcccgaaaggaacgggcggaacggtatcaggcgtatttgttcccttatgattgagatgagtaaagattaccgaaacgatttgtacgatgtatatgtttcttacccgccccaagtggatcgcgggcttatccgggagtgccttaaggagaatctcggcgaggaaaaggcggaaggattgatcgaatcgctcgattccaaacctcaagtgctggttgaggaaaaatgcacttgggcgaaacgggaagagttgcatgattatttcagctatttgggtttggatattattacccggagatatatggagttggaaacggtcgtgccgccggaggaaggggagggcgaaggagaaggcgcggatggggaaatgcccgaatatcttgaacttcacggcgggcgggaagatgatatttccgcaccttcgcaacccgaaccgccgtcccgcaatatcaaactgctggttttcgggctgctgattgcctttttgggctatctgctcggtaagattttttgattgtccgataaatgctgtattcgggattttatatatgaaatggttgaaacgcctgacggttattgtcgggactttttaccgctatcggctggcaggtctgtgtgcttcgctgatgggtagcggttggatatgcgctctgctgaaaatgatgccgcagtcgtccaaattgaaaaacgaaccgcctgctgtccgtctgcgccttgccttggaaagcctggggccgattttcatcaagttcgggcaggttttgtccacacgccccgatttgattccgcacgattacgccgtcgaactggcaaagctgcaagacaaagtgccgccttttgacgcgcggctttcgcgtgaacaaatcgaaaaatcgttgggtcagtccatcgaaaagctgtatgcggaatttgaaaccgagcccatcgccagcgcgtccatcgcccaagtacacaaagcccgcctgcattcgggcgaacaagtggcggttaaagttttgcgccccaaccttttgcccgtgatcgaacaggatttgtcgctgatgcgctttggtgcaggctgggtcgagcgtctgtttgccgacggcaagcgtctgaagccgcgcgaagtggtggcggagttcgacaaatatctgcacgacgagttggacttgatgcgcgaagccgccaatgccagccagctcggacgcaatttccaaaacagcgatatgctgattgtgccgaaggtgttttacgactactgcaccagcgacgtgctgaccatcgaatggatggacggcacgccggtttccgacatcgccaaactcaaagcagacggcatcgatttgcacaaactcgccgattacggcgtggaaatcttcttcacgcaagtcttccgcgacggctttttccacgcggatatgcaccccggcaatattttggttgccgccgacaaccgctacatcgccctcgatttcggcatcgtcggcacgctgaccgattacgacaaacgttatctcgccatcaacttcctcgccttcttcaaccgcgattaccggcgcgtcgccaccgcccacatcgaatcgggctgggtgcccgccgacacgcgcgcggaagagttggaagcggctgtccgcgccgtgtgcgaaccagtgttcaacaaaccgatttcgcagatttccttcggcttggtgctgatgcgcctgtttgaagtcagccgccgcttcaatgtcgaaatccagccgcagctggtattgctgcaaaaaacgctgctcaacatcgaaggcttgggacggcagcttgatcccgatttggacttgtggaaaaccgccaaaccgtttttggtgaaatggatgaacgggcaggtcggccctaaagccctttggcgcaacctcaaaaacgaagcccccgactgggcgcaaatcatcccttcattgccgcgcaaaatcagtgcgttgattgatgaaaaccgccagcaggaaatgcgtgatgcctatatccatttggtcaaagtgcagcagcggcaaagcctgtggctggctgtgattgcggttgttttgctgctgattttgcttttgaaataggctttgtccgaatcatcgcccgactccgcccgtttataaggaaatcggttatagtggattaacaaaaaccagtacggcgttgtctcgccttagctcaaagagaacgattctctaaggtgctgaagcaccaagtgaatcgattccgtactatccgtactgtctgcggcttcgtcgccttgtcctgatttttgttaatccactatatttccggttgcgtgggaatcgggtgtattgaataaaaggcattttgtccgactggcaagtgccgacatcggcggcatatcaaggcgcaggcttgaagcgggcaatgtcgtctgaagcccgtttggcgtttcagacggcattggtgcggatattcaaatcataaagtcgatttcggtaaactggatattttgatccatatccgccgacggtgttttgagcgatcgcgccacgggtttggcgggtacgccgacaaccgtgatggacggcggcacgtctgaaaccacgacgctgcccgccccgattttggcattgctgccgatgcggatattgcccaatatcgaggcgtttgcgccgatcatcacgccgtcgccgattttagggtggcggtcgccgccttctttgcccgaaccgccgagcgttacgccgtgcaaaatcgaaatattgttgcccaacacggcggtttcgccggcaacaaagccggtggcgtggtcgagcatcagcccgtatccgaaacgggcggcgggatggatgtccacgccgaatacttcggacatacggttttgcaggaaatacgccagcgttttgcgcccgtcgagatacagccgatggttgatgcggtgtgcctgaatcgcgtggaagcctttgaaatataaaagcggcagcgaatattcgtcgcaggcgggatcgcgttcgtagatggcttttaagtctgcttcgacgcatttgccgatttgggtgtcgctgcccaacgcctgctggtagatttcaaacagcgcgcgcacgtccataatcgggctgccgagtttgctggaaaggtggtaggcaaggacggagccgagggactcgtggcgcaacacggtttggtgcaaaaaacttgccagcatcggttcggcggagaccgcggccgcggtttcttcgcggatggtgtgccagaggtcgaaaccggttgtgtttaaatggtcttttttcatgagtgatgacgtttgaaaatcgatatggtcggcagtatcttaccgtctatattattttttcggtaggggatttgaaaatgaatttgaaattctctgmttttgmttgaagtttcttgaaaatgtccttatcttgcgcgggtaataactggattttgatttccaatttgttttaagggatacgatatgagcgaacagacacagcagcaaaacagtgaagaagcggttgaaaatgtggaggcggtggaaaccgtcgagacagtaggaaatgcggacggtgtgcaggaacaggctgccgcagagccggcttatgaggatttgcaggcgcggattgccgagctggaagcgcagttgaaagacgagcagctgcgcgctttggcaaacgagcaaaacctgcgccgccgccaccagcaggaaattgcggatacgcacaagttcgccggacagaagtttgccgtggaaatgctgccggtcaaggattatctggaaatggcgcttttggatcagagcggcaatttcgatgcgctgaaaatgggcgtgcagatgactttgaacgagttgcagaaagcatttgatgctacgcaaatcaaggaaatcaaccctaaagcgggcgataagctcgatccgaatatccatcaggcgatgcaggcggtggcaagcgaacaggagccgaataccgtggtgggtgtgatgaagaagggttatacgctgtccgaccgcgtgttgcgcccggctatggttacggtggcgcagaaggaagcctgaaggcgtctggggaataatctgatttatttcctgaagcgcgttttgcgtataaaccgatcgaagtaaagcggcaatgccgtctgaacccgcctgtcgggcttcagacggcattttatagtggattaacaaaaatcaggacaaggcgacgaagccgcagacagtacagatagtacggaaccgattcacttggtgcttcagtaccttagagaatcgttctctttgagctaaggcgaggcaacgctgtactggtttttgttaatccactatatttcggcgttaacggtcaacccgtatgccgcctgcctgtttttcttcatccagtttcttttgcagggtgtcgcaaggtgtgtcgcagtcgcacatttttttcatacccaaggcagtaatgccgccgcaactgcctttgatgctgcgtttggagaaaatatagccgaccgccataccgatgatgacggtcaggaagatgccgaaggtaaggagcagggttttcatggtgtttcctaatcggtttgtatgtttagcggagcagtttttcaaattcggaagacatggcggtgcggtagccgcctttatccctgacaatcaggaaaacagcgagtttttcgcgctctgccagctttaaggcttcggtttcgcccaatacgaataatcctgtggacaagccgtccgccgtcatcgcactgtctgcgaccacgctgatggaggcgaggttgtggctgatgggtcgtttgttgttcgggttgatgatatgggagaggcgtttgccgtttttatcgacgtggaaaatacggtaatcgccggaagtggcaagcgaacggttgttcagcgggacgataatctgcgtattgccgccttggacgatattgggctgctcgataccgatgcgccacggttcgccgcgcgcgtttttgcctttgccgtgcaactcgccgccgatttcgaccagataattttgaatgccgtatttttccagttcgcccgcaactttatcaacgccgaagcctttggcaatcgaagataaatccaaataggccttggggtgggttttgctcaaggaagcgtaatctttgccttgtttcaaaatgattttgtctatgcccgtataagatgccgcctgtttgatttgttccggcgacggttcacgggtaacggatttgtcggggccgaatccccaaaggttgaccaaggggccgacggttacgtccagcgcgccgtgtgtcaggcggttcaggcggacggcttcggcagtaacgtgtgcgaagtcgcttgaaatgcggaggggcttgccggctgtgtgttggttgaaccggctgatttcggagtcgggctgataggtggacatctgccggttgacttctttaagcgcgtcatcgatgcgtttttgtatttcggcaggtgaggggagtttgtcccgattatttgaaaggtatttgacggtataggtcgtgcccatcgtttcgccttgcagggtaacggtttgcgcggtttgttccgaacaggcgttcaggaagatgaaacccagggcaaatatcaagacgcggataaagttcggcaggcgtgtttcagacggcatagtgtttgacggttttggcaaatggtttgaattatatcgcaaaacggccggtatgtttctatgccgatgccgtctgaagggtgttcggatggcatcggcatagaaaaaggaagaaaccgaggtttcttccttttgtatttgaagccgaatatttaaccgccgaaatcgtccaagaggatgttttcgtcttccacgcccaagtctttgagcattttgatgacggactggttcataatcggagggccgcacatataaaattcgcagtcttccggtgcttcgtggtttttcaggtggttttcgtaaaccacgttgtgaatgaagcccgtgtagccgtcccagttgtcttccggcagcgggtcggacagggcgacgtgccacgtgaagttcgggaactctgccgcgagttggtcaaagtcttcgacatagaacatctcgcgtttggaacgtgcgccgtaccagaaggtaatcttacgtttggagttcaaacgtttcaactggtcgaaaatgtgggaacgcatcggagccatacccgcaccgccgccgataaataccatttcggcatcggtgtctttggcgaaaaattcgccgaacgggccggaaatcgtaactttgtcgccgggtttgagcgaccagatgtaggacgacatttgtcccggaggcgcatcaggtacgcgcgggggcggcgtggcgatacgcacgttcagcataatgatgcctttttcttcaggatacgaagccatagagtaggcacgcaaaatcggctcgtccactttggaaacgtattgccacaaattgtatttgtcccagtcttcgtgatattccttaggaatgtcgaagtctttgtaggcaacagtgtgaggaggagcttcaatttgaatgtagccgccggcgcggaaggggacttcttcgccttcgggaatggcaagcttgagttctttaatgaacgtggctttgttatcgttggagatgacggtgcattcccattttttcacgccgaacacttcttcggggacttcgatgtccatgtcggttttgacgttgacttggcacgacagacggcagccttcgcgtgcttcgcgtttgctgatgtgggacagctcggtcggcaggatgtcgccgccgccgctttttacgacgacgcggcattgtccgcacgaaccgcccccgccgcaggcggaggggataaagatgccttcgttggcaagcgcgcccaagagtttgccgccggcgggcatcgtcagctctttttcgccgttgactttgatggtgatgtcgccttcgctgaccagtttggatttggcaaacagaatcatcagtgccaaaaccaaaacgatgacggtaaacatcacgatacctaaaataatctccataccgatccctttcttataactggatgccagagaacgacataaacgccatcgccatcaggccggcggcgataaaggtaatgcccaagcctttgaggcctttgggagcgtccgaatatttcattttttcggtaatgcccgccaaagcgacaatcgccaacatccagcccaagcccgcgccgaagccgtatacaacggactcgccgaagttgtattcgcgttgcgccataaacgatacggcgccgaaaatcgcgcagttcacggtaatcagcggcaggtagatgcccaatgcgttatagagggcggggacgaatttatccaagaacatttccaaaatctgcaccaaagcggcaatcacgccgatgaaggtgatgaatttcaaaaaggtcaaatccacgccttcggcaatcgcgccgtctttgagcagcgagtaaacgagttggttgacagggacggacagcccgagtacgaaaattaccgccacacccaaaccgaatgcggtggatacttttttggataccgccaaaaacgtgcacatacccaaaaagaaggatagtgccatattttcaatgaagacggatttgatgaagaggctcaaatagtgttccatagcttattcctccgcctgttcgggtttccaggtacgcagtccccaaatcaaaaagccgatgatgaagaacgcgctgggggcgagcaggaacaagccgttggtctgataccagccgccgtcctgcacggtttggaaaacggtgtagcccaagagtttgcccgagccaatcagttcgcggacggtggcgacgacaagcagcattatcccgtagcccgcgccgttgccgatgccgtcgatcaggctttccagcggcggctctttcatcgcaaatgcttcggcgcggcccatcacgatacagttggtaataatcagaccgacgaatacggaaagctgtttggacaattcgtaggcaaatgcctgcaagagttggtcgaccagcgtaaccagcgacgcgataatcgccatttgcacgataatacggatgctgttggggatgtagttgcgtaccagcgaaatgaagaagctggaaaaaccggttaccaaagctacggaaatacccatcacgatggccgtctgaagtttggtggtaaccgccaaagccgaacaaatacccaaaacctgcaaggcaatcgggttgttgtcgataaagggtgaaaacatcaaatgtttcaagcgtttcatatcagccattattgcgctcctgctgatttcaatttgttcaggtaggggatatagccgttttcgccgaaccagtaggcgaacgaaccttgcacgcctttggatgtcagcgatgcgccggagagggcatctacgccgtgttctttgtccgaacccgcgcctttgccgacgtgcagggcgagtttgccttgtccgtcaaacagttttttgccgacgaatttttgctgccacaacggattgccgatttcgccgcccaagcccggggtttcgccttgttcgtagtaggtaatgccgttgatggtgttgccgtcgggctggatggcgacaaagccgtacatgaccgaccacaaaccgttaccgtgcataggcaggatgatttgcccgattttgccgtcttcgccttttaccaaataaacctcggtgtatttggcacggcttttgatgcctgccaaatcgtcttcggttttgatgcggatgctttgggcagggtctttgcctgcgatgcgcgcgctgaagtctttaggcgcatcggcgacgtattcgccggtcgccaaatcgacaacacgttgctcgatacgctcggcaaaggttttaccgatgtcggtgtccttatccatcaaaccggctacgctcaagatatagccttgtttgtcttggagtttttgtttctcttggatgggtttcaagccgacgaccgcaccggcaacgatgaccgagcaaatcaggctgaccgccaacacgacaatcagcgtgccgctgaagctgtctttatcgaatttcttagccattgctgcgcgcctttctgcgtttgatgttcgcttgtgcgacgaaatagtcgaaaatcggggcaaacaggttggcaaacagaatcgccaacatcatgccttcggggtaagccggattgaccacgcggattaatacgcacatcacaccgatcagtgcgccgtaccaccatttgccgacattggtaaaggaagcggaaacagggtcggtcgccataaacagcataccgatggcgaagccgccgaccaccaagtgccagtaccaaggcatagcaaacatagcgttggtgtccgaaccgatgaagttgaacagcgaagacatcgcaatcataccgatcatcacgccggcaataatgcgccaagaagcgatgcgggcaaacacgataaacgcgccgccgattaagagtgccaaagtggagacttcgccaatggagccgggcagtttgccgataaacgcgtccatccaagtgatggtttgaccggttacggcgtttttcaggccgtctgcaccgtgtgccgcccattgcgccagtgcggttgcgccggaatagccgtcaaccgccgtccaaaccgcatcgccgctcaagttggcagggtaggcgaagaacaggaaagcacggcctgccagcgcagggttcatgaagtttttacctgtaccgccgaatacttctttcgcaaccacaacgccgaaagaaatacccaaagccgcctgccacagcggcagcgtgggcggaacgattaaggcaaacagaatcgaagtaacgaagaaaccttcgttgatttcgtgtttgcgcacggtggcgaacaaaacttcccagaaaccgcccacaacaaatacagtcgcgtaaatcggcaggaagtaaatcgcgccaaacagcattttgtccgacacgcccgcttcagacgacatattgatgcccaaagcgttggcaaaggcgtaatgccagtcgttggcgatgttttgttgcagcaaatcaggcgttaacgcaccgaatgcctgcgcgccgacgttgtacataccgtagaacatggcagggaacaaagccagccacaccaaaatcatcatgcgcttggagtcgagcgcgtcgcggacgtgcgccgctttgcgcgttaccgcgccggatgtgtagaaaattgtcgccgcagcttcgtagagggcataccatttttcatgtttgccgcccggcaggaagtgcggttcgattttttccagaaaatgtttcaagcccataatcagccttccttctcaatggtttccagcactttgcgcaacagcgggccgtattcgtatttgcccgggcagacgaagctgcacaaagcgaggtcttcttcgtccaattccaagcaacccaatgcctgcgcgctgtcggtatcgccgacgattaaatcgcgcaaaagcagggtgggcaggatatccaagggcatcacgcgctcgtaagtaccaatcggcaccatggcgcggtcgccgccgttgacggctgtgttgaacttgaagagtttgtttttcaggaaatggccgagggttgtacgcgtgatggagtatttgtccggctgcggcgcaacccagccgaacagctctttgctgcggccttcttcgataacggaaatctgattgtggtagcgtcccaaataatcgtgcgcgccttgtgtaatcgcgccgttcaataccgaaccggaaatcacgcggttgtctgtgtcaaccaattcgcccgcagtaatttgcgatactttcgcacccaaaacggtacgcaagaggcgcggtttgttgacttgagaaccacctagggcaatcacgcgctcggtgttcagacggcctgttgcaaacaaacggccaatggtaattacatcttgataattgatggtccacacggttttattcgcgccgaccggctcgatgaaatgaatgtgcgtgccactcaaaccggcaggatgcgggccgccgaattcatgtgtttcgatgttggcagcattttcagacggcacgtctgcgccagctgccttacaaacatggattttgcgttcggtcaaacggctcaataccaacaggccgcgtttgaaatcctcggcggcttctttgataatgaccgtagggtcggcagccagcggattggtgtccatcgcattgacgaagatggcgaacggctcggcatcgacggcaggaattttgctgaacggacgggtgcgcagcgcagtccacaaaccggattggatcaggttgcggcgcacttcttcgccgcttaagtttgccagcgcttcaggtgcgtagcgttcaaactcgatttcgtcgttgccttcaacggcaatcacgactgactgaagtacgcgcttttcgccacggtgaatcgcggcgattttgcctgaagccggcgcagtaaacaccacgcccggattctttttgtcttcaaacagcacttggccttttttgacggcatcgccttccttgactttcatcgaggggcgcataccggcatattcttcgccaagcaacgcgacttcggtaatggccgggccgtcgtaaacggcttgctccggtctgcccgcgatgggcaggtttagaccttttttgattttaatcatatatttgcattacttgtgatggttaaggtaaaaacggcgtgttttgataccgtgtcgcgtggcatcaaaagcattgaataaattaatgtagcaaagtgttagattctatcaggaattgtacctgtttgtcagatttgctgcttttttccttgcggaagccgtttttatagtggattaaatttaaaccagtacggcgttgcctcgcccttgccgtactatttgtactgtctgcggcttcgtcgccttgtcctgatttttgttaatccactataaattgtcggaaggggggatattgatttgattatgccggaatttaaaatgccgtctgaatgttcagacggcatagcgtttacagcagtttgaaaacgaaaaagataagggtatgtacgatgaagacgggtgtcaggaaggcgaccgaccacatcatatagccgaagaaagtcggcatcggtacgccgcgctgttcggcaatggccttgaccatgaagttcggtgcgttgccgatgtaggtcagtgcgcccatgaataccgaacccatagaaaccgccagcagcgaatgaaacagggtacccgtcatcaaggcttgggcatcgccgcccgccatattgaaaaaaacgagataagtgggcgcgttatccaagaatgccgacaatatgccgctcatccaaaaatacatcacattaatcggatgacctgccgtatcgtgaaccagcgataccaccccgcccagcgcgcctgcctcgcctgctttcagaatgctcaggacgggaaagatggtgatgaagatgccgaggaagagtttgcccacttcggcgatgggttcaaagttgaattcgttgcctgcgcggacttgtttgggcgtgattgccatagatacggcggtcaatgcaatcaggatgacatcgcggacgaggttttgcagggcgtaacggctgccgaggatttcaaatcccgggtgttcgggtttccaaaggccggacattagaaccgcgccgaccacgcccgaaagcaggaggaagttccatttgccgaagatggcgattttttcgggtttttcctgttgtgccggcgtatcttgtgcaatgctttcctgtttgaagaaacggttgtcgatgaaatagaaggcggtcaacaggacagcggtgctgatcaggacgggggcgaacatatgtttgaccgtccacatgaaatctacgcctttgaggaagccgaggaagagtggggggtcgcccaaaggggtcagaccgccgccgatgtttgcaaccaggaaaatgaagaagatgacgatgtgcacgcggcgggtacggttttggttggctttcagcagcggacgaatcatcagcattgctgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaagggatgtattcttcaacgagtgcgtgtgcgacggtatggataccggcggacgcgccaaaaaccaaactgaacgggatgaggaagagcaatgtccaaaaggcggtaattttgccgtaatggtgatgccaggtatgcgaaaaaaacaagggacccaatgcgatagacagcaaaatcagggcaaagggcaggccccacagcaggtttaggtttgcgccgtccaaatctgcggcgtaaaccgatgctgggaaaagcattagtgaaaacaggggtaggtggcgcatcgtgtttcctcgattcaagcactgccttgcgcggcgcgtgggagtgatacaggcaccgtgccgcccggacataggcggactgtgctgcctgtttgtttttgaaaaaagttttccgattgattgtaaagtaaataatcaggataaaccagtttcccaaaccggaaggcggcgggaaggcggattgctgtgcttgggaatatatgttctttttgataaataattttatttaaaacaaataaatatatgtctttaataaataatctatcgaaaacgaaaaatgaatttattttaacatatatttgcaatgaaacaggtttgcccccccccgtttgtttgcccttatccctttcagtacggcattcaagattcgggcctgcgccacatccatatggcgacaagggaacaaaaaaccgatgaaaccgccccgacccaccagcgttggggaaactgccaaaacattatcaggcaggatgcggtcatcatactgatggcgaatattttggctttgcgcggcactgcgccgttttgttcccagttatgaaccatcgggccgaaatagcggtgccggtgcagccagcggtaaaagcgcggggatgcctttgcccagcaggcggcggagagcagtacgaacggcgtggtcggcaacagcggcaaaaaaatgccgatgatacccaacagtagggaaatgcagccgcaggcaattaaaagataacgtatcattttgaaatatttttcttattgtgcggataagggcaggatgtgataccgagttttgcccagccttcatgtcccattttttccagcagggcgatattgcgttcgaatattgccgaagcgtcgggaaaggcttgtgcggctttggcaatgctgtcttcgcggatgaggtgcagcgtcggatagggagaacggttggtgtagttgccaatgtcgtctgaatccgtgccttcaaattggaaatcgggatgaaacggggcgatttggacgatgccttctaagccgttttcgacaacggcggcatcggcaatgtcgagcatatcgttgaatacgtcgaaatcggggaatagggtcgggtgaaccagcagggtggtttccagttcggtggcgggtgtattgcccagtcgctgcagttcttcgtccaagtcttccaaaaaaccgtcaaggtgtttggcttcgctgatcgcgatgcggacaaggtttttaacgtggggggctttggcaaagggacacaggttcagaccgatgacggctttttccaaccattgtccggtgtgttcggcaacagcatctttattttcggaagtattgatattcattattgtcatgtaaatgtgtttgcagattgcacgtgcgggaaaatcgggaagggcactattccttcagcaggtggttgagcggcagggaggtggtgtgtttgatttcttttaaaacaaagctcgattgcgcatcttgtacgccgtggtgggacaggagcgtatccaaaacaaaatgggaaaacgcgttcatatcggtaaaaaacgcctgaagcaggtagtcggtttcccctgtcagggcgaagcagctcaagacttcaggccattttcgaaccgatgcggcaaagtcttcccgcgcgtcttttgctttgcggatggaaacgcggataaatgcctgaagtcccaagttgacagattccggagacagcagcgcggcatattggcggacgataccggcatcttccaactgcttcagacggcgcaggcacggagaaggcgaaagtgcgacacgttcggacagttcgacattggtcagcctgccgttttcctggagaacctgtaagattttaatatcggttttgtctaaagtgagttggggcatatttgcgttccgttttaaggaattcggattgtctgtccgtatgtttgcggcaatccgcacagatggagaccatattaacatataaaaagttataccgtcatccgggacaaattttgttttcggaaaatcatgtgaaaacagaggcggtcggtttgcatctctttaagacggcttgcccaaaccgccgattcaagacataatcgggaaatgtgcaggagagtgttacacccaactacaatgtaaccaccgaaggcgcagacacccttaaatcgctcaggtatcagggactgcacattgaaacaaacaatctggagagcggcgttggaataacgtccaccgaaggggagaaggccgtctgaaccaccattcagacaaccgcgcaaagcagtgagcagactggtttgccatcatgcggatacagccgaaaatctcaggttcaaggacagatagggtcatccgcgcacaggtgcgcgggcggcatctgaacaaaaaatccggagaaacttgagaatgactgctctgaaaaccaccccatttcatcaagcccatcaagatgcaggcgcgaagctggtcgattttgccggctgggagctgcccatccattatggttcacaaatcgccgaacacgaagccgtgcgcaccgacgccggtatgtttgacgtatcccatatgctcgttaccgacgtagcaggcgcaaatgccaaagcctttttccgcaaattgattgccaacgatgtcgccaagctcgcttttgtcggcaaagccctttattccgctttgctcaacgacaacggcggtgtgattgacgacttaatcgtttaccgcaccaatgaagccgaaacccaataccgcatcgtgtccaacggcgcgacccgcgaaaaagacacggcgcaattccacaaagtcggacaagagttcggcgtcgccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaacaagccggcgtacagccctgcggcctcggcgcgcgcgacaccctgcgcatggaagccggcatgaacctctacggcaacgatatggacgacgacaccagcccgctcgaagcaggtatgggttggaccgttgacttgaaagacgaaagccgcgacttcgtcggcaaagccgccttgctggcattgaaagaaaaaggcgttgccgtcaaacaggtcggcctgttgctcgaaaaaggcggcatcctgcgcgcgcatatggaagtgttgaccgacaaaggccaaggcgaaaccaccagcggcgtattctccccaagcctgaaacaatccatcgccatcgcgcgcgtaccgaaagattttgacggcgataccgccaaagtgctgatgcgtggcaaagaagtggacgtgcgtgtactgaagctgccgtttgtccgcaacggacagaaacagtttgattgatgcggtttcagacggcattttcatttcatatgccgtctgaaagcaggttttaattgttgtccgatacggacgtttgtagaaagcattgaacaaggcatctgtggatattgattcatgcagatgccgtctgaaaataacccctatcaatggagtatcaaaccatgagcaacaacatcccggccgaactgaaatacgttgccagccatgaatggctgcgccttgaagaagacggtacgattaccgtcggcattacccaccacgcgcaagagctgttgggcgacatcgtgttcgtcgagctgcccgaagtcggcgcgaaccttgccgctgaagagcaagccggtgtggttgagtctgtaaaagccgcgtccgacgtgtacgcaccgattgcaggcgaagtcgttgccgtcaacgaagatttgccaagcgctccggaaactgccaacagcgatccttacggtgcaggctggttcttcaaactcaaaccggcaaacgttgccgattacgacagtctgctgactgccgaacaatacgcgggcgaagtggattaaaccgcccggctgcccgacggcaaccgccggacaaacggaaactgcaccttcagacggcatttttgcggtcggaggtgcagttttttgtccgtgttttaaggaagcagttaggctataataacggtctatattcatctttaccgattttttcatgcaacttaccgctgtcggactcaatcatcaaaccgcacctttaagcatacgggaaaagctggcgtttgccgccgccgccctgcctaaagccgtccgcaatcttgcccgaagcaatgcggcaacggaggcggtaatcctttctacctgcaaccgcaccgagctttactgcgtcggtgattcggaagaaatcatccgatggcttgccgattaccacagtttgccgattgaagaaatccgtccgtatctgtacgcgctggatatgcaggagactgtgcgccatgctttccgcgtcgcctgcgggctggattcgatggtgttgggcgagccgcagattttaggacagattaaggatgccgttagggttgctcaagagcaggaaagtatgggtaagaaactcaatgccctgttccaaaaaaccttttccgttgctaaagaggtccgtaccgatactgccgtcggcgaaaactcggtttccatggcttccgcttccgtcaaattggcggaacagatttttcccgacatcggcgatttgaatgtcttgtttatcggcgcaggcgaaatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattctgcacgattacgacgtagtggtttcttcaacggcaagccagttgcccattgtcggcaaaggcatggtggagcgtgcattgaaacaaaggcagagtatgccgttgttcatgcttgatttggcagtgccgcgtgacattgaagcggaagtcggcgatttgaatgatgcctatctttatacggtggacgatatggtcaatatcgtccaaagcggcaaggaggcaaggcagaaggccgccgccgccgccgaaacgctggtgtccgagaaagttgccgaatttgtcaggcagcagcagggcaggcagagtgtccccttgattaaggcgttgcgggacgagggcgagaaagcgcgcaaacaggtgttggaaaatgccatgaaacagcttgccaaaggcgcaacggcagaagaggttttggaacggctgtccgtccaactgaccaacaagctgctgcattcgccgacccaaaccttgaataaggcgggggaagaagataaagatttggttcatgccgtcgcgcagatttatcatttggacaaataacggtgcgccgggaaaaatgccgtctgaagaggtttcagacggcatttttttgtgccgcctgacaacatcgtgaaatcccacattatatcgatgtaatcacaaagtatagtggattaacaaaaatcaggacaaggcgacgaagccgcagacagtacagatagtacggcaaggcgaggcaacgctgtactggtttaaatttaatccactatattatcccgtatgcggattggttttaagatttgtaaatttgatttgcatcaaaaaatcgccgatagatgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcatttgcccgcgcccgggcgggcgatacgctcaaactggcttccggcgtatataaaaccaaacttcacattgacaaaccgattacgattgaagggcctgccgaccgttccgcaaccatcgaaggcgacaggagcgggcgtaccatagccgtacacgcgccggacgtaacgctccgcaacctgaccgttacccgttccggtatgagcctgcccgcaatggatgccggtatttatctcgaagaaactgccccgcgcgccctgattgaacacaacaatattttggataattcggtcggcgtatatctgcatggttctgccgatgcgatggtgcgcgagaataaaatcgtcggcgacgcgactttgcgcgtgaacgagcgcggcaacggcgttaccgtttggaacgcacccggtgcgcaggtcgtcggcaacgacatttccaaagggcgggacggcattttttccaataccagcacgcacaacacctacaaaaacaaccgcttcagcgatttgcgtttcgccgtccactatatgtacaccaacgacagcgaaatcagcggcaatatttccgtgggcaacaatatgggctatgtgctgatgttttccgagcggctcaaagtattcgacaatatcgccgtcggcagccgcgatcagggcattatgctcaactatgtcaactattccgatattcacgacaacattatcaacaaggcaggcaagtgcgtatttgcctataatgccaactacgataaacttttcgccaatcattttgaaaactgtcaaatcggcatacactttaccgccgccatcgaaggcacgtccttgcatgacaattcctttatcaacaacgaaagccaggtcaaatacgtcagcacgcgctttctcgattggagcgagggcggacacggcaactattggagcgacaacagcgcgttcgatttgaacggcgacggcttcggagacagcgcgtaccgccccaacggcatcatcgaccaaatcatctggcgcgcgcccgtatcgcgccttttgatgaacagtcccgcaatcagcatcgtcaaatgggcgcaggcgcagtttcccgccgttctgcctggcggcgtggtggacagcaaaccgctgatgaagccttatgcccccaaaattcaaacccgttatcaggcgatgaaggacgagctactcaaagaagtcgaaacgcggcagtcggaatggggcagggcggaaaacggttctttgaactagtctgcttcagacggcatccggattcaaatgccgtctgaaaacacaaaaggaacaaccatgaccacacatcatgtcgaattgaggaaggtaaccaaacggttcggggcgcaaaaagccgtcaaccaagtcgatttggttttgaaggcaggagaaagcgtcgggcttgccggacacaacggcgcgggcaagtccaccattatgaagctgatactcgggctgattaccccgaccgaaggcgaagtgatgcttttgggcgaacgtaccggtagcaaagcgggggcgcggcttcgcagccaaatcggctacctgcccgaaaccgttgcgctgcacccttcgctgatcggcatcgaaacgctggatttttatgccaaacttaaaaaacagccgctcacgcagaaccgggggctgcttgagcgcgtcggcatttcacaggcggcacaccgccgcgtcggcacttattctaaagggatgcgccaacgccttgccttggcacaagccctgctgggcgagcccaaagtcctgctgtttgacgaaccgacaaccggtcttgaccctgcatcacgacaaatgttttacgaagtcgtgcgcgaactcaacgggcgcggcgcgaccgtattgctcagcacccacgcccttgccgagttggacgggcacgccgaccgcattatcgtggattaaatttaatccactatatgcgggtatggcgggtttgagcggacaaatcagcctgaccgtccccgttttgctgaccgctcaggttttatgggttatcattccgcttgttttggcagccggaatttttagaaagcgacaaatatgaaaaaaaccctgttggcaattgttgccgtttccgccttaagtgcctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataatattgaaaaaaccggccgaaactttaaaaacgagtttcggtcggtttttcttttcttgttcggtatagtgtcggcaggaaagaaccttcacatcccgccgtaattcggcccgctcgcgccttcggggcaaatccaagtgatgttttgcgtcgggtctttgatgtcgcaggttttgcagtgcacgcagtttgccgcgttgatttgcaggcgcggattgccgttttcttcaacaatttcgtacacgccggccggacaatagcgcgtttcgggcgaggcgtattctttgtagttcacgtctatcatcgtttgcggattgttcagcaccaaatggtcgggctggttttcttcgtgcgcgagattggcaaggaagacgctgctcaagcggtcgaaggtcaacacgccgtcgggtttcggataatcaatcggcttacacgcggcggcttttttaagctgctcgttgtctttgccgtgatgtttcaaggtccacggggctttgcctctgaaaatcatctgatcgatgccggtgtagattgagccgaggtaaacgccccatttgaatgacggacggacattgcgcgcggcgtaaagctcttgatacagccagctttgttcaaaacgttgctgataatccgccgcctctttgccgctgtcgaaaccctccacttcttcaaggttttccaacaaggggaacacggcttcggcggcgagcatggcggatttcatcgcggtatgaatgcctttgatgcgcggcatattgaggaaacccgccgcatcgccgaccaaaatgccgcctttgaacgagagcttcggcaaactttgcaaaccgccttcaatcagcgaacgcgcgccgtaagcaatgcggcggccgccttcaaaggttttgcggatttcgggatgggttttgaaacgttggaactcttcaaacggcgacagataaggattttgatagtccaaaccgaccacgaagccgacggcgactttgttgtcgtcgaaatggtaaacaaacgcgccgccgtaggttttgctgtccagcggccagcctgcgctgtgcaccaccaaaccgggctgatgctgttcggacggcacttcccaaacttctttaatgcccaagccgtaagtttgcggctggctgttttggtcgagttggaaacgttcgatgatttgtttggaaagcgaaccgcgacaaccttcggcaaacagggtttgctgcgcccaaagctccatgccgggttggaatgaatcggtcggctcgccgtctttgccaatgcccatattgccggttgcaatgcctttgaccgaaccgtcttcgtgatacagcacttcggcggcggcaaagcccggatagatttccacgcccatattttccgcctgctccgccaaccagcgcacgacttcgcccaagctgacgatgtagttgccgtgattgtcgaaattcggggtaatcggcaggttgaacgcttttttctcggtcaggaacaacactttgtcctgcgttactgtgcgtgtcagcggtgcgcctttttctttccagtcggaaatcaactcattcagcgcaatcggatcgataactgcgccagccagcgaatgcgcccccacctccgaacctttctccaccacgcaaacgctgatttcgcgcccgttttgttcggcaagctgcttgagtttgatggcggcagacaaacccgacgggcctgcgccgacaatcacgacatcgtattgcatactgtcgcgggtgatggattctgtcatggcggttcctgtgtatttattattgaattgcaaatccgtaattatacaacgggaacatatagttaccaaatacaacaaaggtcgtctgaaaaccatattttcggttttcagacgacctttgtcgaaatttcaataagcacgccaccattttacctgtccgaccgcaaactccgtctgacgtttcggactgcgtgtgaaaaacgccttatccccgccggcatccctccctttcggcacaaccgccaaaatcttacctgccaaatttccctcacgggtttgccaagcatccaaaaactgcgccctgctcattgaaacatgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcttcaaaacccaaatcaggcataatgcgccgcatatcctcaaacgacgcgggcatctgctccttatccagtttttttaacacgtcctcttccgtcagcttttgcccgtaaaaattgttcaaaagcgtcaccaccgaagccgccccgcaggaaaaatccaaatcctgctttacaatattgaaatcgcgcctttctttccaactctgcactttgatttttccataagcaacaggattatagtggattaaatttaaaccagtacggcgttgcctcgccttgccgtactatctgtactgtctgcggcttcgtcgccttgtcctgatttttgttaatccactataggtttccgtgcggacgtgttcagattcccgccttcgctggaatgacggcggagcgatttctacttttccgataaatgaccgtaacttaaaatcccgtcatccccacgaaagcaaaaatcccgcctgtcggatttcggtttttttgggcgtttcgggaaacttataaatcgtcattcccgcgcaggcgggaatccggtttgctcggtttcggtttttcgggcgtttcgggaaactgatgaatcgtcattcccgcgcaggcgggaatctagaacgcgggacggcggcaatattcaaaggttgtctgaaaattcagaggttctagattcccactttcgtggggatgacgggatataggtttccctacggacgtgttcagattcccgctttcgcgggaatgacggcggagcgatttctacttttccgataaatgaccgtaacttaaaatcccgtcatccccacgaaagcaaaaatcctgcctgtcggatttcggtttttttcgggcgtttcgggaaactgatgaatcgtcattcccgcgcaggcgggaatctagaacgcgggacggcggcaatattcaaaggttgtctgaaaattcagaggttctagattcccactttcgtgggaatgacgggatataggtttccctacggacgtgttcagattcccgctttcgcgggaatgacggcggagcgatttctgcttttccgataaatgaccgcaacctaaaccccatccttcccgcaaaaacagaaaaacaaaaacctaaaatcccgtcatccccacgataacagttgcgtaattgcgtagagtgggcttcagcccaccgttttttctttttcggtcgttgattggtgggctgaagcccacccttgtatatcggaactcccgtatcatagcaacaaaccgcccggccgccacccgcgcccacccaaggcacacaaccgttgcgtagcacagggagcggcagggcaacccatcgacacaaccggacagttgccggacaacacaaccgaatgtaaggcaggttgatgatgagtacccgataccattacgcaggtatagtgaattaaatctaaggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaagttctcaatgccgttaatgtggttctgacggtctgcacactccttggaatggttgatgcggtaatggataaaaccgctcacgtccaacttgtcgtagctgctcagactatcggtataaacaatactatccggcatgattttctttttgatgacagggagtaacgtttcagacttggcattatccaccacaacggtatagacccgtccgttgcgtttcagaatgccgaaaacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtgctgccgaattgggatggatacccaaaatatcggcggcagaacgggcggtaacttccagtacaaaaaacggagcagttctttctgtacttttttctttaatttgcagtgcgttatcttcatatttcgagggtaacatatctgctaatctagtacagccccaaaaatataccaaaaacagcaaaacaaattgtaaggatacgtataggctttgtaaaggtaaattgtgaaaaaagcagttttttaaacgaatgaaacggcttcgggctgaaatatatgctgatgccctgttcttcccgtatttctcgtgtgttgtcaaagtgcaggctgctttgaaatcggtattgccatctatgaaccaccactttgctttatttcagcgggcttgagatgtgtataagaatattgttttgaataaatttaaagaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggttcttgagccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcattgcaacatttcagccaatatgtagatctaattaatgaaaataatggtagattacctaacactagtgaaattgagagaagttactataaagccgttaccgaaaatggtgtttcttctagtgcagctattgatttagttattaatcgctcacttccggatatggcagatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgataatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaatttagagatctgttcccaaatccggaaggctggatcgatgatggtcaccaatgtttcgctccttgggttaaagaaactaaaaaacgcaatggcaaatatcatgtctacgacccccttgccctagatttggacggagacggcatagaaactgtcgctgccaaaggcttttcaggcagcttatttgatcacaccaacaacggtatccgcaccgccaccggttgggtttctgccgatgacggtctgcttgtgcgcgatttgaacggcaacggcatcatcgacaacggtgcggaactcttcggcgacaataccaaactggcagacggttcttttgccaaacacggctacgcggctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagttactg

SEQ ID NO: 43 - DNA, 7800 bp, Neisseria meningitidis
cctcgtaaaagttccatgctttttcatggaaatagaaaacgacggtgttgattaggggttcgaccagcgcaactgctcccgatacgcctatactgcccgtcagtacataggttacactgaaggcgacgctgaaatgcagtgcggcaaaagtcagggttttaagcatcatcctctcccggattggacattgacggagagatgataaagattatcataaggctgcgcggtttaaatttgctatttgttgttagtgtagataaatcgttttttaaataaggataggaattatgaatcataaaaagatcgttgttttggatgcggatactttgcccggccgggtttttcattttgattttccgcacgagcttgcggtttacggtacgacaggtgcggatgaaacggcagaacgggtgcgcgatgcacatattgtcattactaacaaagtgatgatttctgccgatattattgcggctaatccgcagttggagctgattgccgtcagtgcgaccggcgtgaacaatgtcgatattggggcggcgaaggcggccggtgttgcggtatgcaatgtccgcgcatacggaaacgaatcggttgcggaacacgcctttatgctgatgattgcgttaatgcggaatttgcctgcctatcagcgtgatgttgcggcaggattgtgggaaaagtcgccgtttttctgccattacggcgcgccgattcgggatttgaacggcaaaacgctggcggttttcggacgcggcaatatcggacggacgcttgccggatacgcgcaggcattcggtatgggggtggtgtttgccgaacacaaacacgcgtccgctgtgcgtgaaggctatgtttcctttgaagatgcggtacgggctgctgatgtgttgtcgctgcactgtccgctaaacgcccaaactgaaaatatgataggcgaaaacgaattgcggcagatgaagcctggcgcggttttaatcaattgtgggcgcggcgggctggtggatgaaaacgcgctgcttgccgcactcaaatacgggcagatcggtggggcaggtgtcgatgttttgacgaatgagccgcccaaaaacggcaatcccttgctgaatgcacgattacccaatctgattgttacgccgcataccgcgtgggcaagtcgtgaggctttggacaggctgtttgatatattgttggcgaacattcacgcctttgtgaaaggagaggcgcaaaaccgcgtggtttgaacctgtcgggattgcggaaaaaaatgccgtctgaacgcctcaagggttcagacggcatttcttgagattcccgtttaaccgactttgtcgcccggctgcgcgcctgtatccacatccaagagcttcagtttcccgtctgccgtggcggcactcaaaatcatgccttcagatacaccgaattttgccattttgcgcggggcgaagttggcgacggcgatgaccatgcggccgttcaattcggcagggttcgggtaagacgcggcgatgccggagaagatgatgcgtttttcaaaaccgaaatcgaggtcgaatttcaaaagtttggtgctgccttcgacagcttcgcagttcaatactttggcaacgcgcatgtcgattttcataaagtcgtcgaaactcgcctgttcggcgactttttcgtatttgccctcttcggcggcaggtgcggctgcggcggcgatgctttgtttgttggcttcgattaaatcgtccacttgtttttgctccactcgttgcattaaatgttcgtatttgttgatggcgtgtttgcccaaggtatcgcgtgtatttgcccaagtgatggcttccaaattcaggaatttggcggcgtttgcggcggtttgcggcaagacgggggcgaggtaggcggtcaacatggtgaaggcgttgatgagttcgctgcatacttcgtgcaggcgttcgtcttggccttcttgtttggcgagttcccacggcttgttggcatcaacgtattcgttgacaatgtctgccaaggccatgatgtcgcgcagggctttggcgtattcgcggctttcgtagcattcggcaatggcttcgctttgcgcagtcagttttgccagcaattcgctgtcggcaacatctttcagacggccttcaaagcgtttggcgatgaaacctgaggcgcgggcggcgatgttgacgtatttgccgacgaggtcgctgtttacgcggctgataaagtcttgcaggttcaaatcgatgtcttcgattttgctgttgagtttggcggcgatgtagtagcgcatccactcggggttcaggccttgttccagataggatttggcggtaataaacgtgccgcgcgatttggacattttttgtccgtcgacggtcaaaaagccgtgtgcgtacacgccggtcggggcgcggtggccggagaaatgcagcatagcgggccagaacagggcgtggaaatagagaatatctttgccgatgaagtggtacatctcggtttggctgtcggctttgaagtattcgtcaaaatcgacgccgatgcggtcgcacaggtttttaaacgacgccatgtagccgacgggcgcgtccagccagacgtagaagtatttgcccggcgcgtcggggatttcaaaaccgaaatacggcgcgtcgcgggaaatatcccagtcggacagggtggtttcttcaccttcgcccagccattctttcattttgttgagggcttcggcttgcagatggggcttgccgtcgtgcgggttgttgccggaagtccatgctttgaggaagtcggcgcattcgcccagtttgaagaagaagtgttcggattcgcgcaattcgggtttcgtaccggaaacggcggaatacgggttaatcagttcggtcggggaataggtcgtgccgcagacttcgcagttgtcgccgtattggtcttgggcgtggcatttcgggcattcgcctttgacgaagcggtcgggcaggaacatttgtttttcggggtcgaaaagctgctcgatgacgcggctctcaatcttgccgttggctttcagcgcgcggtaaatgtcttgggaaaactgtttgttttcaggggaatgggtgctgtaataattgtcgtaaccgatgaaaaagccagtaaagtcggcgaggtgctcttcgcgcactttggcaatcatgtcttcgggcgcgataccttgtttttgcgcggcaagcattacgggcgtgccgtgggtgtcgtcggcgcagcagtagtggcacgcgtggccgcgcagtttttgaaagcgcacccaaacgtcggtttggatgtgttcgaccatgtggccgaggtggatgctgccgttggcatagggcagggcggaggtaactaagattttgcgtgtcatattgtgctttgcaaacaatgggtaaaggcggattataccgcaaatcaaacggggaaatgccgtctgaagcctgaaaaatcgggcttcagacggcatttttgccaaccggcgggagttattcgacggttacggatttcgccaggttgcgcggcttgtccacatcggtaccgcgtgcgagggcggtgtggtaggcgaggagctgcacggggatagtatgcacgacgggggacagtttgccgacgtggcgcggtgcgcggataacgtgcacaccttcggtggcattaaaattgctgtcgaggtcggcaaagacgaaaagttcgccgccgcgcgcgccgacttcctgcatattggctttgactttgtccaacaggctgtcgttgggtgcgatgacgacgacgggcatattttcgtccaccagggcaagcggcccgtgcttcagttcgccggcaggataggcttcggcgtggatgtaggtgatttccttcagcttcaacgcaccttcgagggcaatcgggtaatggatgccgcgccctaaaaacagcgcgctggttttcttggcaaactgttgcgcccatgcggcaatttgaggttcgaggttcagagcgtgctgcacgctgccgggaagctggcggagttcttcggtgtaacgcgcttcgtcttcttcggaaaccaaaccgcgcactttcgccagcgttaccgccaaaccgaacagcgcaaccagttgcgtggtaaacgctttggtcgaggcgacgccgatttccgcaccggcacgggtataaagcacgaggctgctttcgcgcggcagggcggattccatcacgttgcaaatggagaggctgtggcggtgtcccaaggatttggcgtatttcaacgcctccatcgtgtccagcgtttcgccggattgggaaatggtaatgaccagttggtcggaatcagcaatcacgctgcggtatcggtattcgctggcgatttcgacgtcggacgggatttttgcgatggattccaaccaatatttggcggtcagcgcggcgtaataggacgtgccgcaggcaaggattttgacgctgcggatgctttcaaacacgcttttggcatctttgccgaagttttcggggatgaagccgccgtcgaggaaaacctccgccgtgtctgcaatcgcgcggggctgctcgtggatttctttttgcataaagtggctgtacagtcccagttccaaagaggcgagcgagagttcggataccttgactttgcgttcggcaggcaggccgtttttatcggtcagccttttgatgccgtctgaagccagcagcgcgatgtcgccgtcttcgaggtacgccacgcggcgcgtaaaggcgatgacggcggatacgtccgaagcgataaaggtttcatcgtcgcccaaagcgaccaaaagcgggcagcccatacgcgccacaactaattcatcaggcttgtcttgggcaataaccgcgatggcgtatgcgccgtggaaacgtttgaccgcttcttgtaccgcttcaaacagcctgccgccgttttgcgcgtattcgtgattgatgctgtgtgcgatgacttcggtatccgtttgcgattcaaaacggtatcccaaaccttccaaacgtttgcgttcgctttcaaagttttcgatgatgccgttgtgtacgaccgcaatcataccgccgctgatgtgcgggtgggcgttcggctcagtaacgccgccgtgtgtcgcccaacgcgtatgtccgatgccgatgccgccgctgatgcctttttcgcgtgccgcgtcctccataagctgcacgcgtccgacgcggcgcacacgtttgattttgccgtcggtgttgacggcaatgcctgatgagtcataaccccggtattcgaggcgtttgagaccgtcggtcagaaaatcgacgacgttgtgatgggcgcggatggcgccgacgataccgcacataactgttccttagtatccggttgaaaaaaaacaggcgcggacggcttccgtgccgcaccttcctcttcggattataaaccgcctcccgcgccggaaaacagcaaaatgccgtctgaaggcttgggcttgctcaaaaaaaggagggatttccctgtttatccaggatgggcgttcagacggcattacctgctgctggtttatagtttttgcaaatcaacattgacaagctgaaaaaaaaaaacaatatactcgctcggtcttaatgttaacggagtatggaaatgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttagtaggggacaaccgggaggatgccgccgtccgaatcggatgtgcggtttctgtaccggtacgggcgggcaggaatgtccgccttttttgttcggatgcgtttgaatacccgtttgattccgaccgtttgcaaggggtatttccgttcgggcggaaattatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttaaatttgatccactataattccgtcaaataagaaaggaattttgtgcctgcggtatcgcaaaacttcgccttaatgcgcccgattgcctagggatgggcttcagatggcattgttttccggtttacgggcggtattcgggcttcataccgttgggtaggagctgccagacatatcccgtggttttctgtttgccggcaagttcgccggcttcgtcgccgtatccccaaaaataatccacgcgcaccgcgcctttaatcgcgctgccggtatcctgcgccataatcaggcggttgagggctttgcgggtaaccggatgggcggtggcgacaaataagggcgcacccaaggtaatgtagtgccggtcgactgcgccggcatattcccccatcagcggcgtgcccagtgcgccgacagggccgtcattgctgcttccggcaagctcgcggaaaaagatatagctggggttttgacccaaaacttcggcgaggcgttgcggattttgccgcatataagacttaatgccctgcatggaggtttgtccgagtttgaggtagcccttatccgccatatagcgtccgatggaaacgtagggatgttcgtttttgtcggcatagccgatgcggatgtatttgccggacggggttttcagacggcccgagccttggatgtgcataaaaaaaagttcgacagggtcttcggcgtaaccgagtatcggggctttgccgtcaagcgcgccgccgttgatttggttgcgcgtgtggtaggggaggaagcggcttccttcaaacctgcctttgattgctgttgtgcgcgcggtgatggggaatcgggagaggtcggcggtatgtgtgccgccggtattgtcgattgtgccgctgttttttcccgtctgcctgatgcggacaagggcttttccgctccgcaaaccggcaggcagggggacggagataaaatcgtcgggaataccgtaaatcgggaagcgggcttgtgccgtccgcctgtcgtcgcccttcagcaccggttcgtaatagccggtaaccgtaccggcaaggcttccgttgcctgcaacctgccacggcgtgaaatagcgttcaaaaaactgttttgcctgaaaggaatggacgggggtttgaaaggcttgggcgcacacatcctgccagccttggcggtttttcaaattggcgcagccgaggcggaaggattgcaggcttttggcgaaatcctgcgccgcccagtggggcagggacaggtgcggtacaacggtatagacggccccgccgccgccgaccgtcgttccggcggggtcggggatgccgaccggccggtccgggccgttgatgacggatgtgtcgggttgcggaaaggtttggatgc

SEQ ID NO: 44 - DNA, 29069 bp, Neisseria meningitidis
  misc_feature (28994)..(28994): N is any nucleotide
ccgggttaagaaattgtacaagcggacaaaatatttaatgggtatcaaagaatgacctaccgtgaattagttgaacgtcagttggctgtgcgccatgccgatttggaattgggcttaagccgcgcacgcgagcaagagccgtttgtcattcatgtttccgatctgttggataaggcaggcattgagtacgcggtacgcatggataaggattttcagacgacgtttcaccttgaatatccaattacgaactatgacacctttaaacgtgcggtttggcaaactttgggggcgtattactgtgtttgtaatgatggtgatggactggagattgccagcaatcgccctgacggttacgccgtccgtatcgtattcggcgatgtgccggtttaaaggggttttaaatggactttgaatttggtttcagaaccctgtggccgattgcgacggcggcattttggttttgggtcaacggcatttcaggccgcctgaaagaggcggacaagcgtatcgacgaccttaaagaggagttgcacgcggtcaagctctcttatcacaccaaggcggacgccaaggcagacagcactaatattgcggcggccttggagcgaattgaaaacaagttagaaaaagtaaacgaaaaactggacaggaaagcagacaaatcatgagcgacccgattttggatgccttggcgcgtattgaaaacaagactgatcaaacgctgaaaaatcagaaggaaatgcaggcggaaattgcgcaaattcgccaagacacgaaacgcacggccattacattcggcgcactgggcggcggcgtgattacggtcggctgggaattgcttaaagcgaaaatgggactgtaattatggctcacccgcaagaaatccgtgaaaagttacgccggctctatgtgagcggcgagcaaactttggaaacggcggccttgatgtgcgaaatcccgcagaccactgcgcgtgcgtggaaacgtgcggataaggaaaaaggcgacgactgggataagatgcgcgccgcttacactttggccggtggcggtattgaggatttgagccgtgcgatgttggccggttttatggtgcagtacaacagcacgatgacgatgctgcaggattcgagtaccgaagatttgccaccatccgaccgcgccaagctgttggccagcctggccgatgcgtttacgaaaaccgtatcggccaatgcgcgtgtgatgccggaaacgtcaaaactggcgacggctttggaattgattgagttcttgatggcgtttgtacaagaaaaacatcccaaacatttgcctgcctttgtggaggtattggagccgtttggggtggaagtggagaagaagtttggttagaggccaacaaatttttttaaaagagtaatgagggtggcggcagggatagcattaattgcattttccgtaagcgtacttaatgcagtgtccttgattttccctaattcttttttcaaccagcttttttctgaatcagaaatctctgcttggtctatttttgccgcaattaaagcctgaatagtgtcgctgtgtagtttgactgtgacaacaccaagaatggcggataggccgccatcatcggtaaggaagtctatgcccttatgattaattttgcagtcaaaatttttatgaagtgaatctatcgaagtaatttcaattaaaccagattcttctaagtaataaatattttttaaaaaatattggaattcatctgattgtaaagttgctaggtgttgactttgaatttcacaaccaagagtcaaagccaagcccaatccttgtttatcaacagggatgttagaagtaataggtaaagaactactagggaaaagagagttatacaccttggttgcttttaggcagttcgggtaattatcacttaaaactcgtaagattttttcctgaatacctctatttaaccagttcataaattattcctcatgaaaacaaaagaattcctcaaatcccttgccgaactggccgccagtttgcgccaagtcatcgaagcggaagtggacggcttcgatgcgtcgcccaaggctattgctgcacgccgtgccaaggtgtttgacccggtaggcggttacgagtatttcgtgaatacctacttcccccattatatccgctcgcctgagaaatccgaactgcatgcgtttttattcagccgtctgccggagattatccgctcccccaaaggggaaaatgaggcggtgggtgcgccgcgtggagagggtaagtcgacgaaggttactcagttgtttacgctgtggtgtattgtgaccggccaaaaacattatgctgttattgtgatggacagtatcgaccaggcatatccgatgctggaagccatcaaggcggaacttgaatttaacccgcgcttgaaaaccgactttccggaagtatgcgggcagggccgtgtatggcaggccggtacgattgtgacggccaatgacgttaaagtccaagtggccggtagcggtaaaaagctgcgcggtttgcgtcacggcccttaccgtcctgacttaactgttttggacgatattgagaatgacgagcaagtccgcaaccccgaacagcgcgacaagctcaatgcgtggctgactaagaccgtattgcctctgggcggtgtcggtcagaaatacgatgtgatttatatcggcacgattttgcattacgacagcgtacttaaccgcactttgaataacccgttttggcacggtattaagtttaaggcgatgaaacgctggcctgaccgcatggatttgtgggacaggtgggaggaacttttccgaaacgacggcgagacggtggccgaggcgttttatcaggcaaacaaagacgagatggagcgcggcgcggtcacttcttgggcggcgcgtggcgtactcgcgctgatgaaaatccgtgcgcgtgacggccatgcgacgtttgattcagaatatcaaaacgatccggtcagtggcgaagatgcgccgtttgccaagtcgatgaagttttggaacgacctgccgtccgatttggtgtatttcggtgcgctcgacccgtcactcggaaaggccggggcgagccgtgacccgtccgcgattatcattggcggttatcaacgtgtaaccggcaaactgtatgtcgtggaggctcagattaaaaaacgtctccctgatttgattattgaggacgttattcgattgcaccgtcaatatcgttgcaaactgtggtttgttgagactgttcaatttcaggaatttctgaaagacgagctggtcaagcgcagcgcggcgcgtggaatacctgtcccagcgcgggcggtcaaaccggtatcggacaagctgttgcggatcgagactttacagcctcacatggcgaacggtttgattctgttgaatgagagccaacaaacgctgatacagcagttccgccattttccaaaggctgatcatgatgatggtcctgatgccgtgcatatgctctggtcgggggcggtggccaattgtgtgccgatagaatggcaaagccctaccgataacgattttgatgacgagataaaaagtaaatggagccgataatggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaatatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgctgctcggtcatcgcgctgtcggagcgggatgtggaacgccaggggcggattgttgggcaaagcacggcggacaatctggtcgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaggggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatagacgttgggcaaggctcgaaatcacttgcacacgctctcggacgccctaacgggcaggctgcggtatcgaggttatcaccgcttttccaacgtctgtacggaataataccatgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtgaatttataaaaccctcaaaaacgcgctttttagcgcgtttttttatgcgggtaatacaaacccctgcccaagatataaaaatcaatcctagacgcttctaaaaagcccctgaaaacgattaattgtgtatcgcgcggacaggttttaaaaaaatggcgggagggtttgaagcacgcctactctttgttgttttttcaaataggcaaaatgaccgtattgagagaggtacacatgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacaccagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcgacctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcaaaaggcgtattgaaacagccgggcggcttggcatttttgaccggctttattgaaaacgcccagccggtcgctgcactggcaggctcgcaaacgggcggcaaagcacccgacgaacgcgtcgccgcactgactgcggaagaggcagccgcagcaaaaatgctgggcatgtccggcgaagaatttgtaaaaatcaaagaaagcgaaggtaagtaatggacaaatcagcgattttgaccgcaatcacggcagcattccgcaaagaatttcaaacggccttggattcggatttcaagtgcaacactaaggtaccagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggrcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacaaggagtcatcatggcaaaaaccaacaacaaaccagaaaccgccgaaaccgccgccccgtcgtttgaagacatcaaagccgaattggacgccgtgcaggcagagcttgccgccgcccgaaacgatgtcgaaatgctgaccacagccttggaaaaagccgaagacgacaaaaaggcactgtccgccgaacttgccgaactcaaagtgcagcatacgcaacgtgccgccgacgctttggcggacagccgcgatgtgatgctcgtcagtaccggcgcagacggcaaagaattttggcgcggcggcctgctgtttgacggcggctggcgcgaagtgaagcgcgccgaagtcggcgaagcggtgtggaaggcaatctgcgccgagcctatgctgcaacgcaaggcggtcgagtaatggcatacgcgacggttgaggatatggttgcgcgtttcggtgagctggaagtcttgcagctcaccgaccgcaacaacgaggggctgattgaccgcgaggtcgcacaaaccgcgctggtggacgccactgccgaaatcgacgcgtatctggggcggttcagacgaccttttgaggatctgccgcccatcttggtgcgcctttgctgcgacattgcccgctaccgtctgacggcggctcagggcgtgttgattaccgacgaaatccgcaaccgctacaaaatcgacgtgctcgacctgctgcgtgctatggccaaaggcgaagtgcagctgggcgtggatgatagcggcgaagaagtggccgcgggcgaagacggtattgtgtttgtaaacggtaaaaataaggtgttcgggcgtgatcactgatattgagcaagcgataacagaccgtctgaaacggggcttgggtcgcatggtgcgcacggttaaaagctacaacggcgaggccgacgatttggcggggcaaatccatacgctgcctgcggtttgggtaacgtatggcggcagcaaagttgagcctgccagcaccggcggcgtatgcggacgttatcaggataccgccgaatttgtggtgatggtggcggcccgcaatctgcgcaacgagcaggcgcagcggcaaggcggcatcgacagccgcgaaatcggcagcaacgatttaatccgcgctgttcgccgcctgcttgacggccagcggctcggttttgccgatagccgcggcttggtgcccaaagcggtgcgcgcgattgccaatcatgtgctggtgcaaaacgccgcagtaagcatatatgcggttgagtatgccatccgctttaacacctgcgggttggaaaatgaccgctaccccgaacgcaccgacaatcccgacgaccccaaccatatctttaccaagtatcagggtacattgagcgagccgtggcctgatttcgaggggttggacggcaaaatttacgacccgcaatccgccgatgaaatacctgtaaacctaacccttaaggataagcaatgagcaaaatcaaagtaacggcggcagatggcctgcgtgtgccgaccgaacacaacccgcacgaatatatcggccaagagccggtggaggtggacggcaacagcctgtattaccgccgcatgattgatgacggcgatttggtggtggttgaggatgccgccccaaataccaaaacccgcaatactaagggagagtaatgatgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaacccttttcagacggcgtttaaaacaggtttaaaggccgtctgaaaccttaaaaaaggataaagcatgagcgacgctacctatgccgacgcggtgattatggagatgaacggccgcgatatcgagattgtgagcatcaagccgcaaaccactacaggccgcaagccggtcaaaacgatgaaccgcaacggccgagtcaacggttattgtgacggcgtaaccgaacacaaattaagcgttaccgccgccattccgatcgacggtacggaaatcgactgggacaacatcaccaaggcgaaaatcacgatttaccccatcaacgacgaagatcgccgcacttcctacctcgactgctttaccgtcgataccggcgagcaatatgaagtcgataacgaggcacgcatcgacattgagatgattgctttgcacaaaatcaaggagtaatgcgtgattaccgtcaaactgacccacgggctgacctacaatggcaaagtcgtatctgaattacgcctcaagccactgaccgtcggcggcgaactggcggcgttcgccctgattgatgacttgcccgagctgcccgaaaacgccacaaaagccgaactgctgcaacgcgacgtcctagagacgctgacctactggtcgcagcagattgaagcccaaggtatcccatccgacatcctgacggcgcagtggctgatggaaaacctctctaccgaagactaccataccgtgatggcggctcaggaggatttgcgcctaaaaccgtccgccgctacggcgagccccgatgcgccgtcggcggcggagcagtaaaacgcagctacctgacggcacacaaaagctaccgtcaggcggtcatcctgatggcaaggcggggataggggcggacgcagtgcgcgatatgtgccacgccgagctgtcggcatggtttgaagacatcctgtcgagcctgggcataaaaacgccgaaggaagagggagtgattgtgtcgaaacggctgagaaagccggagggaaaataaaaaggtcgtctgagtttcagacgaccttttttttatttgacggttagggttgttttctgccgattattgcaatggtgtttgtttctttttcaaaaacaacgctatataaaataccatctgccggaacgtctttttgcgctgttgctcctgtctgattggattctttgacgacttcggttaaagctgtaaaaagttgttttcctgcttccgattcgcccaatttgtctgtggtagttaaagacagaactgcctgaatactgtgtaatccatttatggcattattgactagattttgtcctttctctccgtcggtttttaaaatgtagcctactgagatagctctaattttttgctgctcgtccagtttgagcgcaatcgccccaaaatccattaccaaagtaaggtcataaccacaatcggtcttgacaatatttttattatggatttttgttgagacgttctgagttttaaatgcttgctccaaattgatgagatattgttcaactgtgatgtccattggggcggtacaatcagcagcctggatactttggacaggttcttcggcttgtgccgtttttgattgttggttgcaggctgataaaacaattgaaacacaaattgcggaaatcaattttttcatattcataaaatatccctttgaataaaatggttatcattctagtattataacgcaacaaacaaataaagcacgaaaacggggttgaagcccataccgcctcccttaaacagcctttaaacgataattgaccttgagttaatacgtttaaaggctgctttttatggcaaacgggaacatgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataatgagcggatggcataccttattgcaggacgcatcttacaagggcgtcggctttgatattgaggtggtggacgagagcaacggcaaggcattggccgagcatgcgcggccgtttgtgcagggtatcgaccttgaagacatgggcatgaccgggcggcaggtgcagattaatgcggtgttttggggcaagggctatgcaggccgtctgaaaaagctgctggatgcgctggagcagccgggcggcggcgtgctggtgcaccctgtttgggggcggatgcacaacatgattgcggcatcatggagttaccgacatgaggccgattatgtggattatgcgggcatcgatattactttccgcgaggcggccgaagcgcaggaaatctttgtttttgaaaacgcctttttggtcgagcttgaggcgttgattgctaatatcgacacctaccgcgaggcggctatcggctttgttgatgcggtgttggcggtggatgcgggcgtatcagctttatggggcagcgcgctgggcatttggagtgcggcatcgggtacgtttggcgcggtgcgccgtttgtttgatttggacaaaattgcctttcccgatcggggcggatacagtgcagcggcgtttaaaaacggctcggccaagctgtttgcggatatatcggtcatggtagatactggcatacgccgtgaggcgggtttggccgataatgccatgcaccatgccggttggtcgccgcgacagcggtttgacggggctgcggctgttgccgaccgcgccgccgctatccctgataatttgctgaccggccgcttttcagacggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttgcgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataattcatacggctatgccgtgtcggtgcgcgtgggcggtaaagagcaccgccactgggagcgctacgacatcgacagcgactttttaatccctgccgacagcttcgattttgtcatcggcaggttgggaccggaggcggccatacccgatttaagcggagagagctgcgaggtagtgatagacgggcaaatcgtgatgacgggcatcatcggcagccagcgccacggcaaaagcaagggcagccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggccgaaaacaaccccgctttgggcaaaatcgacatcgagccgggcgaaaccgtatggcaggcattaacccatattgccaactcggtcgggctgcatccgtggctggagccggacggcacgttggtggtgggcggtgcggattacagcagcccgccggtggcgacattgtgttggagccgcaccgacagccgctgcaatatcgagcgcatggacattgagtgggataccgacaaccgcttttccgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggcctgcgtgtgcatgtgatcgacgacgagcacggtatcgatgcggtgttttttctgatggggcggcggtttatgctatcccgcatggatggtacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatgagtttgagtaaattggcgaaaaaaacggcacaaactgctaaaaatatcggcgaaaccctgcgcgcggcctttcggggaaaaatcacgctggtggtgtcgtccgagccgatacagcgcgtgcagttgagcggcttggccgacgaaaccctgcaagaccttgaacatttgcaggaatacggctttgccagccatccgcccgacggcagcgaagcggtagtgataccgctgggcggcaatacttcgcacggtgtgattgtgtgcagccagcacggcagctaccgcatcaaaaaccttaagcccggcgagacggcgatttttaatcatgagggtgcaaaaatcgtgattaagcaaggcaaaatcattgaggccgattgcgacgtgtaccgggttaactgcaaacaatacgaggttaatgcggccacggatgccaaatttaacgctccgttggtggagaccagtgcagtgttgacggcgcaaggccaaatcaacggcaacggcggcatggccgtcgagggcggcgacggagccacctttagcggcgatgttaaccaaacgggcggcagctttaacaccgacggcgacgtggtggccggcaatatatcgttgcgccagcacccgcataccgacagcatcggcggcaaaaccttaccggcggaaccggcatagacaagcagacctttggcagccttcgggctgctttttttgtgcgtgtgggattgaagcccgtgtactccgtgaggccgtctgaaaacggcaaaatgccaacatggacaaagagctaaaccccagcatcggcgactataccggccgcaccgtcgatacgctgcaaaatgccgtgtatatccgcttgatgacaccgttgggcagctggtgggcggataaaacgctcggctcgctgctgcatttgttgcagcgcgaaaaagacctgcaacgggtcagcctgttggccgagcaatatgccgatgaggcactgcaaccgattgttaagagcgggcgtgccgacaagattaccgtgcgcgcagagcagccgcacgacggccgcctgatcctgcatatccggatggatacggcggcgggcgggtttgattaccgccacgaagtgcccgtgatttaaagaggttttaaacgtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatgagctatcaagacatcttgcggggcctgttgccccccgtgtcgtatgcccgcaatgccccgcgtgtgcgggcgcaggcagaaatagacggcgcagcgctggatgcggtggcggaatcggctcaaagcgttgccgatgccgtcgacccgcgcagcgccggccaaatgctggccgattgggagcgcgtattaggtttggacggtacgggcaaaaaccgccagcaccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgctaaaggacgatttatgcaccccatcgaaacccccgataagaccttccacgacggcgacggcgtgtccgaattgggcaccatcctgcccgcgtggtggctcaaccaagtgcaatccgagctgctggccgtgctgactgcggccggtatccagccggataagtcgcagcctaatcaattactggcagcactaaataggctggctgtagttatcaccggcgaccaaaccgtcaacggccaaaaaacctttaccgcccaaacccaattccaaagcggcatccatttatccgccaaccagacgaactggaacggcggccacaaagcctacatcggcgcggatgccgacaacgcccacatcgtcttcggcgacgacaccctccgcctgcacggcgcaaacaaccgcatttcctacaacaaccacgacatcttccacaaagccaacaaaccgcgttttgccgaagacatccaaggcaaaccgaacacactgtccggatacggcatcggcaatttcaaagtcgaaacattccggggcgatttgaacaccctcaaaacagacggcatctattccctgccgacggcggtcggcagctccaacctgcccgttgaaaacaccgcctgccatatccaagtcatcgccggcacgaaacacggctggtgcaggcagttgggttatcccgcctacacgtccgacgtgtacgaacgccaccaaacgagcagcgcaaacgacaactggtccgcatggaaaaaactcaattcggacggcatccccgtcggcgcgatcgtatcctttcccaaagccgtacaaaaccccgcaggctatctcaaagccaacggcacgacctttgcacaaaacaccttccccgacctttaccgcgccttgggcaacagcaaccgcctgcccgatttaagccgtaccgacatcggcatcaccgcgtggtttccgtccgaccaaatcccgaccggctggctggcgtttgacgacatccgcacgcgcgtaaccgaaaccgcttatcccgagctgtaccgtctgctgaccggaaaatacggcagcatccaaaacgtcccgcaggcggaagaccgctttatccgcaacgcgggcaacagcttggcagtcggaacgaagcaggaagacgaaatcaaacggcacgtccacaaagtattttcacactggacaaaccacacagacgcggcagccctcggttacgaagaccgcaacgaaaggcagagaagcgcgctcgtatcgacttggacggacgaaaatttaaacgacaacggctttttaaccccgcgctcggacagcaaaatggcgacaggcggcgacgaaaaccgccccaaagccctggttttaaaactgtgcatcaaagccgccgacaccttgggcgaagccgtgttttggataaagtcccacggcgaaaccatcaacgcaggcgcgctggacgcgggcacgctggcgcaaggtttgcaagacaaagccgaccgagaccacacccacaccgccgcccaaatccaagggctggacgaaaaaatcagcaccgccgttgccgcgcaattcacacgccaaaccatcggcggcgtggatattgtcagattccccgacggcacaatgatacagaccggcagctacaggttcacacgaagcggcggccccatcgaaaacgaagtcgtcttccccgtcgcctttgccgacggcaacgtcaaatgcttcgtatccgaacgccattcggaacgcgttaccggcgatcgaaggcaacacaactggctgtttatccgcgcaaaaaaccacgccgccgccattatcaccaactggtacgaaggcagttgcgactggatggccatcggcaaagccgcctcgggaaacgccgccagctccccgataggccccgaaatacctgaaaccaacgaagaaccgcaaagagagagtggaagaacatcaaccggaccccgaaaccgccgccgccgagacggcttgctcgaggcactgcaagactagcgggctgtagagatggctgtagagacgggctgtagagatggctgtagagacgggttgtagagacgggttgtagagacgggttgtagagatgggttgtagagatggctgtagagatggctgtagagatggctgtagagatggctgtagagatgggctgtagagatgggttgtagagatgggctgtagagatgggctgtagagatgggctgtagagatgggctgtagagatgggctgtagagatgggctgtagagatgggctgtagagatgggctgtagagatgggctgtagagatggctgtagagatggctgtagagatggctgtagagatgggttgtagagatgggttgtagagacgagttgtagagatgggcttcagcccgccgatccaagcaatccgaccgaaaccggccgcgccgccaatcccccgaaacctatgccccgccaatcctgccactcttcgtcattcccgccgctttcgtcattcccgcgaaagcgggaatccagaccccccgacgcaacaggaatctatcggaaaaaccgaaacccccgccaccgtcactcccgcgaaagcgggaatccagcccccaaacgcggcaggaatctatcagaaaaaacagaaacccccgccgccgtcattcccgcgcaggcgggaatccagaccccaaacgcggcaggaatctatcggaaaaaacagaaatccccgccgccgtcattcccgcgcaggcgggaatccagaccccaaacgcggcaggaatctatcggaaaaaaccgaccccccgccaccgtcattcccgcgcaggcgggaatccagaccccaaacgcggcaggaatctatcggaaacggctgaaaccgaacggactggattcccgcctgcgcgggaatgacggcggcaggggtttcgggattcccgccttcgcgggaatgacggaaagtggcgggaataacgaaaggcgggaatgaccgcgcaaaaagccgctgcccccttcggacggcaccggcaacaaaaaaccgcacggccgaaaccgcgcgggaaaggatagtcgggcgcgcccgataagcagcggccgcccccgttatttcaattgggcgatatattggcgcaaaacctcgttgatgcgcgtctgccagcccttgccgccggcgcggaatttttcgaccacatcggcggacaggcgtatggtaacgagttgtttcggggttttgcctgtgtttcgtttttgcattacgcccttttcttccaattgtttttgatgggaaaaaagcacctgtgccaagtcttcgggcagggcttcggcaatggggcgggcaagcgcaaaatcttcggcggcaagttcccgcacttcgccgtcagcgtttgttaaggattgacgttgcatattttttaacctctcttttattcgctttgcgaaaactgatgacacggatgccgtcttttatcggcgtaaaacagacaatgtgcaggcgttgcgtatcgcctagataagcagcggcaacataacgcggttcggggtaatcaaagcggacatcgggcacaataacggccgttgtccagcgtatttgcccgactgattcaaagggcaaattccgctcttcgatattgcgttgatttttttcggagtcaaattcaatcttcattgcagcttgcagcgtattttgtcgttacattataagcggcaaaaaaccaaaatgtaaatacaaaaaaggaaaccccaaaatgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctgaaaaaatacgtttaccacctgttggtagccatcgaccaactgttcaacgccctaaccggcggcgcggcggacgaaaccctctcaagccgcacctatcgccgcgcgcggctcgcccaaaagcccaaaacccgctggaagattttatataccctgatcaacggcgtgtttttcgaccgccaccactgccggcaggcgtatatcagcgaactgaaaggcaggcagcacgacgcgcggttcaaccaaagccgcgccgccggggaaaaggggacgcgatgaactacttcggcatggtagagtttctgcgcctgatggcaatggtgcggccgccatttgtcttcttctccggcacccgcagcgaactgcctgcttatcttgacctcgtggcagaactgcgcctgaccggatgggagcgttttgcaggcagccaaaccttgactgtgagcagcacatcaacagcaattcaagctacgacgaccacctgatttataagttctgaccgcaagtagcgtactacttttaaaggcataagataatccccgtttaacagaccattaaacggggataaatttgtgcaaaagctaatacaatttcctacgcttcggcggtgcaaaagctgccgccaattcgtgcaaaagctgccgccgccttacattccagtgcaatgccgtctgaaacttcgctaatctcgggttgccgcgcgctgtgttgttcttcggtactcagcaaaaagccgtacagacgctccaatcgggcgcggtaggcggtgaatttgttgtagaacatccggaagaaagaaagcgcgttttgcagtcgcgcgaaggcttggacggtctgctggatgtcgccgattttgatttgtccggcaaacaggcgcggcgcttgcaaaataatggggaagagcttgatgccgttggtgaacatatcattaaagccgctcaggcagacgctttgtcgcgcaatacgccagcggttgcggataatggctttaaaacggtcagaaagctggtcgtgttcgtgtttttcgccgctgtaaaacgccacgctttcggcgtggtcgcgcacgcggatgagggaataacggtagtcgccgttgagtttttcgttttcataattgtaacgaatcaaagggttgcctatccacatggcgataaaggtcgccaaaatcacaaatatatagacaaaccaaacgatgccgtgcggaatgtcgaagccgaacacggtcaggatgccagccaagccccgcaaaacaacggcaaattccagagaagtaacgaccgaattgaccatgccgcgcacaaattcgatggtcgaagcgataaattcctgcgcgtcctgttggatacgctggtcgatgttgtccggcgcgtggcggcgcatttgcaggcggtagtagtttttgtcggcaagccagcgtgctgtcagcacttcgttgagccgctccgaccatttaatcgccaagccttgatcgaggaagtcgttgacgacgttgttaaacgcccgtatcagcaccacgcccgcgttcattgcagcaaacatccaaaatgccgaagcatttcaaatcctgcatcgagtcgtaaagccctttggacataaaggtactcaacacattcagccgcatttcggttaacaccagcgtaatcatcgccgtaatcagcagcaagactttgaccgcgcttttcggtgtcagacaaagccaaagcggtgtggaataaagctcggtttgccatttctgcatgggaaatttcttacggtatcaatgccgtctgaaaaagacgggtacagttgattttttgatgaagtttggggaagttttgccggtcagggtacattgcgtgttaatttatagtggattaaatttaaaccagtacagcgttgcttcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgaacgggaaagcagcagtcccagatgggcgtgcgcacccggggcgagcattcatttttattgttgccgngcttccacaaaggtatttttccattcttttcggatctgctgtgcccaacgaaagtgtcgttcgtttttcaaacct

SEQ ID NO: 45 - DNA, 9560 bp, Neisseria meningitidis
cgcgtccaaatcaaccgcgacaccggcgaataccaaaccttccgccgctggctgattgtcgccgatgaagctatacctatcccgatgtcgaaaaaaccatcgaggaaatccaagaggaaattcccggcactaccatccaaatcggcgaatactacgaagagcagctgcccaacgaaggcttcggccgccaagccgcgcaaaccgccaaacaaatcatcctgcaacgcatccgcgatgccgagcgcgagcagaatctgaacgagtttctcgccgtcaaagaagacatcgtgtccggcacggtcaaacgcgtcgaacgccacggcatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaagtcattctgagccgtacttccggcgatttcctcgtcaaactgtacgccaatgaagtacctgaaattgcagacggcatgcttgaaatccgcgctgtcgcccgcgacccgggacaacgtgccaaagtcgccgtcaaagccaacgaccagcgcatcgatccgcaaggcacctgtatcggcgttcgcggttcgcgtgtcaatgccgtcagcaacgaattgtccggcgagcgcatcgatgtcgtcctctggtcgcccgaacccgcgcaattcgtgatgagcgcgctctcacccgccgaagtcagccgcatcgtcatcgacgaagacaaacacgccgtcgatgtcatcgttgccgaagaccagctcgcgctcgccatcgggcgcggcggtcaaaacgtgcgccttgcttccgacctgaccggctggcagctcaacatcatgacttccgccgaggcagacgaacgcaatgcggcagaagatgccgccatccgccgcctgtttatggatcacttgaacgtggacgaagaaaccgccgacgtactggttcaggaaggttttgcaaccttggaagaagtcgcctatgttcctgccgccgaactgcttgccattgaaggatttgacgaagaaatcgtcgatatgctccgcaaccgcgcccgcgatgccatcctgaccatggcgattgccgccgaagaaaaactgggcgaagtgtccgacgatatgcgcaacctcgaaggcatagatgccgatatgctccgcagccttgccgaagcaggcattaccacccgcgacgacttggcagagcttgctgtggacgaactgattgaaatcaccggtgtaaacgaagaaaccgcaaaagccgtcatcctgaccgcacgcgaacactggtttaccgaagacaaataaagggggtacagatgagtaacacaaccgtagaacaatttgccgccgagctgaaacgccccgtcgaagacctgttgaaacagttgaaagaagccggcgtcagcaaaaacagcggcagcgattccctgacgctggacgacaaacagcttctgaacgcctacctgaccaagaaaaacggcagcaacagcagcaccatcagcatccgccgcaccaaaaccgaagtcagcaccgttgacggcgtaaaagtcgaaacacgcaaacgcggacgcactgtcaagattccttctgccgaagaattggcagcacaggtaaaagccgcccaaacccaagccgcacctgtccggccggagcagacggcagaagacgcggcaaaagcccgagccgaagctgccgcacgcgcagaagcccgtgccaaggcagaagcggaagcggcaaaactgaaagcggcaaaagcaggcaacaaagccaaacctgccgcgcagaaacccaccgaagcaaaagccgaaaccgcacccgttgcggcggaaaccaaacccgccgaagaaagcaaagcggaaaaagcccaagccgacaaaatgccgtctgaaaaacccgccgagcccaaagaaaaagccgccaagccgaaacacgagcgaaacggcaaaggcaaagatgccaaaaaaccggcgaaacctgccgcacctgccgtgccgcaacccgtggtcagcgcggaagaacaggcgcaacgcgacgaagaagcacgccgtgccgccgcacttcgcgcccaccaggaagccctgttgaaagagaaacaggaacgccaggcacgccgcgaagccatgaaacaacaggcagaacaacaggcaaaagccgcacaggaagccaaaaccggcagacagcgtcccgccaaacctgccgaaaaaccgcaggcagccgcgccagccgtcgaaaataaacctgtcaatccggcaaaagcgaaaaaagaagaccgccgcaaccgcgatgacgaaggtcaaggccgaaacgccaaaggcaaaggcggaaaaggcggacgcgaccgcaacaatgcacgcaatggcgacgacgagcgcgtacgcggcggcaaaaaaggcaaaaaactcaaactcgagccgaaccaacacgccttccaagcaccgaccgaacccgtcgttcatgaagttttggttcccgaaaccattaccgttgccgatttggcgcacaaaatggcggtcaaaggcgtggaagtggtcaaagccctgatgaagatgggcatgatggttaccatcaaccaatccatcgaccaagacaccgccctgattgtggtggaagaactcggccacatcggcaaacctgccgcagccgacgaccctgaagcattcttggacgagggcgcggaagcagtggaagccgaagcattgccgcgtccgcccgtcgttaccgtgatgggccacgtcgaccacggcaaaacctcgctgctggactacatccgccgtaccaaagtggtacagggcgaagcgggcggcattacgcagcacatcggcgcgtaccacgttgaaacccctcgcggcgtgattaccttcttggacaccccgggccacgaagcctttaccgctatgcgcgcacgcggtgcgaaagcaaccgacatcgtgattctcgtggtcgccgccgacgacggcgtgatgccgcaaaccatcgaagcgattgcccacgccaaagctgcgggtgtaccgatggtggttgccgtcaacaaaatcgataaagaagccgccaacccagagcgtatccgccaagagctgaccgcacacgaagttgtgcctgacgaatggggcggcgatgtacagtttatcgacgtttccgctaaaaaaggcctgaacatcgatgcattgctcgaagccgtcttgctcgaagctgaagttttggaactgaccgcacctgtcgatgcgcccgccaaaggcatcatcgtcgaggcgcgcttggacaaaggccgcggcgcggttgccacattgctggttcaaagcggcacgctgaaaaaaggcgatatgctgctggccggtacggcattcggcaaaatccgcgcgatggtcgatgaaaacggcaaatccattaccgaagccggtccgtccatccccgtcgaaatcctcggcttgtccgacgtaccgaatgcgggtgaagacgcgatggtattggcggacgagaaaaaagcgcgcgaaatcgccctcttccgccaaggcaaataccgcgacgtgcgccttgccaaacagcaggcggcgaagctggaaaatatgttcaacaatatgggcgaaacccaggcccaatctttgtcggtcatcatcaaggcagacgtgcagggctcttacgaggctttggcgggcagcctgaaaaaactgtccacagacgaagtgaaagtgaacgtgttgcacagcggcgtgggcggcattaccgaatcggatgtcaaccttgccatcgcttcgggcgcattcattatcggctttaacgtgcgtgcagatgcctcttcgcgcaaacttgccgaaaatgaaaacgtggaaatccgctactacaacatcatctacgatgccatcaacgacgtgaaggcggcgatgagcggtatgctttccccggaagagaaagaacaggttaccggtacggtcgaaatccgtcaggtcatctccgtttccaaagtcggcaacattgcaggctgtatggttaccgacggcgtggtcaaacgcgattcccatgtccgcctcatccgcaacaacgtggttatccacacgggcgaactggcttcgttgaaacgctataaagacgatgtaaaagaagtccgcatgggcttcgagtgcggtctgatgctcaaaggctacaacgaaatcatggaaggcgaccaactggaatgcttcgacatcgtcgaagttgcccgcagcctgtaattcctttgcaaataaaatgccgtctgaagcgttcagacggcatacgaaacgggttctgtatcatacagaacccgttttttgtcgcaaatcggcttcagacagccctcttgccttatcccgatttgaatctgacttgccatacaaacaggcttcagacggcattatttgcccgctaaacgtatcccaagcttctccgcatattccctgcgttcggcgcggctggtttccgggcggtgcgtattgagcgacgaccatttccaatgactgcgggctttgttgagttcgggcgggagtctggcggcatcccacgggactttgcggctgtgcagctcgatatccgactgtgccgcgtgtccgcgcgtttgcaggacgtggagcaaatcgagggcgcgggcggcgagcagggtcagggtttcagggtcggtgtgcagggtttggcggccagcgagtttgtcggaaatggtgcgggtattgggcaggatgccgcccaaaaagccgccgattgccgtacccaatccgagcgagccgccgagtgtggcgatgtccagccccaagccgatgagcgcgccggttgccgcgcccgtgccggtgcggatgccgtattgtttgagcaattcgctgtcgaacgggtcttggcggaaggcttgcggcatccagtcgccgccgtcgatttcgctgtggtagaaacggtagagggcaaacagccgctgctgcatctgccgttcgagttggcgtatttccgcctgcatggtttgcagcacggtggcggtatcctcgttttcgtccacttcctgcctgaaggcggcggcatcaattaaaaagtcggcgatttcgcggcgcgcttcgccgtccagccgctgccattcgcgccggcgcatggctgtcaggcggtcaagtgtgctgcgttcgggcaacatggtggcgaggttttcccacaggcgcagttcgccttcaaaatcaaaggcgacggtgtcgaaccctgcgaaaacgtgcaggtttctcctcgccagcatggttgtccacgattcgggaagctgtccgccggtaaagttgaacacgggcataaccggtttggcacaccatgaaaggatggtcaactcgtccctgtatttgtcgaggacgggttcgcgcgcgtcgatgacgtacattgccatatcgctttgcaagacttgccgtaagactttggcttcctgattgaaatcatggtgcgcaccgtggctgccgagaaactgttgcagccgttcgatgccgtctgaacgattgtccgtatggttttccagccattccagcacgccgcccgcgtcttcgagtccgggcgtgtcgtacaggaaaaccagcgtgtctgcgccgtcgctgatggcggcttcttcgacatgacgcgtggtcgatggggcgtttttgacttcgccgaaaccgctgtcgcgcaaaagggtacgcaggagcgaggttttgccggtgttggtgtgtccgacgacggcgagggaaaggggttgtttgttcatgatgtttttgaagaatggattttcagacggtcttttttcagaatggcggcttaacagaacatttcaagtgagtttattggtctttcaaacgcccttcctgcgccgccctgtcaggctcaagccacgccgcgccgcattcggccagcgcgttacgccaatgttccagcttttccgaaaggtcgtctgaaagcccctgttccgccaaaagctgcaccaccgcgccgccctgcgccgcttccgagagtcggacaatctgccgcaacacgccgcggtccggcacagtttgggcgcgcacgccgataagcagttgcgccggtttctgcttcagctctgtctccagcgcggcaacctgttcccgattggtggcaacgcccttatccagccattcctgcgccagcctgccctcgaaccattcgccgtcctgccactcggtctccagcatgaccgcccatttcggcgcatcgttcaagatgattttcggtgaaacggcggacacggtttcccgacgcgtatccgcatcggtgattttgttctgccagcggcggatgaccgcctgataatagggcttttccaaatccaatccgttttcgcttgttttcaaaaggattttacacactacccaagccagcaggcgcggcaggatgccgtagcaggcgatactgccgaccagcagccccgaccaagcccgcgcatcggcaatattgccgttcagacggccttcgatgaccgcccgcgcatcggggacagggaaaccgagtttcgacggcagccatgccaacatttccaccgcgcgtaccgaagcggcattgctcaacagcgtgctttcccagttgaacgtatattgccgcaccaaaagcagcaacaataccgacaccagcattccgagcagcgtgcagagccacaggctgtgcgacgttgcgcctattttccaacgtaccgaaggttgccgccactcgtccgcatacagccgcaacaccgcctgatttacagggtctttgccccgaaaccacgtcgccggactgctgaaaaaacgccccactttcacacgcaggaacaacattgccaaccatactgccagcatcagcgtattcatgcccaacacgcccgccaaaaccaaaaagaaattcagaccctgattgtccattagaagataagtgactgaaaaaccggtaaaaaatgcaaacgtcgccgccaccacccacaaccagaacgaccccgcacgcacacgttccaacgtctcccgcagcatacggttcctgtcaatcatctccgcccgacggatgattttttcctccgtactgccgtccacgcggcgcaaagcctccgtcgcctgtacgggatcgccgctgaaaataaaaccgccttcgtccaaaatacggaccagctcaaccagttttcgggatggattcaacataaaatgccgtctgaaaataaaaaacagattttaacacacgcattttcaagaatattcacagtgtaggcaaagagtaaatctcacacagaagcaaaagtatcggcgtaaactgactgcctctactttcccgaaagattgtgcgatgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctgaatgccgtctgaaaagcaaaacctcccgttcctgaagattgggaggttttctgtttgccggacatcagcccttgtcgtggaactcgtggaattcatactgataggacaaatcccgacccgcttttttctgtgccaaataatcatcataaatggcgcggatttccttacgcaacaaaaacagggctatcaggttggggataaccataaaaccgttgaacatatccgacagactccaaaccaaatcgactttgccgagcgtacccaaaacaatggcaagcagaaccaatgcgcgatagatgcccaagtgtcttcccctgaaaagaaaacggatattggactcgccgaaataataccaaccgatgatggtggtgaaggcaaagaaggtcagacacacggcaagcaattgcgaaccgaagcccggaaatgccttgttaaaggcaaattgagtaaccgccgcgccctgttcgcccgaaaggttggcatcggtcagcaggataatcaatgccgtagccgtacataccaaaatcgtatcgataaacacaccgacaaatgccgccataccttgctgcacagggtgcttcacatccgcagtcgcgtgggcgtgcggagtcgaacccatacctgcttcgttggaaaacagaccgcgcgccacgccgaaacgtatcgcttcgcgcataccgatacccgcagcaccgcccaaaacggcttcgggattgaaggcggcggtaaagatgtggttgaacatcggcacaatatggtcggaaaattcaaacaggataacgacggcgcacaaaatataaacaaccgccataaacggcacgacaaattgggcgatattggcaatacggttcacgccgccaatcacaaccatgcccgcaaggacggcaagcacaataccgactgccaaagaaggcacatcaaatgcaatggtaacggcagaagcaatggagtttgcctgtgtcgcattaccgataaagcccaatgcgataatcaacgcaatggaaaagaaaccggacaaaaaacgcgccgcgcccctgccgattttcggagtcagaccgtgggtgatgtagaacgccggcccgccgatgtatttgccgtggctgacgacgcggtatttctgcgccagcagtgcctccgcaaaaatcgtggacatccccaaaacggcagaaacccacatccaaaaaatcgcgcccggcccgcctgcggtgatggcggtcgccacgccggcaacgttgcccgtaccgatttgcgcagatatggcaaccgccaacgcctgaaactgcgataaagacttgtcgtctttatcgcctttggcaaacaagccgccgaatacggatttgaatcccgcgcccagcttggtaatctgcggcgcaccaagatacagcgtaaaaaacaggccgatacccaaaagcgcgtaaatcagcaggtagtcccaaaggaaccgattgactgtacccaccagaacagacaatatattttccataaaataaaccttatcttacaattaaaatgactgccttccaaaagacattccaataaggaaacacggcgagcagaccgtatttgccgcaacagatgccttaaattgtcaacaatcggggagaagctgcgc

SEQ ID NO: 46 - DNA, 352 bp, Neisseria meningitidis
  misc_feature (109)..(109): N is any nucleotide
  misc_feature (112)..(112): N is any nucleotide
  misc_feature (333)..(333): N is any nucleotide
  misc_feature (340)..(340): N is any nucleotide
ccttcgaccaaaacgacttcgtactgcgccgccaattcttgtgtggcggtgcggattttgtccaagtccaaagccctgccatccagtcgggcggcgaggtgaggcgaanggngatagctgaagatttcgggcatagtcagccgccgtttgtcggcttcctgcatcggtatgcccataattttgcggtggacggcgatgtcgtcggccaataacctcatgatggaatagtaccgtttttcaaaggtactttaatcatagagcgtcgagcttgatccattgctttttgaacagcaactggtacttcttttgatttacctttgcccataccaatgngaccatnaccatcaaccaa

SEQ ID NO: 47 - DNA, 22863 bp, Neisseria meningitidis
tttattatgctgcctttcctgctgtatttcctgtccggtaccctgagtcaagagtctgcatttgaaacttaccgtgccattgtttcccatcctttggtcaagctggttttaatcggtgtattgtgggcttatctgcaccattctctcgccggtatccgctttttatttttggatgcgcacaaaggccttgagctgaatactgcgcgcaataccgctaaagccgtatttgcttctgcattggttttgactgtcgttttgggagcgttgttatggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaagtatgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatgcgttttcagacagtcttcgcctcaaaggtcgtctgaaatctaaccatacccacattgaactgcttgaatttataatacaaaatcattgggcagttgatgagaaaaggaacacttctcatggaaaaaatgagttttgaaatttaccgttacaacccggatgttgatgccaagccttatatgcagcgttacgagttggaattggaaccgaccgacgtgaaacttttggatgctttggtacgcctgaaagcacaagacgataccttgtctttccgccgctcctgccgcgaaggcatttgcggatcggacggtatgaacatcaacggcaaaaacggcttggcgtgtttgaccgatctgcgtggcttgaaacagccagttaaaatccgtcctctgccaggtctgcctgttatccgcgacctgattgtggatatgacccagttcttcaaacaataccattccgtcaaaccttatgttgtcaacgataatccgattgatgcggacaaagagcgtctgcaaactcaggaagagcgtaaagagttggacggtttgtacgagtgtattttgtgcgcctgctgttcgactgcctgcccgtcattttggtggaaccctgataaattcgtcggtccgtccggtttgctgaatgcttaccgtttcattgcggacagccgtgataccatcactaatgagcgtttggataatctgaacgacccataccgtttgttccgttgccacaccattatgaactgcgtagacgtatgtcctaaacacttgaatccgacccgagccatcggtaagattaaagagattatgttgaaacgggccgtttaagaaatgatggtttttgacgatattgccaaacggaaaatccgttttcaaacccgccggggattgttggaattagatttaatcttcggcaggtttatggaaaaagaattcgagcatttgagcgataaagagctgtccgagttttccgaaatccttgaatttcaagatcaagaattgcttgccttgattaacgggcattcggaaacggacaaagggcaccttatcccgatgcttgaaaaaatcagacgggcatgaggcatctgaaatctgcctgcaggcagatttcaaaatgcaaaagccgtctgaaggcaaagaacgtgctgcggatgcagtaacgtgggttataacttgcaaaggagcaataatatgtccaaatcaatcaaactcaacgtaccgggtcaggcaggtttggagctgccggtattggaagccagcatcgggcacgatgtggttgacattcgggggctgacaaaaaatacaggtttgttttccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaataccgtccgccgccacacgatggtgcatgaacagctgacttggttcttccgggggttccgccgcgacgcgcatccgatggcgatgatggtcggcgtggtcggcgcactgtctgcgttctaccaagacagcttggacattagcaatcccgaacaccgcaaaatcgcgatttaccgcctgatttctaaaatcccgaccattgcggcaatgtgctaccgctattcaaacggtctgccgttcaattatccgaagaataatctttcttattccgaaaacttccttcatatgatgttcgccacgccgtgtgaagactacaaacccaatcccgttttggcacgcgcgctcgaccgcatctttattttgcatgccgaccacgagcaaaacgcctcaacttcaaccgtccgtctggcagggtcttcgggtgcgaacccgtttgcctgtattgctgccggtatcgcctgcctgtggggtgcttcgcacggcggtgcgaacgaagccgtgttgaaaatgttggacgaaatcggcgatgtgtctaatgttgccgcatacatggaaggtgtgaaacaacgcaaataccgtctgatgggcttcggtcaccgcgtgtaccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatccaaacgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccgccaggcgagaggtaacatacattaatatattgtcaaacaggcaatatcagagaaccggattgtttcccgaatccgtctgattgtagtcggatgaaatcaagacaagcaatccggtttaaaatagggtagaataaaatgtcttttcaggcggcatcagtttagccgtcaggacgcggacttctaccctttgtttatattttaaagaaaagagcgcacgccatgatggacgaaaaactcaatttctcttacctgttcggttcaaacgcaccttacattgaggaattgtacgaggcttttttggaaaaccccgatgcggttgatgaaaaatggaagcagtatttcaccgatttgagcaaacagccggggacggttgctgtcgatgtcgcacacacaccgattcgcgaatcatttgttactttggcgaaaaagaaaattgcatctgccgttgcgggcggtgcggatgaggcaatgctgaaaaagcaagtcagcgttttacggctgatttccgcctatcgtatccaaggcgtgggtgcagcccaacttgatccgctcaaacgtatccccccgcgcgatattgaagccctcgatccgaaattccacggtctgtcagatgccgatatggcgcttcaattcaatatgggcgagggcgattttgccaatcgcggcaaactgcctttgtcccaaatcatcagcaacctcaaacaaacctactgcggccacatcgcattggaatatatctatattcccaataccgaagagcgccgctgggtacgcaattattttgaaagcgtattgtccacaccgcattacaatgccgatcaaaaacgccgtatcttgaaagagatgactgctgccgagactttggaacgttatctgcataccaaatatgtcggtcagaaacgtttcggtgtcgaaggcggcgaaagcgcgattgccggtttgaactacctgattcaaaacgccggtaaagacggtgtggaagaggtcatcatcggtatggcgcaccgtggccgtctgaatgttttggtgaacattttgggcaaaaaacccggcgatttgtttgccgaatttgaaggtcgtgccgaaatcaaactgcccagcggcgacgtgaaataccatatgggcttcagctccgatattgccacgccgcacggcccgatgcacgtttctttggcgttcaacccgtcacacttggaaatcgtcaacccggtggtggaaggttctgcgcgcgccaaacaaaaacgtttgggcgaaaacggccgcgacaaagtcttgccggtattgattcacggcgactccgcatttatcggtctgggagtcaaccaagcgacattcaacctgtctaaaacgcgcggttataccaccggcggtacggttcatatcgtcatcaacaaccaaatcggctttaccacttccgatatccgcgatacccgttcaaccgtacactgtaccgatatcgcaaaaatggtttccgccccggttatccatgtgaacggcgatgatcccgaacgcgtttgctttgctatccaagccgctttggattaccgcaaaaaattccataaagacatcgtgattgacgttgtctgctaccgtaaatggggtcacaacgagggcgatgatccgaccttgacccaaccgatgatgtacaaaaaagtatcgcaacaccccggtgcgcgtgctttgtacaccgagcaactgattgccgaaggcgtggtaacccaagccgaggctgacggttacatccaagcttaccgtgatgctttggacaaaggcgagcacgtcgagcaaacaacgttgagcaacttccaacgcacgcaaatcgactggagcaaataccaaggcaaagattggcgcgaacacatcgaaaccggtttgcctgccgcagatattgaacgtctcactgagaagtttaccgccgtaccggaaggctttgccctgcatccgactgcaaaacgtgtgattgaagcgcgtaaagccatggcatccggcaaacaggccatagattggggtatggccgaaaccttggcatacgccagcctcgtaaccaaaggtcacggcgtgcgtatttccggcgaggactcgggacgcggcacgttctcgcaccgccacgccgtattgcacgatcaaaaacgcgaaaaatgggacgacggtacttatgttcctctgcgccatatgggcgaaggcatgggcgagttcctggttatcgactccattttgaacgaagaagccgtgatggcgttcgagtacggctttgcctgctccgcacctgacaaactgaccatttgggaagctcaattcggtgacttcgccaacggcgcgcaagtgactattgaccaattcctgtcttcaggcgaaaccaagtggggtcgtttgtgcggtctgactaccatcctgccgcacggctacgacggtcaaggccccgagcactcttctgcacgcgtagaacgttggttgcaactgtgttctgagaacaatatgcaagtcattatgccgtctgaagcgtcgcaaatgttccacctcttgcaacgtcaagtcttgggttcataccgcaaaccgctggtgattttcatgtccaaacgcctgttgcgcttcaaaggtgcaatgagcccgctggaaaacttcaccgaaggttcgaccttccgtccggttatcggcgataccgcagaacgcgcaagcaacgacagcgtgaaacgcgtggtattgtgtgccggtcaggtttactatgacttggaagccggccgtgccgagcgtaaactggaagatgatgttgctattgtccgcgttgagcagctgtatccgttcccatatgacgaggttaaagctgaactggcgaaatatccgaacgcaaaatctgtggtttgggcacaagaagagccgaaaaaccaaggcgcgttctaccaaatccgccaccgcatcgaagatgttattagcgaagagcaaaaactgtcttatgccggtcgtccaagcagcgcatcgcctgcagtgggctactcaagcaaacacattgctcaattgaaacaattggttgaagacgctttggcattgtaaaccaagtagcattccgtctgagtctgctcagatggaatgcccatatgcagaattaaaaacacacaacaggccgtctgaaagggccattggagacacaaaatgattattgatgtaaaagtacctatgttgtctgaaagcgtatctgaaggcacgctcttggaatggaagaaaaaagttggcgaagccgttgcccgtgacgaaatcctgatcgatatcgaaacggacaaagtggttttggaagtaccttctccacaagccggcgtattggttgaaatcgtagctcaagacggtgaaaccgttgttgccgaccaagttttggcgcgcgtcgatacagctgctactgccgctgctgaagccccagccgccgctcctgcagaagctgccccagctgccgctcctgctgctacacaaaacaacgccgctatgcctgctgccgccaaactggctgccgagaccggtgttgacgtgaacgcattgcaaggttccggccgtgacggtcgcgtattgaaagaagacgtacaaaatgccgctgccaaacctgccggagccgctgctcctgctgttgcacttcctgccggcgcacgtcctgaagaacgcgtaccaatgagccgcctgcgtgcccgtgttgcagaacgcctcttggcttctcaacaagaaaacgccattctgactacattcaacgaagtcaacatgaaaccaatcatggacttgcgtgcgaagtacaaagaaaaattcgagaaagaacacggcgtgaaactgggctttatgtccttcttcgttaaagccgctgttgccgccctgaaaaaatacccggttgtgaatgcttctgttgacggcaaagacatcgtgtaccacggctacttcgacatcggtatcgcaattggcagcccacgcggtttggttgtgccaattctgcgtgatgccgaccaaatgagcattgccgacatcgaacaagcaattgttgattacgcgaaaaaagccaaagacggcaaaatcgctatcgaagatctgaccggcggtacattcagtattaccaacggcggtactttcggttctatgatgtctaccccgatcatcaacccacctcaatctgcgattttgggtatgcacgccactaaagagcgcgctgtggttgaaaacggccaagttgttgtccgtccgatgatgtatctggctctgtcttacgaccaccgtatcattgacggccgcgaagctgtattgaccttggtagccattaaagacgcgttggaagacccggcccgcctgttgttggatctgtaatcgtttcagacggccttttatttgttaatgaaaaggccgtctgaatttttatagtggattaaatttaaaccagtacggcgttgcctcgccttgccgtactatctgtactgtctgcggcttcgtcgccttgtcctgatttaaatttaatccactatatttagatgtagcgtaatgtagtatcgtgctacaataggctcaacgaacgattgaggccgtctgaaacatttgattcgaatgaatcggcagatatggactttcagacggccttttcttaaaaccatcaaaacgcagtcattcaaaataaaaaagaaacaaaaagtatcgtttttattttgagatactgttaaaagcaaaggatgacacgatgtctcaatatgatgtagtagtgattggtgcaggcccgggtggatacgttgccgccatccgtgccgcgcaactgggtttcaaaaccgcttgcgtcgatgcaggcgttaacaaagcaggcaatgcccctgcattgggcggtacttgcttgaacgtaggctgtatcccttctaaagccctgttgcaatccagcgaacatttccacgctgcgcaacacgagtttgccgaacacggtatcactgtcggcgacgtaaaattcgacgcggccaaaatgattgagcgcaaagatgccatcgtgaccaagctgaccggcggcgtcaaattcctgttccaaaaaaataaagtaaccagcctgttcggtacggcttcctttgccggtaaaaatggcgatgcttaccaaatcgaagtcgataacaaaggcgagaaaaccgttatcgaagccaaacacgtcatcgtagccaccggttccgtaccgcgtccgctgccacaagtcgctatcgacaatgtgaacgtattggacaacgaaggtgcattgaacctgaccgaagtacctgccaaactcggcgtgatcggttccggcgtgattggtttggaaatgggttccgtatggaaccgcgtgggtgcggaagttaccattcttgaagccgcgccgactttcctggctgccgccgaccaacaaatcgccaaagaagccttcaaatacttcaccaaagagcaaggtctgagcatcgaattgggcgtgaaaatcggcgacatcaagtctgaaggcaaaggtgtttccgttgcttacgaaactgctgctggcgaagccaaaaccgaagtattcgacaaactgatcgttgccatcggccgtattccaaacaccaaaggcctgaacgcggaagccgtaggcttggaaaaagacgagcgcggctttatcaaagtagatggcgaatgccgtaccaacctgcctaacgtatgggcaatcggcgacgtggttcgcggcccgatgttggcacacaaagccagcgacgaaggcgttgccgttgccgaacgcattgccggtcaaaaaccgcatatcgacttcaacaacgtaccgttcgtgatttacaccgatcctgaaatcgcttgggtgggtaaaaccgaagagcagctcaaagccgaaggcgtggagtacaaaaaaggtacttcaggttttggtgcgaatggtcgcgcattggcaatgggcaaagccaaaggtacggttaaagtgttggcagatgccaaaaccgaccgcatcttgggcgtacacatgattggtccggttgtcagcgaattggttaccgaaggcgtgactgcgctcgaattcttcgccagcagcgaagacatcgcccgcattatccatgcccacccaaccttgtccgaagtggttcacgaagctgcattggcggccgacaaacgcgctttgcacggttgatagacattaaggccgtctgaaatttttcagacggccttaaggccttcgacaaattgaatgttccgagagctccgttttctgatttataattccgtcagacaaacaaacagcatttacattcattatgaacaaagaaatagtcggtattttctttataccggcgggcatcatcagcatgtgtatggccgcattgtggcagatgtatgtgatgatgaccgaaacttatacgctcaaccgtttcaaagataaagaattggtttggcgcgtggcattgttgtttatcagtttcagccttgccgtttatctgctctgtccgaattcgcgtaaaaaaggcatcgtcttttttattctcgggggaggcggtgcagccatgtatctgctggcgcggatgtggttgcctttcagcaagtgaaacgacgattttccgaccgccgaaaggtagtctgaaacgcacgggcttgccatttggaggcagactcggggcattccactaatctaaaggagaaatccatgaatttacacgagtatcaggctaaagaactgctggctagctacggtttgcccgtacaaggcggtattttggcacacaacggcgaagaagccgctgcagcttacgacaaattgggcggcaaattcgctgttgtcaaagcacaagtacacgccggcggccgcggtaaagcgggcggcgtaaaagtcgttaaaagccgcgaagaagctaaagaagtggctgaaagcctgattggcaccaacttggtaacttaccaaaccgatgccaacggccaacctgtcaacagtgttttggtttgcgaagacatgtatccggttcaaaccgagctgtacttgggcgcagtggttgaccgttctacccgccgcattacattcatggcctctaccgaaggcggcgtggaaatcgaaaaagttgctgccgaaactcctgaaaaaatcttcaaagtaaccgttgatccgctggtcggcctgcaaccttgccaagctcgcgaagttgcgttccaactgggcttgaaagacaaacaaatcaacgagttcgtcaaactgatgaccggtgcgtacaaagcgtttgtcgaaaatgacttcgccctgtttgaagtcaacccgctggcagttcgcgaaaacggcgcgctcgcctgcgtggacggcaaaatcggcatcgacagcaacgcgctctaccgcctgccgaaaatcgccgaattgcgcgacaaatctcaagaaaacgaacgcgagttgaaagcttctgaatttgacctgaactatgttgccctggaaggcaacatcggctgtatggtgaacggtgccggtttggcgatggccactatggacatcatcaaactgaaaggcggccaacctgccaacttcttggacgttggcggcggcgcaaccaaagaccgcgtggttgaagcgttcaaactgattctggaagacaaatccgttcaaggcgtattgatcaacatcttcggcggtatcgtacgttgcgacatgattgcggaagccatcgtggcagccgttaaagaaatcaacgtcaacgttcctgtcgttgttcgtttggaaggcaacaacgccgaactcggcgcgaaaatcctgaacgaatcaggtctgaaactgacttctgcagacggcctgaatgacgcagccgaaaaaattgttgcagccgtaaacgcctaaggagaaaagaatgagcgtattgattaataaagacactaaagtattggttcaaggtttcaccggtaaaaacggtactttccactccgaacaagctctggcttacggcactaaagttgtcggcggcgttaccccgggcaaaggcggtcaaacccacctgaacctgcccgtgttcaacaccatgaaagaagccgttaaagaaaccggcgcggatgcatccgtgatttacgttcctgctccgtttgtgttggattctatcgttgaagcagttgattcaggcgtaggcttggtcgttgtgattaccgaaggcgtgccgactttggacatgctcaaagccaaacgctacttggaaaccaacggtaacggaacacgtttggtcggccctaactgcccgggcgtgattactccgggcgagtgcaaaatcggcattatgccgggccacatccatactcccggccgcatcggcatcatttcccgttccggtacattgacttacgaagccgtggcacaaaccaccaaactgggcttgggtcaatcaacctgtatcggtatcggcggcgacccgattccgggtatgaaccaaatcgacgcactgaaacttttccaagaagacccggataccgacgccatcatcatgatcggtgaaattggcggtactgcggaagaagaagcagccgaatacatccaatccaacgtaagcaaacctgttgtcggctatatcgccggtgttaccgcacctaaaggcaaacgcatgggtcacgccggtgcgattatctccggcggcaaaggtactgcggaagaaaaattcgccgctttcgaaaaagccggtatcgcttacacccgcagccctgccgagttgggcactaccatgctggaagtgttgaaagcaaaaggtttggcataatcaggtttgacaactgattgaacatcaaatgccgtctgaaaccggaaatcgggtttcagacggcattttgtttgtcatttcaaaaagaggcagcctcaacatacccacattatttttgcccttttggggcagtcagagacctttgcaaaattccccaaaatcccctaaattccctaaattcccaccaagacatttaggggattttggggaattttgcaaaggtctcgggctaagtgtgcctgtttgcgcctaaaaggcggcccggatgcctgattatcgggtatcctgggaggattaagggggtattggggtaaaattagtggatatttgaaacgaaaacagccgaaaacctgtgtttgggtttcggctgtcgggagggaaaggaattttgcaaagctctcgtattggctttgaagttccgtgtaattcacaggtagggcgtgtggcacagccacgcacgcggtcggttgggtatgcaggctacggctttctctgttgaaactgcaacacgtcagctaccaaccgtgtgcgtagcgcacacggttggttgggatacaagttactgtttgttcttaaatggagtaccaacatcaagggcttttgataatcctgaaaatattaaatattcagtttcagtttttattttaggagaaatatttgcataatttctatctttaaagcaccaatggatatatggtttcgtttcatcttctgggttatctaaataagcaataacattcaagtcaaataaaaattgcaaaaactcattagcagtactcataaatttaggtatttccactgatgttgtttgtaagtgctttttcaaacgttcaaatgcttttaaaaaatcactatatttaaatctatctttcccgtttaaaaattcaaaaaatttcaggaaattttgataatcactttgactataataaaacaaaagatgatctttgatttcaccaagtaaatatatcgagtattctctttgaaaagaagtattatcaaaatcttctgctacgacataatcttccttacttttcttatttttttgtagcaaagtaagcatctgaagaatatcgcgaggtcgataatacgattttcttaggaagctaataaatgaagttaaatttttatactcatcatgtaaattaggagcattccatggaaaataataatcccatgagttgcctttttctaaactatcttgtttttcttgctgggttctcaaaagatgatcaaaaacgccaaaaatctttgaacttctataagatttataatccgtcctccagtctaaaaatactgaattatcttgaagtttggtattttgattttgtaaacctaatgaatcaaagatatcaggtctaatcaataacacaactctcatccttcccttactatctttaatggaagggaagatatcattatttaacatccatatggcgttagcaagaccttttacacactcatgatattcatcaaatggaatctgtgatggtctaatatctatcccatcaataaacaaaatatgattatcttttagctttaactgagataaagcatctttaaattttctttcaataaaacctaaatttgcttggaatttactttctgtaaaagttatttgttgggattcctcttcacctagtttaacaaattttccaaaaatcatttccgcagcttcttttgaattttctattaaagttattgcttgtacaatttccggatcaaaagcgccataataatattcatttatagcctcatctaaggctttaaatttattaaatattgaagataatattccgttttctttacatttgatttgatttgatatcaacagatataaaatgactttccaaatacttgtaaaatctgaaacagttaagtgtcttgctttctttagctgaataaattttgaataatcggtttcacgaacaaacttagtagtggcatgtatgtttttatagaagttattagttaaataaacagcatatgctgtctttccagttcccttttctccgattaaaaacgaaatatttggttcacataattcatccaaatattctccttttacaaatattcggttaaataaatctttattttctcttcttctgtagtttgcagcatccacaaatccaaattctaatgtttttaacggtttcatcttaataatctcctatttaattttgaattaaacttacctcaaaaccaccttcaaatacttcccagtataactccccttaactttcgccacctgttcaggactacctttagcaataatcctccccccgccatctccgccttccggccccaagtccacaatccaatccgctgttttaatcacatccagattatgctcgataatcactatcgagttgcctttgcctttcagacggcctatgacttccagcagcagggcgatgtcggcgaagtgcaggccggtggtgggttcgtcgaggatgtagagcgttctgccggtgtcgcgtttggagagttccaaggcgagtttcacgcgttgggcttcgccgccggagagggtggtggcggactgtccgaggcggatatagcctaggcctacgtccatcagggtttgcagtttgcgcgatacggtggggacggcgtcgaaaaattcgcgggcttcttcgacggtcatgtcgaggacttggctgatgtttttgcctttgtattggatttcgagcgtttcgcggttgtagcgtttgccgtggcagacttcgcaggggacgtacacgtcgggcaggaagtgcatttcgactttaatcacgccgtcgccttggcaggcttcgcagcggccgcctttgacattgaaggagaatctgccgacgttgtagccgcgttcgcgagagagggggacgccggcgaagagttcgcggataggggtgaacaggccggtgtaggtggcggggttggagcgaggagtacggccgatgggggactgatcgacgttgatgactttgtcgaggtgttcgaggccgtggatgtcgtcgaatggggcgggttcttcttgggcgcggttgagttcgcgggcggtaattttggcgagggtgtcgttaatcagggtggatttgccgctgccggacacgccggtgatgcaggtaatcaaaccgagcggcagctcaagggtaacgtttttgagattgttgccgcgtgcgcctttgaggacgagcatccggtcgggattgacgggcgtgcgttcagacggcacggcaatggattttttgccgctgaggtattgtccggtaacggagttttcgcattgggcgacgttttcgggcgtgtcggcaatcagtacgttgcctccgtgttcgcctgcgccggggcccatatcgaccacgaaatcggcttcgcggatggcgtcttcgtcgtgttcgaccacaatcacgctgttgcccaaatcgcgcaggcgtttgagggtggccagcaggcggtcattgtcacgctggtgcaggccgatggagggttcgtccagtacatacatcacgccggtcaggccgctgccgatttggctggcgaggcggatgcgctgggcttcgccgccggagagggtttcggcggagcggcttaaattcaggtaatccagcccgacgttaatcaggaagccgaggcgttcggtgatttctttgaggattttttcggcgatttgttttttgttgccgtctaaatccagtgtttcaaagaattggtgggttttggtgagcggccaggcggaaacttcgtgcaacggctcaccgctgacgtaaacgtagcgggcttctttgcgcaaacgtgcgccgccgcagcttgggcaggcgcggtggttttggtattcgcgcagtttttcgcgcacggtttcgctgtcggtttcgcggtagcggcgttcgagattggggatgatgccttcaaaggcgtggctgcggttgaaggtggtgccgcgttcggacaggtaagtgaaatcaatgacttctttgcctgagccgtgcagcacaacttttttcactttttcaggtagtgtttcccaagcagcctgcacatcgaaaccgtaatgccgcgccaatgattgaatcatttggaaatagaattggttgcgcttgtcccaaccgtcaatcgcacctgttgccagcgacaattcgggatgggcgaccactttttcggggtcgaagaaattggtgttgcccaagccgtcgcaagtcgggcaggaacccatcgggttgttgaacgaaaaaaggcgaggctctaattcgggcaggctgtacgaacacacggggcaggcgaaacgtgcggaaaaccaatgttcttcgccgctgtccatctccatcgccagcgcacgctcgttgccgtggcgcagcgcggtttcaaaactttccgccagccgctgcttgatgtccgccttcactttcacgcggtcgatgaccacgtcgatattgtgcttgatgtttttttccagcttcggcacttcgtccaactgatagacctcgccgtccacgcgcacccgcgcaaaaccctgcgcctgcaagtcggcaaagaaatcgacaaactcgcccttacgctcgcgcacggtgggggcaagaatcatcacacgcgtgtcttccggcagtttcaatacggcatcgaccatctgcgatacggtttggctcgacagcggcagcttgtgttcgggacaatacggggtaccgacacgggcgtataaaagacgcagatagtcgtggatttcagttaccgtaccgacggtggagcgtgggttgtggctggtggatttttgctcgatggaaattgcaggcgacagaccttcaattaaatcgacatcgggtttgtccatcatctgcaaaaactgccgcgcataggcggaaaggctctcgacataacgccgttgcccttcggcatacagcgtgtcaaacgccagcgacgacttgccgctgcccgacaatcctgttaccaccacgagtttgtggcgcggaatgtctaaatcgatgtttttcaaattatgcgtgcgcgcgccgcggatgcggatggtgtcgttgtcgtgcgaatgttggggatgatggttgcacataatggatgccgcctgaaaaataaaggaaaaccggtattgtagcactttctcggatgccgtctgaagccgcgttcagacggcatttgccagcggagtacggcagattccgctataatgtcggcaattttaacccgcttgaacaaaaggatgacaaatgaaccgtctttacccccacccgattatcgcccgtgagggctggccgattattggcggcggtttggctttgagcctgctggtgtcgatatgttgcggctggtggtctttgccgttttgggtgtttaccgtatttgcattgcagtttttccgcgaccctgcgcgtgagattccgctaaatcctgaagcggtgttgagcccggttgacggccgtatcgtggtggtcgaacgcgcacgcgatccgtatcgtgatgtcgatgctttgaaaatcagtatttttatgaacgtgttcaacgtgcattcgcaaaaatcgcctgccgattgtacggtaacgaaagtggtctataacaaaggcaaattcgtgaatgcggatttggacaaagccagcacggaaaacgaacgtaatgcggtgttggcgactacggcttcaggtcgtgaaattacttttgttcaagtggccggtttggtggcgcgccgtattttgtgctacacccaagcaggtgcgaaactgtcccgcggcgaacgttatggctttatccgcttcggttcgcgcgtggatatgtatctgcctgtcgatgcgcaggcgcaagtggcgattggcgataaagtaaccggcgtcagcactgtattggcgcgtttgccgctgactgcgccgcaaactgaatctgagcctgaatctgagcctgctttacaaactgctccggttgaaacagcggcaaacccatctgccgaacaacggcaaatcgaggcagcggcggctaagattcaggcggctgtgcaagatgtgttgaaagattaattttgcggactgaaatagaaaatatcagtaccatcattcacacgaatgaggaagtttggttttttgaatttttgctaatgttcacaccgtcattcccacgaaagtgggaatctagaaacttaacgttacgacgatttatcggaaacgactgaaaccggacggactggattcccgcctgcgcgggaatgacgacttattagttacctaacacttaaaaaacagaaacctttccgcgtcattcccacgaaagtgggaatccgggaacttaacgttacagcgatttatcggaaacggctgaaaccgaacgaattggattcccgcctgcgcgggaatgacaactcattagttacctaaaacttaaaaaacggaaacctttacgccgtcattcccacgaaagtgggaatccgggaacttaacgttacagtgatttatcggaaacggctgaaaccgaacgaattggattcccgcctgcgcgggaatgacaactcattagttacctaaaacttaaaaaacagaaacctttacgccgtcattcccacgaaagtgggaatctagaacccaaatgctaaggcgatttatcggaaacggctgaaaccgaatgaattggattcccgcctgcgcaggaatgacaactcattagttacctaaaacttaaaaaacagaaacctttacaccgtcattcccacgaaagtgggaatctagaacccaaatgctaaggcgatttatcggaaacggctgaaaccgaatgaattggattctcgcctgcgcgggaatgacgacccattagttacctaaaatttaaaaaacagaaacctttccgcgtcattcccatgaaagtgggaatctagaacccaaatgctaaggcgatttatcggaaacggctgaaaccgaacgaattggattcccgcctgcgcgggaatgacgggatcttgggtttctgcttttgatttttctgcttttgcgagaatgacggcgtgaaagtaagaatgatgaaacaaaaaaaatgggaatgatggcatagtggtttgttctttgtctttgccatatttcctaacaaattgattaaaaagaaaaaaggttttcagaatgccgtctgaaaaccttttttgtttgcctgtccgattttaaaacttcacgttcacgccgccggtaaagctgcggcccatttgcggcgtatcagagagaaagctgctgtgggcgtaaacggattggttgagcaggttgtcggctttgacgtaccaattccactcgccatagcgcgtattgcggcggtagtttgcgccgaggttgagcatatggtgtccgggcgtgcgcgtttcgtagcgggcgagtttgttttgggcgaacacgcggtagtagtccaaattggcatcgatacggtcggtcagcgaggctttcaggtggaagccgaggcgcgcagccggaacacggggggcattttggtcgtcctgtgcgatgaaaggacggttgccgtaggcatcttctctgccgggtagggaaggcaggtttttcagacggcctcgtacatagtcgccggaaacgccgatgcggtagcgcggtgtcggtttgaagtagatttcgccttccgcgccgtagaagtcggcgccggattggttgtagcgcacgagcttcatttcgctgtcgtcttcgatggatttggggccgcgtccgtcgtttaaggtttgggcgtaaatgtagttaccgaagcggttgcggtagagtgccagattgtattgccagcggtcgccttcgtagcccagcgcgagttcgatattgttggaacgctctttgttgaggtgtttgttgccgacttcaaaggtgttggtggcgacgtgtttgccgtgtgcgtacagctcttgcgttgacggcaggcgttcctgatgggaggcggtcaggctgagtttgtgttgtggcgtgaaataccagttgcccgaaagtgcgaatgagcgggcggtttggcggtgcgcgccgaggtcgggcagggggtggttgtagtagttttcccgatcaatcaatgctttgtcgtactgaatggaggctttttgtttttccacgcgtacgcctccttcaagcgtgaagttgtcccagtttgcctgttctacaccgaaaaagctgtaatgttgcactttgttgtcaagcagcatcggttgtttaaccgcttcggatatggcagataaagcactggatttttgttgtaaatattgcacgccccagctgcctttcagacgacctatgggttggtggcgcaactcgatgcgggcgttttgcgtttggttgttaaaaaagttttcgactgcatcgcctgctttttcgtcgtggcggtagtcgttgcggttcaggtgtacgcgcagggcttcaaaaccggggaacggttgcttccattcggcacggagttcgtagcgtttgttgcgcaggtctatccacggtctgccgctgtgggtgtgtgcgtgtgcattatcgtcgtcgtggaagccgcagctcaagcccggattgtcgtaatcgatgtcttcttcggtcaacaggtgcggataaagctgtaaatagcgtttgttaatcaagctcttttgccagatgatgtcggcgtggcaatcatcgtattcgtggctgtgggcaggcagaccatattggtcgcgacggtcgctgtacgctacgccgataaaacctttttcgccaacccaagacagcccgatgctgcccgtttgcgaatcggcgtggctgtcgggcaggcgtttcagattgcggtaacgcggtacggcgtaatcccccgatttgcggtacagcccttccgtgtgcaatacaaagtttttgcccaaaccgatattgatgccgccggacgtgagtttttccagattgccgctgctcaaacgcaatccgagttcgcccgatacgccgttttcaggcattttttcggggattttgccatcggcaacatcgaccagccccgccacattgcccgagctgtacaagagcgtaaccggcccgcgcaggatttcgacctgttgcgacaaggcggtatctaccataatggcgtgatcgggcgaaaaatccgccatatcgcctgtttcgccgtgatggttcaacactttaatccgcctgcctgtttgaccgcgaatgacgggagcagacgcgccgccgccgtattgcgaagcgtggatgcccggtacgccgtctaaagcgtcgcccaagttgacggctttttggcgcaaggtatcgccggagatgattttgtcggaggcggtcgaagtgtgcaacagccccgacgtggcgcgcggacggcttttgccgacgacgctgaccgtttccaaatccaccgattgctcagttttatgcgg

SEQ ID NO: 48 - DNA, 48275 bp, Neisseria meningitidis
tagtggattaacaaaaaccagtacggcgttgcctcgccttagctcaaagagaacgactctctaaggtgctgaagcaccaagtgaatcggttccgtactatctgtactgtctgcggcttcgtcgccttgtcctgatttttgttaatccactatatcgatttgaatttttcagaaaatgaagcggacgtttgggcggaggcaacttgtttgataagatagcaatattttaaaacggagaaagatcatgccttatgtcaatattaaagtaaccggcggcaaggaagcaccgactgccgcgcaaaaagcggaactgatcggcggcgtaaccgaattgctggcacgcgtgctgggcaaaaatcccgaaacaacggttgtcgtgattgacgaagtggataccgataactggggaataggcggcaaaagcgtcagcgaacggcgcaaagagggcaggtaaaaagcctgaaaatctcggtttgatgctttaaattccgcgtgaaaaagagtacattcccacccattgcccaaaatttacggaacacatcatggataaatttcccaagtctgcaaagctcgatcacgtctgttacgacatacgcgggccggttcacaaaaaagcccttcagttggaagaggagggcaataaaatccttaaactcaatatcggcaaccctgcgccgttcggctttgaagcccctgatgaaatcttggtcgatgtcatccgcaacctgccgacttcgcaaggctattgcgattctaaagggctgtattccgcccgcaaagccattgttcactactatcagaccaaaggtttgcgcgatattacggttgatgatgtctatatcggcaacggcgtgtccgagctgattacgatgtctatgcaggcattgctcaacgacggcgacgaaatcctgattcccgcgcccgactatcccttgtggacggcggcggcaacgcttgcgggcggtacggtacgccattatctgtgcgacgaagaaaacggctggttccccaaccttgccgatatggaagccaaaatcacgcccaaaaccaaagccatcgtcgtcatcaatcccaataatccgacaggcgcggtgtacagcagggaaatcctgttggaaatcgccgaactggcgcgcaagcacggtttgattattttcgccgacgagatttacgacaaaatcctttatgacggcgcggttcaccaccacatcgccgcgcttgcccccgaccttttgacggtaacgttcaacggtttgtccaaagcctaccgtgtagccggattccgccaaggctggatggtgctcaacgggccgaaacatcatgcaaaaggttacatcgagggtttggatatgctctcgtctatgcgcctgtgtgccaatacgccgatgcagcacgcgattcagacggcattgggcggctatcagagcatcaacgaattcattttgcccggcggacggcttttggaacagcgcaacagggcgtgggaactggtcaaccagattcccggcgtatcctgcgtcaaaccgatgggcgcgatgtatatgttcccaaaaatcgataccgaaatgtaccgtatccgcgatgacatgaaattcgtttacgatttgctggtgcgcgaaaaagtcttgctggtgcagggaacggggtttaattggatcaagcccgaccatttccgcattgttacgctgccttacgtccatcagattgaagaggcgatgggcaggctggcaagattcctgcaaacctaccgccaataaggggacggtttgtctgccgaggataaaaaatgccgtctgaaacggagattcccgtttcagacggcattttcaacagcaggaacgaatcaggcaaatttcagtctgtcgccgtcggcttccaccctgatttcgctttcgggcgcatagtttccggcaagcagggcttttgccagcgggttttcgatttccgactggatggcgcgtttgagcggacgtgcgccgtaaatcgggtcgaaaccggctttggcgatgatgtccagtgcggcatcggaaacagccaggcgcaggttttgtttttccaaacgtttttccaagcctttgagctggattttcgcaatgttgcggatattatcctgatccagtccgtggaacacgaccacttcgtcgatgcggttgatcatttcggggcggaaatgttctttcacatcctccatcacaacttctttcaccgcttcgtaatcctgaatgcccatttgttggatatgttggctaccaatattggaagtcatcacgataacggtatttttgaagtccacggtgcgaccttgtccgtcggtcaagcggccgtcatccaatacttgcagcaggatgttgaacacatcgggatgggctttttccacttcgtccagcagaatcacgctgtacggtttgcggcgcacttgttcggtcaggtagccgccttcttcgtagccgacatagcccggaggcgcgccgattaagcgggcaacggcgtgtttttccatatattcggacatatcgatgcgaatcagatgatcttcgctgtcgaacagaaagcctgccagggctttacacaactcggttttacccacgccggtcgggcccaagaacaggaagctgccgtaaggcttgttcggatcggcaagaccggagcggctgcggcggatagcgtcggacacggcacgcacggcttcgtcctgtccgaccacgcggcggtgcaatacttcttccattttcagcagtttgtcgcgttcgccttccatcattttggatacgggaatgccggtcatacgggaaaccacctctgcgatttcctctgcgccgacattattacgcaagagtttgtttgccggttttgtgctgtccgtatctgcccgttcggcggctgcacgctgtttttccaaatgctccaaatcttcatacatcaattttgaagccagtgccaaatcgccttgccgttttgcctgttcgattttaattttgacttcgtcaatttgtttcttaatattagcagcaccgtctgaaattgctttttcggctttccagatttcgtctaaatcggcgtattctttttgcagaccgttgatttcctcgtctatcagttccaaacgttttttgctggcatcgtctttttctttttcaacgtgcgccttttccatccgaagctgaattagacggcggtcgattttgtccattgcttccggcttggtttctttttccatcttgacacggctggcggcttcgtcaatcaaatcaatcgctttatcgggcaggaagcggtcggtaatgtagcggtcgctcaactccgctgcggcaacgatagcagggtcggtaatatcgataccatggtggatttcataacgctcctgtaaaccgcgcaaaatagcgatggtgtcttccacgcttggctcgccaaccaatactttttggaagcggcgttcgagtgccgcatctttttcgatgtattggcggtattcgtccaaagtggtcgcgccgatacagtgcaattcgccacgtgccaaagccggtttcagcatattgcccgcgtccatcgcgccgtcggttttgcccgcgccgaccaaagtatggatttcatcaatgaaaatcagagtgttgccgtcgtctttcgccaaatcgttcaacacgcctttcaagcgttcttcaaattcgccgcggtatttcgcgccggcaatcaaagccgccaaatccaaaaccagcaagcgtttgttacgcagggattcaggtacttcgccgttgacgatacgttgcgccaagccttcaacaatggcggttttacccacacccggctcaccaatcagcacagggttgtttttggtacggcgttgcaatacctgaatcgcgcggcggatttcgtcgtcacgaccgataacggggtcaagtttgccgtcgcgggcgcgctgggtcaggtcaagcgtatattttttcaaagcatcgcgttggtcttcggcattggcatcgttcacgttttgtcctcctcgtactgcgtcaatcgcggcattgatgttttgttcggtcgcgccggcttctttcaaaattttgccggtcgcatcgttctgctgtaccaaggcaagcaggaaaagttcgctggcaatataggcatcgctgcgtttggtggcagctttgtccatcaggttcaacaccgcctgcaattctcggctgggcagaatatcgccgccctgaccggacactttcggcaggctgtttaaatgctgctgcaaacgctgtttcacctgcggcacgttcacgcccgcatgagccaagagcgcggcggctccgctgttttggtcgtcaagcagggcttttaacacaaagcccgcttccagatagctgccgtccgcagccaacgccaaactctgagcttctgcaagggcttgttggaatttggcggttaatttgtcgtatcgcatttttgtttccttttcaaaatgtccgctgtcgaagcctatatgtgcataattgtggataactcaagttctgttttctgtttttctatatttaattcgatatatcattgaatttaaagtatataaaaatgtataataatgtgtataactatatcttcttaatatggaaaagtctgttgtcggctggatgtaggtggcaaatcgggtataatcggcacatctttttccctttcagacggcattgatgccgcaaggacatttttatgagcaaaaaacgagttctgaccggcgtaaccaccaccggcatcccgcatctgggcaactacgtcggcgccatccgccccgccgtccgcgcggcgcaaaacctcgataccgaatccttcctcttcctcgccgattaccacggtatcatcaaatgccacgagccggagatgattcaccaatccacccaagccgttgccgccacttggcttgcctgcggactcgaccccgagcgcaccaccttctaccgccaaagcgacactcccgaagtgatggaattgaactggattctgacctgcatcactgccaagggtttgatgaaccgcgcccatgcctacaaagccgccgtgcaggcaaatgcagaaaacgggcaggaagaccctgatttcggtgtggaaatgggtttgttcagttatccgattctgatgactgccgatattctgatgttcaacgccaacgaagtgcccgtcgggcgcgaccaaatccaacacgtcgaaatggcgcgcgacatcgccggccgcttcaaccaccgcttccgggaactcttcaccctgcccgaagtgaaaatcgatgaaaacgtcgaactcttggtcggtttggacggacgcaaaatgtccaaatcctacggcaacaccattccgctttgggaaaacgacaaaaaaacccaaaaatcggtcaacaaaatcatcaccaatatgaaagagccgggcgagccgaaacagcccgacgaaagcccattgtttgaaatctacaaagccttctccacgccgtctgaaacggtggaatttacgaaaatgcttgccgacggcttggcgtggggtgaagccaaaaaacttttggcggcgaaaatcaacgccgaactcgccgaaccgcgcgaacgctacaacgagctgaccgccgacccttcgcaaatcgaagagattttgcaggcaggcgcggcgaaagcgcgtaaagaagcacgcgaattattggacaaagtacgcgatgcggtcggcatccgcccgttgaaatgaacccgatgccgtccgaacctccgcctgccgcgtttcagacggcattttgaaaccatcaggagtgtggaatgctgaaaacatcttttgccgtattgggcggctgcctgctgcttgccgcctgcggcaaatccgaaaatacggcggaacagccgcaaaacgcggtacaaagcgcgccgaaaccggttttcaaagtcaaatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattgaggtattcggacatcccggaatatatttgggtttttcaaaccctgcaggaaaaagtccgcaccgtcgggaaactcaaaaggagggggatatgtgttacaattttccgaactgttttcataaaatagttttcggacgtgtttcaatatggcattgatgccgccttattgttcgagaaaaaaacctttatatttaaatataatgggttttaactaaacgggaaaccgttttctctccggtcgatgggcaaaatcagccgattgatggaacacggtccgatttttaagcaaaaccttaatcaacaactcaagaaggataagacatgaaaaaattattgattgccgcaatgatggcggctgccttggcagcttgttcgcaagaagccaaacaggaggttaaggaagcggttcaagccgttgagtccgatgttaaagacactgcggcttctgccgccgagtctgccgcttctgccgtcgaagaagcgaaagaccaagtcaaagatgctgcggctgatgcaaaggcaagtgccgaggaagctgtaactgaagccaaagaagctgtaactgaagcagctaaagatactttgaacaaagctgccgacgcgactcaggaagcggcagacaaaatgaaagatgccgccaaataatttgttgccttggcaaaaatgatgggatgccgcctgccggcaacccaaacgaaaccgcctgaagattttcaggcggtttttgggttatgtgccccttgttttttacgcctgcatgaccgttccgagcagatgtgccgcgcatatcgggatgttgcggacaggcaaatgccgtctggacagggtttggacggcatttgttccgcaaggttcagacggcctcgactttgaacggcatattgattttttgccattggacgctttcatattccaatgcgtcggcaatcaggggatggcgttccagccattccctgtcaatacgcaggatgaagccgcagctttccgtatccgtgcgcaactgcatatttttcgggaaagacaggtcttggcgcgaacggcagaacagtgcggcaaggcgcagggacaaaacggcataccacaacatttcgttggtgccgatgatgccgctcatttttttcatatcgccgcgatgaccgatgaccagttgggcaagtatggtctgttctttgcgtgagaaacccggcatatcggcgttttcgaggatgtaggcggaatgcttgtgatagccggtgtgggcgatgtccaaaccgatttcgtgcagcgcggcggcgcgtccgagatactgttgccacaaggcaagctcttgaactgtaacgtttttagcgtggcagaggctgtccataaaggtttgcgcggtctcggcggtgcgtttcgcctgattgaggctgacgtggtagcggtgttggaactcggcaaccgtttgtccgcgcatatcttcgtttaaaccgcgcccgatcaaatcgtaaaacacgccgtcgcgcagggcggcttcggttacggtcatcctgtcgagtttcatttcctcaaacgccgccatcatcacggcaagtccgccggcaaaaacttcgatgcgttccggtttcaggttttcaaatttggcttttttgaccgaaccggcttcgatgatgcgttcggcgagggcgcgcatgcctttgtaggtaatgtccgcctcttggggcatttcggcggcaagcacgtcgcggatggattttgccgaacccgatgtgccgacggcgaaatcccaaccttcgcgcctcatatttttgctgatacgctggatttcgttgcgggcggcggaaatggcagattggaagtctttggcggtgattttgttttggaagaagcgcaggctgtaggttacgcagcccaagggcaggctttcggtaatgtcgggattcagcgtcgagccgatgacaaattctgtcgaaccgccgccgatgtcgataaccagcattttgccgccgcccggggggagggtgtggatcacgccggtataaatcagccgcgcctcttcgcgcccggcgatgatttcgatggggaaacccaatgccgcttcggctttgggaaggaaatctgcgatgtttttggcaacgcggaatgtgttggttgccacggcgcgtacctgttcagggcggaagccgcgcaggcgttcgccgaattttgccagacagtccaaagcctgttcttgggaagcggcactcagatttttctgttcgtccagtccggcggcgaagcgcaccatctgtttgaacgaatcgatgacttttaattgtccgttgttgttttcgcaaatctggaggcggaaactgttggaacccaaatcgacggaggcgaggacgtttgcgggggtggtggtcatggcggataccggtgggggaaaaacgcaatgttactctgacggcgcaggcgttgacaataaatgatgcggcggtttttgattctgcccacggatgttgccgacggcattttttgcgcttatttgaaatccttttccacgctcatgaaaatctgcatgtttttgcgtgtgtaaaaacttttcatattgctgtcgattttcagatagcggaaattgagttgcggcgtaaagcccttccaagagattttgtcatgccacaacgacaggtttgcctgatattcgtggtctttgcgcgggaagcggtacacaatggtcccgggtgcgtcaaacatcctgcgggtatagcgcaggtttgcccgcagacccaagccgccgtcgaacgttttgaccgcgccgacacgcaaacccttgcggatggaagcctgttccgcctctttcgttatgttgtgcgaccagtccgcaccgccgtaaagcagccagtctttcggcgcggaatacatcagcgtcgcgcccgccagcggcatatggctgtcgtatcgggcggcggtgcggtcttcctgataatgcttccacatattgcccgcgtttagtgtcaaccgccagcgttcgctcaagcgttgggagaaatcggcattgaagccgccgacgaaattgtatcggctgccgcctaagaggttttgctcgacaaacggcacgatgccgaacgagcgcgttaccgaacggtttttatagccgaacgacaggcgcaggctctgttcgctgaaatctttgttatcccaataatgcacgccgccgccgctgatgccgccgtagaggaaatgatgcctgcccgcattgatttcgcgcgacacgcctaagccctagcgcaaaccgtgtgccttttgcggcaggctgtcggcggttttcgtccagcttctgcccgcaaattcaatcgttttttcggacgaagcgttgtttatagcggattaacaaaaatcaggacaaggcaacgaagccgcagacagtacaaatagtacggaaccgattcacttggtgcttcagcaccttagagaatcgttctcttttttgttcatccgctatattgtgttgaaacatcgccacaaacctgatatagtccgctcctgcaacatcattgaaaatctttctttttaatcagttaaaaccgaatacggagccgaaaatgaatccagcccccaaaaaaccttctcttctcttctcttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgaaagcaaccggtgcaaacaacacaagcacagtaagcgattatttcagaaacatccgtgcgcattccatccacccccgggtgtcggtcggctacgatttcggcggctggaggatagcggcagattatgccagttacagaaaatggaacaacaataaatattccgtaaacacaaaagagttgcaaaaaaacaatagcagtggcatctggcaagaactgaagacggaaaatcaggaaaacggtacattccacgccgcttcttctctcggcttatccgccatttacgatttcaaactcaacgataaattcgataaattcaaaccctatatcggtgcgcgcgtcgcctacggacacgttaaacatcaggttcattcggtgagaaaagaaaccacgactactttcagtccaccagcgcaaggcgctacagtgccaggcaaaatcgtacaaggtccgaccaacaaacctgcctatcacgaaagcaacagtatcagcagcttaggtcttggtgtcatcgccggtgtcggtttcgacatcacacccaagctgactttagacaccggataccgttaccacaactggggacgcttggaaaacacccgcttcaaaacccacgaagtctcattgggcatgcgctaccacttctgattccccgacaccgatgccgtctgaaccttcagacggcatttttgattcacctgccgtttacaggcgcggggcgggcgtggaaatacccgaaccgtcattcccgacaacaccgtaatcttgaaacccgccattcccgacaataccgcaatctcgaaattcgtcattcccgataataccgcaatctcgaaattcgtcattcccgcgcaggcgggaatccagactccctgacgcggcgggaatctatcggaaatgactgaaaccccgggattctagattcccactttcgtgggaatgacgtggtgcaggtttccgtatggatggattcgtcattcccgacaataccgcaatcttgaaacccatcattcccgcgcaggcgggaatctagaccccctgacgcggcgggaatctatcggaaatgactgaacccccgagattctagattcccactgtcgtgggaatgacggttcagttgcgttccgacaacaccgcaatctcgaaacccgtcattcccgcgcaggcgggaatctagacccccgacgcggcgggaatctatcggaaatgactgaaaccccgggattctagattcccacttccgtgggaatgacgtggtgcaggtttccgtatggatggattcgtcattcccgacaacaccgcaatcttgaaacccgtcattcccgacaacactgcaatcttgaaacccgtcattcccgcgcaggcgggaatccagaccccctgacgcggcgggaatctatcggaaatgactgaaaccccgagattctagattcccactttcgtgggaatgacggttcagcaagcgtaggtcggatacttgtatccgacaaaacctttaacattcccatcattgcaatccattgcagcaatgcccaaaatgtcgaattcaagaatccgacctacaaaatcattccgagcataatactatgaaataccgtcgtttttaccgcaatggcggcacttacttttttacggttgtaaccaataaacggcagaagattttgaccgatgatgcggtgcgtttggctttacggcaggcggtaatggcggtgcgcgaacggtatccgtttgaaattttggcatgggtgttgatgcccgaccatctgcataccatatggcggctgccggacaatgattctgcttattcggaacgctggcggcaaatcaagcggcacagccaatatttaatcggcggcaatctcaggctttggcaaaaacgcttttgggaatatactatccgcgatgaggccgattttgcctggcattttgattatctgcatttcaatccggtcaaacatggctatgtaggacaaatttccgattgggggttttctacgtttcaccgttatgtcaaacagggtatttatccgcataattggggtggcggcaatgcggacttttctattggatacgattgaagtaatgtcggattcgagaatccgacctacggaaaactgaaagagcatcggttgcagaacggcattatgcgcaaagcctgccgcaaccgtccgctgacggaggcgcaaaccaaacgcaaccgatatttgtcgaaaacccgttatagtggattaaatttaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatgtggtcgaacagagcttcggtacgctgcaccgtaaattccgctacgcccgggcagcctatttcggactgattaaagtgagtgcgcaaagccatctgaaggcgatgtgtttgaaccttttgaaagccgccaacaggctaagtgcgcccgctgccgcctaaaaggtgccccggatgcctgattatcaggtgtccgggcaggattaaaggggtatttgggtaaaattaggaggtatctggggcgaaaacagccgaaaacctgtgtttgggtttcggctgtcgggagggaaaggaattttgcaaaggcctcaagatatagtggattaaatttaaatcagtacggcaaggcgaggcaacgctgtactggtttaaatttaatctactatatttccgcctgctgccgcccgaaaagcgtgatgcgctgatggtgctgctgcataatccggacgacggataaccggtgaaaacggaaatgcccgggcggtgttgcctgtgcctgtttggacaagcgttcttgagggcggtagaattgaggtttgcccgaaaagggcagggcgatatgccgcgcttggattttgcgcgcggtttttcgcgttgaaagcaattatgtctgtttgaatatttaatgccgtctgaaacgtccggacgcgcccccgttccctatgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttgattttgaacccgcgccgcaaccgaaatacggcgaatcctgtataatccgaaaatctgttcactggaagttcagacggcattgcaactgttgatgccgtctgaaaaaatatgatggcaagagacaaccgcatccaaatgtttccgcacgaatggcgcgccagtacgacgctttccggcgtgtacgcgctgcgtatgctgggtatgttcctcgtgctgcccgtattggcggtgtatgccgcctcgctgcccggcgcggaaggcaacaaaacgctggtcgggctggcaatgggcatttacgggctgacacaggctctgctgcaactgcctttgggcatcgcttccgacaagttcgggcgcaagaaaaccatttatgcgggactggtcgtgtttgcggcgggcagctttcttgccgccgccgccgatacgctgcccatgctggtcgccgcacgcgccatacagggtgcaggggcggtcagtgcggcggttaccgcgctgctggcggatttgacgcgcgacggcgtacgtacccgcgcaatggcgatgatcggtttgagtatcggtttgacgttttcggtcagcctcgtcgttgcccccgtgattgccgacgcggtcggcgttcgcggactgtttatgctgaccggcattctgaccgtcatcagcatcggcgtggtggcgtggatgactcccgatcccgaagtttccaagctgcacgaagatacgcaggcgcagccttcgcgcataggcgaagttttgaaaaaccgtaggctgctgacgcttgatttcggcattttcgccctgcacgccgcacaaatggcattgtttaccgcgctgcctttcgcgatgacccagctcggtttggaaaaaatacagcattggaaagtctatctgccttcgaccattacgggcttggtggtgatggttccgctgattatcgtcggcgagacgcgcaacaagcttaagcaggtttttgttttgggtatcgtctgtattgcggcggcgcagctcggtttgctgtccggtatgcgctcggtaggcttgattaccgcttatttggttgtttactttatcggttttaatgtgttggaagcgagcctgccgtctatggtttccaaaatcgcgccgtccgacctgaagggtacggcgatgggcgtgtacaacacgatgcagtcgctcggactgtttgccggcggcgcggcaggcggtttgctgtttcaaaaatacggcttttccggcgtgtttgccttttgcagtatattgatgctgctgtggctggtaattgccgttttatcgcctgcgcccaagcccgtcaaaaacctcagttaccctgtcggcggcgtgtggcagggcaatcaggaagggttataccgcgccttgtcggagcttgagggtgtggaagacatcggtttcagtttcgacgggcagaccgtctatctcaaagtgttgcagaagggtttcgatcaggctgccgctgaaaaaatcatcacaggagtttaaaaaatgtcattgaacaaagtcatcctcatcggccgcctcggacgcgatcccgaagtgcgctatatgcccaacggcgaggcggtttgtaatttcagcgtcgccaccagcgaaacttggaacgaccgcaacggccaacgtgtagagcgtactgagtggcacaacatcaccatgtaccgcaaactggcggaaattgccgggcaatacctcaaaaaaggcgggctggtttatttggaaggcagaatccaaagccgcaaataccaaggcaaagacggcatcgaacgcaccgcttacgatattgtcgccaacgaaatgaaaatgttgggcgggcgcaatgaaaacagcggcggtgcgccttacgaggaaggttacggtcagagtcaggaggcttaccaacgccccgcgcagcaaagccggcagcccgcctccgacgcgccgtcccatccccaagaagcaccagccgcgccgcgccgccaacccgtgcctgccgccgccccggtcgaggacattgacgacgatatcccgttctgaattttacggccggacatcctcgcggagggaaatcataaaggacggagaaaccttaaaccttacggggcagggtttctcttttttgcatttgggccggcttgttgccgccctttgcgttgggcggaacgttgcgattgcgccgttcgggcgttttgaggcagtgatgcctgccgcacgtccccgctgttttcagacggtatagtggattaacaaaaatcaggacaaggcgacgaagccgcagacagtacaaatagtacggaaccgattcacttggtgcttgagcaccttagagaatcgttctctttgagctaaggcgaggcaacgctgtactggtttttgttaatccactatattttaaaattcaggcggtgttttcaaatagcgcgaagcaatagccgagcttcagccggtttgtttgaaatcaaagggttggaatcaaacgccaaacgcttgaaccatcattgcccgatgcggcaaaccggcatcgtccggcaatacggttgtttaaaaataggaaaatcaggatggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcactgggcgggcggctgccgaagcggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgcaggcgcactgatcgtggtcgggggtgcggttacggcggcggtgggggacaggctgttcaaacgccgctagtttgcaggcaacggaaaatgccgtccgaacgaggtttcagacggcattttatttgagggaaggattagcgcggatgaaccatatcggcaggaacgaccagttcgtcaaattcttcgcccgtcagcaagcccaactcaacggcggtttcgcgcaacgatttgttgtttttgtaggcggttttggcgactttggcggcgttttcgtaaccgattttacggtttaatgcggtaaccagcatcagggaatggtgcaggaaatagtcgattttttccggcacgggttcgatgccgatggcgcagtgttcgttgaagctgttgcacgcgtcgcccaacaggtggatggattgcaagaggttgtaggcgataacgggcatatagacgttcagctcgaaattgcccgacgcgcccgccataccgatggtaacgtcgttgccgaacacttggcagcacaccatcgtcattgcttcgcattgggtcgggttgactttgcccggcataatggacgaacccggctcgttttcggggattttgatttcgcccaaaccgcaacgcgggccgcttgccagccaacggatgtcgttggcaattttgttcaggcttgccgccagcgttttcaatgcgcccgaagcggcaacggcggcatcgcgtccgcccagggcttcaaatttgttcggcgcgctgacaaacggcaagccggacaattcggcgagtttggcggcggctttttcggcgtattcgggatggctgttcaaacccgtgccgaccgccgtaccgcccaaagcaagttcatacaagtctttaagcgcatcgttcagacggcctaaaccgtgatcaagctgggaaacgtagccggaaaattcctgtcccaaagtcagcggcgtcgcgtcttgcaagtgggtgcggccgattttgacgataggggcgaaagcttgggcttttttgtccaacgtgtcgcgcagggcttttacggcggggatgaggtggcggttgatttcaatcgcggcggcaacgtggatagcggtcgggaatgcgtcgttggtcgattgcgcgtggttcacatggtcgttgggatggacgggctgataagccgccaaacccgtaccggcgatttcgttggcgcggtttgccagcacttcgttcatgttcatattggactgcgtgccggaaccggtctgccacactaccaatgggaactgcccgtcgagcttgccgctcaacacatcatccgccgcctgcgtaatcaaatccgcctgttcaggcttaatcctaccgagggaaacattggtggcagcggcggcttttttcaccaatgccaaagcataaatcaacggctgcggcagggtttcgccaccgattttgaaattgttgcggctgcgctgggtctgcgcgccccaataggcttcggatgggacttcgacattgcccatcgtgtcgtgttcggtacgggtgctcatgcgtttctccttttgaaatgtgaataagagtgattcgcaaatattataatggagattggtgggatgagaaagcatcatggccgcgagaatataaaaatgccgtctgaagccctaattggtttcagacggcatttgtttaggtgtggggttacagcacggatttcaccgtatcaaccacattgtccacggtaaagccgaatgctttgaagagtaaatcggcaggggcggattcgccgaagcggttgatgccgacgactgcgccgttcagtccgacatatttgtaccagccgtcggcgtgtccggcttctacggcgatgcgcggcaggccttcgggcaggacggcggcttgataggcggcgtcttggcggtcgaatacgttggtggacggcatggaaacgacgcgcacggcgatgttttgcgcggcgagggctttttgcgcttccaaagccagctcgacttctgagccggtggcaatgatgacggcttgggcgttgccttgggcttcgctgatgacgtagccgccgcgtttgatgtcgttcagttgttgctcgctgcgcgcttggaatttcaggttttgacggctgaaaatcaggcaggacgggtgatcggcggctttgacggcttctgcccaagccaccaaggattcggcggtgtcgcacggccgccatacgtccatattcggaatcaggcgcagggtggcggtttgctcaatcggttgatgggtcgggccgtcttcgcccaaaccgatggaatcgtgggtaaacacaaatacagggttgattttcatcaacgcagccatacgcagggcattgcgctcgtattcgctgaacatcaggaaagtcgcgccgaagggttttacgccgccgtgcaataccaaaccgttcataatcgcacccatgccgaactcgcgcacgccgtagtggatgtagttgccgcctttgtcgcgggtaacggagacgctgtttgaccagtcggtcagattggacggggtcaggtcggcagaaccgcctaccaattcaggcaactcttttgccaagatttcgatgctgttttggctggctttgcgggtggcgatggtttcggctttggcgcacacttctttcaatgcggcttgaacgtattcatcgaaattgtccggcagctttttatccatacggcgcacaaattctgcggcttcggcaggatatttggcttgatattgcgcgaacagttcgttccagtcggcttccagtttcgcgccttgttctttggcattccacgcatcgtaaatttcttgcgggatttcaaaggcggggtaagtccagcccaaatgtttgcgcgtggcttcgatttcgtccgcgcccaaaggtgcgccgtgggttttgtggctgccttctttgttggcactgcctttgccgattaaggttttgcagcagatgatggacggtttgccggtttcggcacgtgcggcttcgatggcggcttgaatggcggcggtgtcatgaccgtttacattgggaacgacgtgccagccgtagctttcaaagcgttgcgggatgttttcggtaaaccagccgtccactttaccatcaatggaaatattgttgtcatcatataaaacaatcagtttgcccaagcccaaggtgccggcgagcgaacaggcttcgtgcgatacgccttccatcagacagccgtcgcccataaagacgtaggtgtaatgatcgacgatgttcaaaccgtctttattaaattcggcggcaaggattttttctgccaatgccatacccaccgcgttggcaatcccttgccccaacgggccggtcgtggtttccacgccgtcggtgtagccgtattcgggatggccgggggttttgctgtgcagttggcggaagtttttcaagtcttcaatgcttaggttgtagccggtcaggtgcagcaggctgtacaacagcatagacgcgtggccgttggagaggacgaagcggtcgcggttgtagaatttggggttggcggggttgtgattgaggaatttcgtccacaatgtttccgccatttccgccatacccataggcgcgccggggtggccggaattggctttttgaacggcatcggccgagaggaagcggattgcgtttgccagttgagacattttgtattttccttgctggtgtttcagataagtggataatcggaaagcgttgattatcgcccgattcgcttatgctttcaagaaaagggcggacgcgtgggaaggcggcggcaggggacaggcggggaaggattttcgatttgcgggcgaagcctgccattattccttttgaaataaaaagttatagattgtgtgccggattgtcgatagcgtttgtttatgagcttgcgccgtcggttctgccgatatgggggtgtcggtttttttagtctttttttttaaccgtattcggattttgttcgggcggtaaggtaaaatccaggcgttttgatgcggatgggaaatgtatccgccccatacatccggacggcgcataaagttgtacaatagcggaaatatattttgggaaaaacggattttctcaaaacttgaaacacaacgccttaaaaaacaagaaaaatgacgtctgaaaagcaaacggcggcggtaacgggcaaaccatcaatcaaaaatctaaggaatgcagaatgaccacggaaaaccaagccggcagtccggcatccggaatcggcacgtccgaacaaacaaaagccgcgccgaaagcaaaaaaaacattcgatccgcgagccagcgtgattcaaatccatcccgaaggcgaacgcatccatcccaaaaaggcggaaggacggttcgccaaactgcgtatcgccgccgtattggcgacgcagtttgtgttttacgtcattccgtggttcaactggagcggcaggcaggccgtcgttttcaatatccccgaacggcatttcttcattttcggattgtcgttgggggtgggcgatttgatttaccttgccttgctgctgatgatttgcgccttcgggctgttttggtggacgacgattgcagggcgactgtggtgcggctattcctgcccgcaaacggtttacaccgaaattatgctgtggattgacaacctggtcgaaggcgatagaaacaaacggctgaaactggaaaaatcgccgtggaatttcactaaaatccgcatcaaagccaccaaatacctgctgattttccttgtctgcgcgtggacgggcatcacgtttgcaggctggtttgtccctatccgccagttcgttcccgatttattcactggagcagcaggtggcggcgcgatgtttgccgcagcgttttatggctttatgaccttcttcttcgcccacattatgcgtgaaaaagtatgcctgcatatgtgtccgtatgcacgtttccaaagcgcgatgttcgacaaggacacgctgattgtttcttatgacgcggaacgcggcgaaccgcgcggcgcgcgcaagaaaacggtcaataaggaagaggcgggtttgggcgactgcatcaactgtgcgatgtgcgtccaagtctgccccgtcggcatcgacatccgcaacggtctgcaataccaatgtatcggctgcgccgcctgtatcgacgcgtgcgatgagattatggacaaaatgggctatccgcgcggattaatccgttatacgaccgaaagcgcgctggaacacgaatattctgaaaaagacattaaaaaacggctgctcagaccgcgcgtggcaggttacggcgcggtgttggcgttagttatcattgccttcctggccggtttgtccacgcgcaaaatggtcgaggtcgatattttgaaagaccgtggcgtactggtgcgcgaaaacgccaaaggctggctggaaaacgcatacagcctgcgtatcatcaacaaaagtgaaaaagaacagctgattaccgcaagtgtcaaaggctttgacgaaatcgccctgaccgggctgcccgaaggcggtatcaaggttgccccgcgcgaaacggtaacccttcccgtccaagtgtccaccattccggaatacgcggacaaaggcagccaccctatcgaatttaccttccaataccgcgaaagcggcgcgcccgacggcaagccggtcgtcttggaagaagatgcaacctttatcggagaataaccgtgtctcaaaacactccaatcaaaccttggtacaaacacgtctggccgtggatcttgatggcggggccgatttttgtcgtcatcgccagcgtcgctatgttttttgtcgcgcagcagcacgcgacagatttggttacggacgattattataaagacggcaaacatatcgacatccagcttcatcgggatgaagaagccgtcagacggcatatcggggtgcaggttctcatttcccccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaaccctttcgccgaccaaccactggtatgtgcgcgtggaggacgcggcaggcgtgtggcgcgtcgagaacaaatggattaccagccaaggcaatgcggtcgatttgaccccgatggacaagcttttcaataatactgaaagcaaataaaaaagccgtgttttcattgcattgctttgccagatgtaatgccgtgcaggcattatttgatcattcggcgcgatggtttgatttgtcggacgaaaataaatgtatctcatcccgtttattttttaacactattccggaacgcagcctgaaaaacgccgtctgaaagcccttcagacggcattttgtttgcaaatcaaatcctacctgatgtcagcgtccgagcgttgcaacaggttcgctccccgtcagcagatattgtatcgtctcgcggacggtgcggatggcattgccgaagggcagcggtctttacctctgaagaacaggcctttatctacttctccacggaatgcggcggcaagctggatatcaatacagaactgtcctgctttggaaagcccgtcgcgcagaccgcaactggttaggcagtttaaaccttgggtacagcggcgcgggtcggctttggcgtttgtctgaagtttgctttcacgcttgatgtagctgtctaggaatttggtgcggacaccgcgcgccggcaaaccggcaacagacataaattcgactactttttcagtttccgcaccggcgagcgtttttttgaagttaaggtgtgcatctccttcttcggtaacggcaaaagccgtaccgatttgaacggcggatgctccccagttctttagggcggttttgactttttcaaaatttgccatgcctcccgcaagaataagcgggattttttcgctttccagccctaaacttttgaaaacttcaaacgtttcctcaatcacgcgtttgaagtcgaacttggcatcgtttacgccttcaacggttgatgcacccaaatgtccggccgcgtgggcaggatgttcgactacaatcgcatcgggcaatatgccttttttcatccaacgtttcaagacgatattaataccgcgcgattcggacagaatcggcagcagcgcgacatctttatgatagccctcggtcatttccggcaggtctaaaggcaggccggcacccattacaaccgcatccgcccctgattcgcaagcctggcggacatatgcggcgtggtctttgaccgccttcatcacgttgaccgcaatcagtccttttccctctgaagcgcttttggctttttggatttccctgtctaatgcggtacagttcaaagatgtatatttctcttcactcggattgatttgtgattcggcgagtaggtcttcgtgaaggtggcgcaaatccacactggcaatcgttccgataccgttttcacgcgccaccgcgctggataaacccgatgcggaaacaccgacccccataccgccttgcacgatgggggtaagggattttccacgaataaccaaagggtcaaaaatattctgcatcagtttctccgagtgtacgaatcagtcaggctcatgaaaaatggttctaactgttttagaactattgctcaaatttggtattatactctaaatatcgcggcggtaaacaagaaagcagccggagcttcgggcattctgttacgcctgtttcaatcgggagagaaaatattatagtgaattaacaaaaatcaggacaaggcgacgaagccgcagacagtacaaatagtacggcaaggcgaggcaacgccgtactggtttaaagttaatccactataaatttgatgatggcataaaaaagccctagtcagttgctgtcaaaggggattgttaagaaaagtaatgccacgttgatggggtgcaatatatcaggcgtttcaatcgggtaaaatgttggacggacaccgcatccggttatgggatatcggtttgcacggcaaaggtttgaatatgattcgattacgtctgagattctgatgaagggggtaggtaaagatatggtaacgagttgctgagacaataaaaaatccccgagcgataatctcggggatttagaatttggcacgcccacggggaatcgaaccccggttaccgccgtgaaagggcgatgtcctaaccgctagacgatgggcgcatattgtattttcttactggcgcacccggagcgattcgaacgcccgaccctctggttcgtagccagatactctatccaactgagctacgggtgcgctgcaagaaagattcgaattttagggtaatcatcggattctgtcaattgttttgttggatgaaatgccttaaaagtgtaaaatattggtttgttgtttgaatttaaagagaataaaatgattgttgcttctcgctggcccttgctggaaaaggtatttttacggtttggaatgcctgttgccgtggttgatttggaatcgacgggcggcaatctgtatgaagacagggtaaccgaagtggctttggtcaagtttgagcagggaagggtggtgaggcatgagtggttggttaatcctcaaaaaccgattccgcagtttgtggcggggctgacggggatttcagacggcatggttgccgatgcgcctgtttttgcagagattgccggcgagttgttttcggtattgaagggttgtgtgctggttgcacataacagccgtttcgactatacgtttttaaagcatgagtttcatcgtgcgggtatcggattttcatcgcctgctttgtgcagtgtgcagctgtcccggtgtctgtatccgcaattttacaagcacagcctggacagtatcatcgaaaggttggggattgttgtggaagacaggcatcgtgcgatggcggatgtatcggcattgtgtgattatttggaatacagtctgtcggaacacggggttgaggcatggatcaggcagtgtttccgtttgatgaatccgaaaccgctgcctgccgcgctgcccgaacggttgagggaacagttgtacggtttgcctgacggtatgggggtgctggcttgtttcgacggcggagggaaagtaaattatatcggtacgtttgaacgggtatatagcgagatttcggctttattggactccggaaaagccccgtttgattggtgcaatacggaggaagtccgtttttttcccgcattgggcagcctgcatgcatataagattaaagcggaattggtcgggcgttatcattcggattgttatgtgtctgccaaaaatctgcttaaaacatttacgaccgtcaggtttgaaaaaggttcagacggcatgttgaatgcgaaaacagcggctttgaaaaacggtgtgacggataatccgcctaccggattatttgccaataaaaaggcagcgagacgggctttgtcgtcgtgggcggaaacatacggattgtgtcctgccgcagccggtatccttccggacggttatgcagaggatgagccttgtcccgtatatgtttcaggccgatgcgataaggcgtgcggccgttctgacgaacaggttttggcgtttgcacacaagttgcctgttttggattggggaaaaatgcatgaggtggaaattaccgaaaccgatcctttgacgggggaaaaagtcgttctgcacggaatgggcggcgcattggaaatggatgacgggctttggtatttcgataaagatttaccggatgcgtttaaggcgaagtttaaaacggacaggaaaaatattaaggaaatcggttaaatcgatatcggttggtgaaagccggcaagtatgtaaacagccgtcaccgtgttgattgcctaatcggtttgtgccggtgtgttgccgtttgcaggtaatgtatccgaagatgccgtctgaattttttcagacggcatttttgccgacgcggttttcgtgccgtgtcggtttgcccgtccatccgaaggcatcggacaagcagggtggtttttagaagccgttttccatcatgatttgaccgggaatgcggttgcggtgcatggcgtaacccatgtcgagcagcgtttggaaagtgtctttgaccatttccgggttgccgcaaatcataaaccgtgtggattccggggtgaacttggtatgcagcgcctgttcgatgctgttgttttttaagagttccggaatgcgttttccgcttaagcccgaggggttggcggcacgggtggtaacagggacgaaacggaaagagtgtccgtattcgcctaccaggggatgttcagtcaatgcggcgagtcggtcgttgaaaatcaattcttcgggaaaagatacggaatgtatcaggttgacggtatcgaaacgttgacggatttcgggttgttcgagaatggaaaggaagggggcgatgcccgagccggtgcagagcatcaccaaatccttgccgtcggggaagcgttcgggcaggaggaagccggtggcatttttatcgagcaggatggtgttgccctgttgcattttggcgaaacgggccgacatggggccgtcttggatgagtacggcaaaatattcgagcgtgtcggcatattctgcggaaacaatggaataggcacgccaaatgaaaccttccccttcgtagaaaccgagtcgggagaactgtccggctttaaagcggtaggattcgggacggctgatggcgaaagtgatgagtttcggcgtgtggtgtttgacccacaaaatcttttcttcggtgaattttgcttcgggcgaggctgccatgttgttgtccttgagtgtgtttgtcgggattatagccaatttgggtgtttttttctgcattggcggtctgtatttaaattcggatatttttcaatacaatgttatcgttttttgaaataaacggtaaggagtagtttgttttttgtcaaaatgggaatacaatcctatctataaatttaattgagaattactttttttcaattaatataaaaaatcaaaacagttgtgagagcctttggacgatttgcacacttgcatattacagaggtctctatgaatcaaaatcatttttcacttaaaattctgaccgttatgctgttatcggcttacggtggttcttttgcagacggtgttgtgcctgtttcagacggcaataccgtcagtctggatacggtcaatgtacgcggctctcatgctttgttgggcaagaccgaaaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtatgaccgtcaatgttgcaggccgttcgggatatacggcgaaaatcgacgtgtctccgagtaccgatttggcggtttatgaccatattgaagttgtacggggtgcaacggggttgacccaatccaattcagagccgggaggaaccgtcaatttgatccgtaagtgacctaccgcttctttcaaacataccggagagctgaccgccgaccatcgcggcagccggcgtgcagtgttggatgtttcaggcagcctgaataaggcgaataccttacgcggaaggttggtgggtgcggaagagtataaaaaatcgtttaaagaccgagtttggggcaggaaacatatggtttacggcattgccgaagccgatgcgggcgacagcagtgtgcttactttgggcggcatgtatcagaagagtagggaggttcctgatttttcgggcattattttgccctgtgaaaatcagaaaactgccccgttcagttcaacgcctgcctgcaaccggcctttgcaactgccgcgcaacacttatttgggggaggattggtcgcggttaagtgccgacaaatacaaccttttctcaggattcaaacatgtgtttgacaacggttggcagctcaatgccgaagtgtcttataccaagaatgaatccgatgcgaaggtggggcagttttttctgaaaaacgaatatgcggcgggtttgtcgggtgaggatgcggtaggctttttgactgaaaaaaacgaagtcatcccgttcgagccgaaagataaggcattggagaaactgaaagcatatcgtgatgaaaccgccaaggaataccgggagcgcaaagacgattttgttaaaaaccgtttcgataatactgctttcgaacagtatcgcagccgccgtgccgcagaacgcaaagccggttttgacaagtgtatgagtgaccctttcgcgctggactttatctgtcaaggttcttggggggatccgggcgttgatgccgacaaggcggaatttgtcgataaagcccttgcgaaggagggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggtgatgaaaagatacgttcggaatatctagaaatctacgaacgccgctacagagtacgtccgaatacgggggcaacgcacggcgtgtatgcgggaagttgtcaggaggagccggacggcgatttgtcgtctcctttggtcagggggcataaagaacccgattggcaggcgtacgatgaaaaaggcaaccgtaccgtttatgccgaagaatgcaggaacgccaagaaaataaaaaccgagcccaagctcgatgccgaaggcaagcaggtgtattactatgacgaatacagcggcagccggacaccggtatatgtcgatgtatatgagctggacgaaaaaggcaacaagattcaggagaccaatcccgacggcacgcctgcctttaccggtttttccggtacggtgccggtttggaaaaccgtcaaagtggcagacgaccatgttcctgcgctgtataactacgccaaatacctcaacaccaacaaaacccattcgctgactgccagcacgcgtttcaacgtaaccggccgactgcaccttttgggcgggctgcactacacgcgctatgagacttcgcaaaccaaagatatgcctgtccgctatgggcagccggcaagcgattttcagacggcatcgagcattagggcggatcaggaccattacacggccaagatgcaaggtcataaattgacgccctatgcaggcattacctatgacttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgatttcggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgccttgccaaaaattccagtgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgccaaattgagcctcatcggtacgaacttaaacggacgcacttattttgagaacaactacaaccgtacgcgcggcgcaaacaacttctacggagagccgcgcactgtcagcatgaaactggattggcagttttaattgaaaaccgtagttttgcggatgccgtctgaaacagggtatgtttcagacggcatttttatggaggcaggtctatcggggcgtatatttggaatttgcccgatgccggcagtagaatatcccttttatcctcagaagagccgatgtcttcacgcaaaattatccacatcgacatggacgcattctacgcatcggtagagctgcgcgaacagccgcatttgaaagggcggccggtggtcgtcgcgtgggagggcgcgcgttcggtgatttgcgccgcatcgtatgaggcacggcagttcgggctgcattccgcgatgtcggtggcaacggcgaaaaggctgtgtccgcaagcggtgtatgtgccgccgcatttcgatttgtaccgtcaggtttccgcgcagattcacgccgtattcaggcgttataccgatttaatcgaacccttgtcgctggacgaagcctatcttgacgttacccgtaatttcaaaaacatcccttacgccggcgacgttgccaaagaaatccgtgccgccatttttgcggaaacaggtttgactgcatccgcaggcatcgcgccgaacaaatttctggcgaaaatcgcgtcggactggcgcaagccgaacgggcagtttgtgttgccgccgcacaaagtcatggcatttttggaaaccctgcctttgggcaaaatccccggcgtgggcaaggtaacgctgaaaaaaatgcagtcgctgggtatgcggacggcgggcgacttgcgccgtttcgagcgcggcgaactcttaaaccatttcggacgctacggataccgcctctatgatttggtgcgcggtacggacgaacgccccgtcaaagccgaacgcgaacgcctccaaatctccacagaaattaccctgcccgaagacctgccgctcgagcaggctgccggacacctcccccatcttgccgaagacttgtggcggcaaatcacgcgcaaaaacgtcgaagcccaaagcgtaacgctcaagctgaagacctacgatttccgcatcatcacgcgcacactgacttattcctccgtattgcccgactgcgcactctgctgcaggctgcgcaaatgttgatggcgcgcgttcgccgcagacggaagacgcgttccgccttatcggtatcggcgtggggcatcttgtgccgaaaaaccagcagcaggatttgtgggcgtaaaccgctttacgcgcgccgtccaaaaaatatgccgtctgaagccttcagacggcattgcggctccggtttaatccgccgcgccgcttttttttaggttgtcgagccttccgattatatcggcaaggttgcgtctgccttcttctttgctgacaatcggttcgccgcctttgcgccccaggattttcaaatcttcctgcggcatttcgtctatgaatcggctgggttcggggaactgccatgtgccttgttttttgcgtttgacgcagtgggtcagtgtgagttggcgtttggcgcgggtgatgccgacgtacatcaggcggcgttcttcttcgacgttgccctcttcgatactgtcgttgtgcggcaaaacgccttcttcgcaaccgacaaggaaaacatacggatactccaaacctttggcggcgtgtagcgtggatagcgagacggcatcggtttcttcttcgtcttttccttccaaaagcgtcatcaaggcgacggtttgggcgagttcgatgatgtttttgccgtcttccccgccttttcgcgcaaaccatgataccaaatcgccgacgttgcgccatttgatttcgccggctttgccttcttcgttttgcatcaaatggttttcatagtcgatttcttcgagcaggctgttgatgaactcgcccgcttcgctggtttcggctttggcgaggtagctgacgaacatatccataaaggtttgcaggtgttggcggttggtattgttcagcgtggcaagggcttcttcgttttgcgcggcttcatacaggctgcattcgtgttcgtgcgcgtaagtgttgagcttgcccagcgtgacatcgccgatgccgcgtttgggcgtggtaacggcacgcagaaaggcgggatcgtcgttggggttggcaagcagccgcacataagacaacacgtctttgatttcggctttgtcgaaaaagctttgtccgccggagagctggtaggggatgcgcgcgccgcgcaatgcttcctcgaaaatcctcgcctgatgctttccccggtataacacggcgaaatcggcatattgggttttgtcgccgccgatgagtttttgtttgacgatttggctgacgacccagtcggcttcgtgttgctcgttttggcaggcaacgactttgaccggctcgccttcgcccaattgcgaccaaagttttttggtaaacagcttggggttgttttcgatgactttgttggcgattttgagaatccgcgcggtggagcggtagttttgctccagtttgatgaccttcatctgcggatagttttcctgcattttacgcaggttttccatgttcgcaccgcgccatgcgtagatggactggtcgtcgtcgccgacggcggtaaacataccttccgcgccggtcagcagcttcatcaacgtaaattggcaggtattcgtatcttggcattcgtcaaccaacagataacgcagccgccgctgccatttgttgcgcacttcgctgttttgctgcaacagcacggcaggcaggcggattaagtcgtcgaagtccactgcctgatagctttgtaaggtttcctgatagctcgcatacacgcgtgcggtttgttgttcccaaatgttcgatgccgtctgaacgacatcttcaggcgtttttaaatcgtttttccacaaggaaatctggtgctgcgccttgaatacggcttctttgcccgtaccgcctaagagttcgccgatgattttcgcgctgtcggtagaatcgagaatggagaagttttttttgtaaccaatatggttcgcctcttcgcgcagaatcttcatgcccaaagagtggaacgtgcaaatcgtcagcccgcgcgtttgcggtttgggcagcattttggcaacgcgctcctgcatttccgcagcggctttgttggtaaaggtaattgcggcaacggtatgcggcaggtagccgacattgacaatcaaatgcttaattttttgagtaatcacgccggttttgccgctgcctgcaccggcaaggacgagcagtgggccgccgaggtagcggacggcttcgagctgttggggattgagtttcatcatgttttgatgctgtctgaaatcagtctgcgccgttttcgaggcagtcgagtgtcgcacggagggcggatacgccgatttgccccggcgcggagttttgcgttcccgaaccgaacgtgatgcttgagccgaacacctgtccggcaagccggctgaccgcccccgtctgccccatcgacatcgtaacaatcggtttggcggcaagctctttcgctttgagcgtggcggaaagcaaagtcagcacatcttccgcgctttgcggcatcaccgcaattttgcagatgtccgcgccgcagtcctccatctgtttcagacggcatacgatttcttcttgcggcggcgtgcggtgaaactcatgattgcagagcagggcggcgatgccgtttttttgagcatttgccacggcgcaccggacggcggtttcgccggaaaacagctcgatgtcgatgatgtcgggcaggcggctttcgatcagcgcgtcgagcagttcaaaataataatcgtccgaacacgggaacgagccgccttcgccatgccgtctgaacgtaaacagcagcggcttgtcgggcagcgcgtcgcggacggtctgcgtgtggtgcaatatttcgccgatactgcccgcgcattccaaaaagtcggcgcggaactccgcaatatcgaagggcatatttttgatttgctcaagtacggcggaaagttcggcggcatcgcgggcgacaagcggcacggcgattttggtgcgtccgcttccgataacggtatttttgacaacaaggcaggaacacataaaacaggcacacacagaaaaaacagccgccattataacaaagccggccgccttttagacggcatccagattccattccggcacaagccgccgcgtcctggcgcatatcggcaagcaaggaaatatgcgataatggcaacctcgtgaagcagcattaccgatagcccgcacatcgggaaaacgatacacatcccgcgccgcagcccgtgttgcgccgcatcccacataccgcatttgttccggagtaaccccaatgtcagacgacaaaagcaaagcacttgccgccgcactggcgcaaatcgaaaaaagtttcggcaaaggcgccatcatgaaaatggacggcagccagcaggaagaaaacctcgaagtcatttccaccggatcgctcggattagacctcgccctcggagtcggcggtctgccgcgcgggcgcatcgtcgaaatcttcggccccgaatcctccggcaaaaccaccctctgcctcgaagccgtcgcccaatgccagaaaaacggcggcgtgtgcgcctttgtcgatgccgaacacgcctttgatcccgtttacgcccgcaaactcggcgtaaaagtcgaagagctttacctgtcccagcccgataccggcgaacaggctttggaaatctgcgacacactcgtccgttcgggcggcatagatatggtagtcgtcgattccgtagccgcactcgtccccaaagccgaaatcgaaggcgatatgggggacagccatgtcggactgcaggcgcgcctgatgagccaggctttgcgcaaactgaccggacacatcaaaaaaaccaacacgctggttgtgttcatcaaccaaatccggatgaagatcggcgtaatgttcggcagccccgaaaccaccaccggcggcaacgcgctgaaattctattcttccgtccgcctcgacatccgccgcaccggatccatcaaaaaaggcgaagaggtattgggcaacgaaacccgcgtcaaagtcatcaaaaacaaagtcgcccccccgttccgtcaggcagagtttgacatcctctacggagaaggcatcagttgggaaggcgaattgatcgacatcggcgtgaaaaacgacatcatcaacaaatccggcgcgtggtacagctacaacggcgcgaaaatcggtcagggcaaagacaacgtccgcgtctggctgaaggaaaatcccgaagtcgccaatgaaatcgacgcaaaaatccgcgccctcaacggcgtagaaatgcacatcaccgaagggacgcaggacgaaaccgacggcgaacgccccgaagaataaaacctgaaatcccgataaacggtacttctgctgcgaagtaccgtttttttgagccgcctccgaacggcttgatttgagttttggtatagtggattaacaaaaatcaggacaaggcgacgaagccgcagacagtacaaatagtacggaaccgattcacttggtgcttgagtaccttagagaatcgttctctttgagctaaggcgaggcaacgccgtactggtttttgttaatccactatatttttgcccgacggggtgaaaaatacagttgctacagcccgacctacgcccgctttgcctctatcctgcgcccttttatgtgcaacactttgcacttgctgaacaaaattcaaacgaccctttatatcaaatgcaaaaaatatgccgtcattcccgcgaacgcgggaatccagacccctcggcatggaaatttatcgagtaaaacggtttctcagattctacgttctagattcccgcgttcgcgggaatgacggcggcggggggttctgttttttccgatagattcccgtggtttttcggttactggattcccgcttttgcgggaatgacggggtgtaagtttctgctcccacggggctggattcccgttttcacgggaatgacgaaatttcagacggcatcggaatttttgtgttttggtgggcttcagcctgccgcatcccatcgattctgccgtttttaccgtttccgccgaatcctgcaaactgatgccgtcattcccgcgaaggcgggaatccagacctgtcggcacggaaatttatcgagtaaaacggtttctcagattctacgttctagattcccgcgttcgcgggaatgacggtcgggggtttccgttttttccgatagattcccgtggtttttcggttactagattcccgcgttcgcgggaatgacggcggcggggggttctgttttttccgatagattcctgtggtttttcggttactggattcccgcgttcgcgggaatgacggggtgtaagtttctgctcccacggggctggattcccgttttcatgggaatgacgaaatttcagacggcatttaagcggtacggatgtgtaaataatggtagggtgggcttcagcctgccgattcccgctattcttgccgtttttgcgttcttatcattctcactgtttttaccgttcacgccgaatcctgcaaattgatgccgtcattcccgcgaaggcgggaatccagacccgtcggcacggaaatttatcgagtaaaacggtttctcagattctacgttctagattcccgcgttcgcgggaatgacggtcggggggttctgttttttccgatagattcctgtggtttttcggttactggattcccgcgttcgcgggaatgacggtcgagggtttctgtttttccgatagattcctgtggtttttcggttactggattcccgcgttcgcgggaatgacggggtgtaagtttctgctccgacggggttggattcccgctttcacgggaatgacgaagtttcagacggcatttaagcggtacggatgtgtaaataatggtagggtgggcttcagcctgccgattcccgctattcttgccgtttttgcgttcttatcattctcactgtttttaccgttcacgccgaatcctgcaaactgatgccgtcattcccgcgaaggcgggaatccagacccctcggcacggaaatttatcgagtaaaacggtttcttagattctacgttctagattcccgcctgcgtgggaatgacggtcggggatcagcggaagaagtcgcccactccggggggtagaccttgcgtgaatgcgcccattgttttgtttgcggtttcttcggctttgcctcgggcggatttgagggcggcgaggatgaggtcttcaagcatttctttgtcgtcggcggcttcttgaatcaaatcggggctgatgtcgattttgcgtacttcgtgcgcgcaggtcattgtgattttgaccaggccgttgcctgcttcgccttcgatttcggtttcggcgagtttggcttgcgcttttttcatattttcctgcatttgctgcgcctgtttcatcaggccgcctaatccggcttttccgaacatactgaatactcctgtctgttttgattgaataagggaaacggcaatgccgtccgaagggttcgggcggcattatatctgtttatggccggtttgccgccaattccagtgattcgggctgccattgcgcgccgaatgcttggaggattttttgtgcggcggggtcggcttcgagcaatgcttgtgctttttgcctgtcttcggcttggacgcgcttgtcctgcatcgcgggggtttcccggccggcttcgtcacgccagtcttgggtttgcagggtgagttgcagcccgtaggcttgggcaagggtgtcgcggattttgtcgaggcgttttttgtcggcggtggcgcgtgcttcggcggtcattgccaaaaccatcagaccggtgtcgggatggtattccgtccacgcggagtgttgcgccggcatttgcgccgcgccgagtttgcgggcgaagtgccggacgatggctgcccagttttcggtggaaaattcgggcggcggggcgtatggcgtgtggtcttcgttgttgctgctttcgtcggcgttgttttcttcttccgcatcggcaggggcggcgtgttcccaatcgggcggtgggatttctgcgccgtcttctacgaggtagtcatcattcggaaagctgtaaccgttgaaaggttttgcaggagcttcgtgtgcaaatgcttctgtttcaagggcttcattattcggtgttgcctgaatggggttttcagacggcacttcggacaagggggcatcggtttcgttgtcggctgcttcgttcttggaaacttggtttttgggcggcgttccggcttcggatgccgtctgaatgctttttgccgatgcttgcgccgtgccggctgcggtttcgtccggcgcgtcttcccaaggcggaatatcgttgttttcttgattggtaacgggttcggcagttttgccttcagacggcattgctgctgcggatgccgtctgaacgggtgtttgggcggtttccgcttcagggcgcggttggggcttttttgcggcggtttccttttcggcggtttgtgccgatggggattttagttcggtattttcaatcacggcatttgcatcacacgatgctgccgccaagggcgcaaacgccagcatacgcagcagggtcatcataaagccggcgtattcgtcgggggcgaggctgaggtcgcgtttgccgtggacggcgatttggtagtaaagctggatttgttcgccgcttatggtttgggcgaggcggtgcaaaatatcggaatcggggtcgtcgtgcgccaaggcattcggcactgcctgtatcagggcgaggtgttgcagcagtatggcaagttcgcccaaggcgttgtcaaagccgacggcacacgccgccatttcctgcgctttggcggtcagggctgcgccgtcttggttgatgatgcctgtcagcagttcgtaaaggtattgtttgtcaaccgcgccgatcatttggcggacatcgttttcggcaactttgcccgaacctagggcgatggcttggtcgagcaggctcaaggcatcgcgcatcgatccggcggcggcacgtcccaaaagttgcagggcggcgggttcgtaggcgattttttcgctgtcgaggacgtgggcgaggtggtcggcaacctgttgcgcggtcatattgcgtaagacgaattgcaggcagcggctcaagacggtaacgggaactttgtgcggatcggtggtggcgaggatgaatttgacgtgttcgggcggctcttccagcgttttgagcatagcgttgaacgcgcttttggaaagcatatgcacttcgtcgatgatatagactttgtattttccggcggtcggtgcatattgggcgttttccaagacttcgcggatgttgtcgatgcctgtgttggaggcggcgtcgatttccagcaggtcgacgtagcgtccggcatcgatctgcgtacagctttcacatacgccgcaaggttcgccgtgttgcgcgttttcgcagttgaggcttttggcaaggatgcgggcgatggtggttttacctacgccgcgcgtgccggtcagcaggtaggcgtggtgcagcctgccttcgtccagggcgttttgcagggctttgacgacgtgttcctgaccgactaagtcggcaaaggttttgggccgccattttcgggcgagaacttgataggccatgtttttctcttggtttcggtcgtgatgtttctgtcggtgcgtcggaatgccgtctgaacggcggtctcgggcggcgtattctagcactttcggcttactgtccgcgcaagaacagtgcgtccaattctttcaaagtcagtttgacccaagtcggcctgccgtggttgcactggttgctgcgcggcgtattttccatatcgcgcagaagggcgttcatttcgggcagggtgagccggcggccggcgcggatcgagccgtggcaggacatggtggcgaggatgcggttttcgtgttcctcgatggtttggctgctgccgacttgggcgagttcgtttaatacgtctttggcgagcgagacgacatcggctttgccgagcatggcgggaactgcacggacggcgagggtgttgccgcccatatcggataattccagcccgaagcctgccagcgtttcggcataatcggcaagggcggcgcattcttcgtgggacgcggcaaaggttacgggaataagcaggcgttggctttgcaggttgccgttttcctgacgttggcgtttcattttttcgtagttgacgcgttcggcggcggcgtgcatatcgatgagcaacaggctgtcttcggcttgggcaagaatgtagatgccaagtaattgggcaatggcaaaaccgagcggcggcagttcggattgggacgggatgccgtctgaaagcggcgtatctgtttggggagcaggcgtttcagacggcatattgccgaaacgtgcctgctcgaatcggcttaactcaaggtcgatgtcgtcggtttttttgtaaagttcggcgtaagtattcattgccgcgcggctttcgcgcagggacaggctgcgttgttgcggcgcatatgcggactgatagggcatgggcgcggttttgcctgatgaaccaaaggcattgtgtgtatctgatttgttgcctgtcgggtagttggatacgctatcaaacagattttcgctgtcgttttcagacggcattggggtggagacaacgccggtaatgtcatgcaacacttcgcctgcgttgccgacgctttcggtcaggttggcgcgtgtgtcggcaagggctttgttgagcgtgtggaacacaagttggtgcacctgctgactgtcgcggaagcggatttcggttttggtcgggtggacgttgacatccacggcttcgggcggcaggtcgagaaagaggacgaaggcgggagtgagtgcgttgtgcaatacgtcgcggtatgcctgcttgacggcgtggagcatcactttgtcgcgcacgaagcgatggttgacgaagcagtattgtttgtcggttttacctttggcgaaagtcggtttggcaatcgcaccatagagccgcagcgcgccgttgccgctgtcgattcccaatgatgccgtctgaaagtcttcgccgacaatggcggcaatccgttcatgcaggctttgtgcagggagtttgaacacttgtttgccgtcgcgtttgagcgagaaggcaatgtgcggatgcgccagcgcgaggcgttcgagcatggtggcgcagtgggcgtattcggtgttttcggatttgaggaacttgcgccgtgcgggggtgttgaagaagagttcggcggcttcgatggtggtgccgacggggtgggcggcggcggtggggctgctgagtttgccgtcttcggctttgacttgggtcgcgtgcgaactgtcgttctgacggctggtcagggtcaggcggctgacggaggcgatgcttgccaaaccttcgccgcgaaagcccatactggcgacgtgttccaaatcgtttaaggttttgattttgctggtggcgtggcggtggagcgcaagttcgatgtcgtcggggtggatgccgccgccgttgtcgctgacgcgaatcaggcggatgccgccgcccgccagctcgacttcaatcgccgttgcgcctgcatcgatactgttttcaacgatttctttcaaggcgttggcagggcgttcgaccacttcgccggcggcgatttggttgacaagatggtcgggcagggcggcgattcgggacataaggcgggcttccgttgcaaaaaacgtcttattctataataaaaccccttatctttctgcccgtattcttgataaaagccgtttatcccgtttggaaaataccagtataatcacgccatattccgtaaaattggagcacaaagatgtatcactaccaatccgatgccacacaattcctcaaccgcctgattgaagaaaaacctgagttggaacagcagcgtttggaaaacagggggcttttgtgggatgtcgaactcaatcccgaagaacaggaaaacttcgaggcggcaaaagtggcgaaaaaaccttatacctattaccaagactgaatccgccgaaatgacgacccatctgtccaatgtcgcaccggacctgcaaaactatttgaacgccatcggcgaacccgaacatcccgttttgacgcggctgcgcgagaagaccgggcatcaccgtatgggcaaaatggcgattgcgcgcgaacaggcggcagttttggtttggctggcaaagctgatccgtgcggaaaaatatctggaaatcggcgtatttaccggatacagcagcaccgcgcttgcattggcactgcccgaacacgggcggattaccgcctgcgacatcaatgtaacctttaccgatacggcgcgtcaggtttggaacgaggccggtgtggcacataaaatcagcctgcacctgcaacccgcattgctgacattggatgatttgattgcacagggtgaagccggaagctacgatttggcactgatagacgcagacaaaccgcccacgccgcaatatttcgagcgttgcctcaaactcgtccgtcaaggcggcatcatcgccatcgacaatattttgctgaacggaagggtgatgcgcgaagcggcttccgatgcgccgcccagcgtcggcatcctcaaagatttcaatcaaaacctgccgaacgacccgcgcatcgtccccatcaccctgcccgtcggcgacggcttgaccctgcttctgaaaaaataatgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatagtttttccatttttccgctttttaccccatccgcaccaaggaggatttatgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgaatatggaattggaacaaatttaaaacccaccgtctgcgaatatatagtggattaaatttaaaccagtacggcgttacctcgccttgccgtactatttgtactgtctgcggcttcgtcgccttgtcctgatttttgttaatccactatacaaatgccgtctgaagccctgtttcgggtttcagacggcatttttgcgaacaactttttatgcctgttctttttggcgcattttttctgccattagttcgtgcagggttttcttcgccggtttcatcggcacgcggttttgcgtccaacccaactgtttgcgcggggtcaggttgcggaacttggtggctgcccaaccgaaggcgcggtaggttttgctgccgctgaaaataccgttgaatgtgcgccacgccatttgttcgccgaaggtatgcgatgcgccttgcccccggatggggtgcggcacggtttcggtcggcgaacgttgcgcttcaacgcgcaaacgctgcatttgttcggtaatcgggatgcgtaccggacaaacttccacgcacgcgccgcacatcgtgcaggcggtcggcaggtcgcgagtggcatccaagcctaacaggtgcggggaaataatctcgccaatcggaccgggataggttgtgccgtatgccgcgccgccgatgcgggtataaaccgggcaatggttcatacacgcgccgcaacggatacattgcagggtgcggcgcatttggtcttcggcataagcctggctgcggccgttgtcgagcagaaccaagtgcatttcttgcggaccgtctaattcttcactgcggcgcgggccggtaatcatattgaaataagtggtaatgttctgaccaatggcagaacgcggcagcaggctgtacaagggtgggatgtcggacaatttcgccaccactttttcaatgccggtaatagcgatatgcacgggcggtacggtggtactcaagcgaccgttgccttcgttttccaccagacacagcgtacctgtttcagcaacggcaaagtttacgccactcaaaccgacatcggcagtgctgtaaatatcgcgcagtgctttacgggcgaagccggtcagttggtctacatcgtctgtcagcggcgtaccgaggttttggtggaacagttcgctaacctgttctttggttttgtggatagcaggcatcacgatatgggtcggtttttcgcctgccatttggacgatgaactcgcccaagtcgctttctaccgctttaatgccttttgcttcaagataatggttcagctcgatttcctcgctgaccatcgatttgcctttgaccatcagcttgccgtttttggctgtgatgatgtcgtggataatttggcaggcttcggtcggggtttctgcccagtgcactttcacgcccaacttagtcaggttttcttccagctgctccagcagggctggcaatttagacaatgagcgctgacggacgtgttcgcacaaatcgcgcaggctttgcagctcttcttcgtcggtcaaaacggctttgcgtttggtcatcagcatatccatcgcggtacgcaggcttttgcgcaaaggcttgtcttgaagggaaattgcggcgttttgcttgaaagtttccggcttcatgtgaaatttgatggtttgcgtagtcatgcgttttcctccaaatcggcaggggaaatgtggtcgggcaggatggcgaggatgaccaaatcgcgcgggccgtgcgcgccgtaagcaagcgtcagttggatgtctgcggttttggacgggccggaaatcaggaatacattggtcggcataccgttttccaccagtttttcgccttcgacggcattatgaaactcgttgtacatcttggacgtatcgaacaggcagaaatgcacgggcggaacgaggcttaaagtacgcggttcttcggggctggaaaacagcatcagcgtgccggtgcgggcgatgccgcattgcgcgccgctgaagcccgcatcgatgttcgtgaaaaactcggttttccaagtatcgatttcgcgctcgaaggcaatcggttcgatattgctgtccgccaatgcggcacgggcaatttgtccgtgttcggtcgccaagggcagcaggatgtttttcaaacccttgccttctgccgcttcgcggaaaacctgcatccaattgcttttcgtcacccaataaatttcggttttgaccgcacgcatagcggcagcccaatgtttcagacgctcaacttcgctgccccaagaaacacccatttcacggtaataatcaaaaaccgcaggttcttccatcggcaatgcgtcggcttttttcagttttgccaaaatattttcacgcgcgctcatgctttgcctccggtgcgttccaacaagaaggatgcgatatgtttcggacgcggcatatccggctcgtccttggcgattttgccgccgatgttcatcatacagccgcagtccgcgctgatgatttcggttgcgccggtttctttcagcgcggcgactttgtctgttaccattgcgccggaaatatcggcttgtttgacggagaatgtgccgccgaagccgcaacattcgctttcgtggtcgtggacgatgcgttcgacgttttccataccgtcaatcagttgccagcctgaaagatggacattcatttcgcggcgggcggcgcaggaagtgtgaacggcgactttgagcggttcgcccttgtcttcgggtttgaaaccgatggcaagcaggaaatgggtaaactcgatgatgcggccggcgcaatccacagccctttcctcgtactcgctgcctttaaacagcgtcggccagtggtgtttcatcatgccgccgcacgagccggacggcacgacgatcggccagttttcagggaaaaggtcgagttgtgctttggcgacatcgaaggcttcggtcggatggccggatgaataggcaggctggccgcagcagctttgcgccatcgggaaatggacgcgtatgccctgctgctcgattagggtaatggcatccatg

SEQ ID NO: 49 - DNA, 65632 bp, Neisseria meningitidis
ttttacaagatgccaagagtcatctgtcatttccatctcaactagcacataaccaggatatgactttctttcactaatagtcttacgaccattgcggatatcaacaactttctctacaggcaccagaatttgtccgaaataatctcccatctcctcacgggcaatgcgctcttccaatattcgttggacattcttctcaaaccccgaatacgcctgtacaacataccattttttcgacatctcaaccttcccttctcagcaatacatcaaaaaataaccacgaaattgctgtatctgccgcatagataaatatagaaagcacagcaacaaacactataacaaatacagtcattctgacagcatcttcacgcttaggccaaaccacctttttgaattcggaccaagaatttgagaaatatgcaaaaaacccttccttaccggaattagatgcagattctttatcttgaacaaccagttgatccactttaacgttctttttttcaggcgtatgttctgtcatattatttatccatcatagcatctgtctattctcaatccatgtaaatggcaagagagtttactaaataacaaatacaaaaaaattaaccgacacaaggccggttaattttttatttggcaggccaagagggtctcgaacccccaaccctcggttttggagaccgatactctaccaattgagctattggcctctaaacttaagcgataacagaagaaaccacgccggcacccacggtacggccgccttcgcgaatcgcaaagcgcaggccttcttccatagcgataggcgcaatcagttctacggtgatggttacgttttcacccggcattaccatttctacaccttcttccaaagtaaccgcgccggttacgtcggtggtacggaagtagaattgcggacggtagttggcgaagaacggagtgtgacgaccaccctcttctttgctcagtacgtatacttctgctttgaatttggtgtgaggagtgatagtacccggtttagccaatacctgaccgcgttccacgtcttcacgtttggtaccgcgcagcaatacgcctacgttgtcgcccgcctgaccttcgtccagcagtttgcggaacatttcaacaccggtacaagtggttttttgggtttctttcagaccgacgatttcaatctcgtcaccaacgtggatgataccgcgctctacacggccggttactactgtaccgcggccggaaatggagaacacgtcttcgataggcagcaggaacggtttgtccacggctcgctcgggagtcgggatgtagctgtccaatgcggcagccagttcgaagattttttcttcgtaagcggcatcgccttccaaggctttcagtgcggaaccttgtacaatcgggcagtcatcgccggggaagtcgtagctggacagcaggtcgcggatttccatttcaaccagttccaacagctcggcatcgtcgaccatgtcgcatttgttcatgaacacgatgatgtaaggtacgcctacttggcgggccagcaggatgtgttcgcgggtttgcggcatagggccgtcggctgcggaacataccaggattgcaccgtccatttgtgcggcgccggtaatcatgtttttaacgtagtcggcgtgccccgggcagtctacgtgtgcgtagtggcgggtttcggtttcgtattccacgtgcgaggtgttaatggtaataccgcgtgctttttcttcgggtgcgttgtcgatttggtcgtaagcttttgcagcaccgccgaattttttagccaaaatagtagtcaaagcggcagtcagggtggttttaccatggtcaacgtgaccgatggtgccaacgtttacgtgcggtttgctacgttcgaatttttccttagccatggcaatatcctatatatctaagccttaaagaaatgaataatcgagagatggtgcccatgggcagatttgaactgccgacctctcccttaccaagggagtgctctacccctgagctacatgggcctaattgtttggagcgggtgaagggaatcgaaccctcaccgtaagcttggaaggcttctgctctaccattgagctacacccgcattactcgctactgccccaagtaagaattttggtggagggagaaggattcgaaccttcgaagctttcgcaacagatttacagtctgccccctttgaccgctcgggaatccctccaaaagagaacgttagtttattagcggcttgcttttccgtcaagtttttttttgattttatttcaaaacagacataatttgatgttttaaaaagaatttatttaaactggataatcttttcgtatttcgccatcaactcgtcatgggtttcgggatgttcttcgtcaatcaggatgcagtccaccgggcaaacctgctggcactgcggctcatcgtagtgtccgacgcactgcgtgcagaggttggggttgatttcgtaaatttcctcgccttgggaaatggcatcattggggcattcgggttcgcatacgtcgcagttgatgcactcgtcggtaataaaaagcgacatttcttttccttttccactaaattatcaaaaccgggcgggcgcggattatagcacaaggtttttttgaaccggacggttgcaaacgaatgtttacaactcggaaatgattatcaaagcgcatattattcagccacttggaaaacccttaattcaaatgtactctgccccgatttcccttctctatattccgtcagccaatcgggaatattcggcagcgtacccgcctcgagatagacgaatgcccgggggttcaggcacggcttcaaggcatcgaacaggatttgccagtcctgccatgcaaacggcgggtcgagaaagacaacatcaaactgttcggatacggtcttcaaatatgcgatgccgtctgaaaagacgatttgcacctgccccaaacccagttcgcgactgtttttctgcaaggtctgcacggtttggcggttgttatccgaaatcagcacgcgtttggcgttgcgcgaagcggcttctataccgagtgcgccgctgcctccgaagagatccaaaaccgttttacccgtcaaatcctgtcccagccagttaaacagcttttcacgcacgctgtcgggtgtcggacgcagtccgtcggcggatgtgaaactcaatttcctgccccggcattgcccgccgataatgcgtacccggttgctgtgtttggtatgtttgcctgccgccataatcaaaaacctgtaagttcaaacggtattatacaagacctgtcaaagaatatgccgtctgaaaacttttttcagacggcatatctgtttaaacggtttcggtcagcttgcggagcagctcgatttctttgtctttttgttccaacatttctttgcagtgtttcaactccatttttaaaaattctattttcatcgaaacatcacccgacgcatacaacgcaatatcgccaccactatcaccttcattaatctgaaacaccatcccaccaccgcccgatttgagcaagtcccacatatcgattttgaaaatctgagccaactgctccaaacgcgggatatttaactgcgtttcgccccgttcgattttggcatacccgcctgccgacatcgccagcttttccgccatatcctcctgggaccatttattcaattcgcgcatcaggcggattttttcgtgggtttccataagctgaactttctgtatagatggttgaattattgggatagattttaaacttcttctggctggttaggcaattaactattagataagattttttcctttttacaaaaaaagggaaaacatggaattcctatctcttcacccttggtggtctttttttattatattaactattatccttagctatattggattctgtgcacatctccacattcaaaatagggcagttttcttttatagctatcgggatgtaactattattttcttgacacctgtcatcctcatcgctctaagttatttaattaaaaataaagaaatcctgtcagcttgtatcttatgtataactcttattgcattttcatgggcatggattataacctatcgatctaatactaaaaggttttttctttccttattgatagtatggggaaaattgttattaagtactattgtttgggcaattctcgccatatcacttggcttagctgtaataacagggaacagcaagcgtaaaaaatatgaacgacgtgaccgtcatgctgaacgtaatgaaaaagcttttataggtgcgctattagtaggtttcgaattatcaagaaatttattgaatttatgttgcctacacaaggatttttccaccccatctaaaaacattgaagtcaatcgctcttaaattttaaaaggaagagttcatgatgaaggatttgaatttgagcaacagcctgttcaaaggctacaacgacaaacatggcttaatgatttgtggctatgaatggggttggagtaaagccgatgaggctgcttatgtagcaggtgaatacaaactccctgaaaacaaaatcgaccatacatttgcaaacaaatccctctatttcggagagcaggcaaaaaagtggcgttacgacaatacgataaaaaattggtttgaaatgtggggacaccccttagacgaaaatggattgggcggtgcatytgaaaaatccctggttcaaaccaactgggctgctacacagggcaacactatcgacaatcccgacaagttcacacaacccgagcacatcgataattttctctaccacatcgaaaaactgcgtccgaaagtcatcctcttcatgggcagcaggttggcggattttctgaacaaccaaaatgtactgccacgcttcgagcagttggtcggtaagcagaccaaaccgctggagacggtgcaaaaagaatttgacggtacacgtttcaatgtcaaattccaatcgtttgaagattgcgaagtcgtctgctttccccatcccagtgccagtcgcggtctatcttacgattacatcgccttgtttgcgcctgaaatgaaccggattttatcggactttaaaacaacacgcggattcaaataaaccaatcacagaaaagcaaaggtcgtctgaaaatttttcagacgaccttttctctttcaaaccaacctaatcttactccttcggcgcgggcggttcaatctgttctttccagccgcattctttttgtgggcagactttttctacaccccagcgtttagtggttttgatggtcaagaccggccaatggcagttcaggcattcttcggcaacgggcgggttccaagtggcgtagttgcagtcgggataggtgctgcaactgtaaaacagtttgccgtagcgggatttgcgctcgacgaggttgccttttttgcattgcggacactggacgccggtatctttcggtttttccagcggctcgacgtgtttgcatttcggatagttgacgcagccgatgaatttgctgccggtgcggctgtatttgtacactaggcgaccgccacatttcgggcactcgcgtccgtcgagttcggcctgttcggcttcggctttggcgatgcgttcggcagcttcttcggcggtttcgttgacattgcgcgtgtagctgcactcgggataaccggcacacgcaacaaaacgacccattttgccgaatttgatttgcagtttgtgttcgccgcatttcgggcaggtttcatcaagttcctgcgtggtaaatttggcgcgttcgatgccttctttttcttccacttgtttgatgaacggtttccagaatttgtccatcaagggaatccattggcgtttgccgtcggcaatttcgtcaagctggtcttcgagtttggcagtgaagtggtaatcgacgtattgggcgaagtgttcggtcaggaatttattgacgatgtcgcctgtgtcggtgggcataaagcgtttttgctcaagggtaacgtattcgcggtctttgagcgtggagatgatgctggcgtaggtcgaggggcggccgatgccgtattcttcgagggctttaaccagcgtggcttcgttgtagcgtggcggcggagtggtaaagtgttgttcgccgtagagtttgtccacgggcaatttgtcgccttcgctcatttcgggcagttttttgctgtcttcgccttcttcatcgtcgctgctttcttcgtaaacgctgaggaagcctgcgaaggtttgcacttgtccggttacgcggaatacgcctttgccgacggtaatatcgacggtggtttggtcgaatttggcgggcgtcatctgacaggcgacggtacgctgccaaatcatttgatagagtttgaactggtcggcgctcaggaagggtttgacgctttcgggcgtgcggtacacggaagtcgggcggatggcttcgtgcgcttcttgggcgtttttggatttggttttgtattgtttggcggcactcggcagatattctttgccgattttgttttcaatgtaatggcggatttcggttaaggcttcatccgccaagttcacgctgtcggtacgcatataggtaatcagaccgatggcaccctgccctacgtcaataccttcgtaaagctgctgggcggtacgcatggtgcggtcggtggtgaagccgagtttgcgcacagcatcctgctgcatggtggatgtggtaaacggcgcggcggggttgcggctgcgctttttcttttcgatggcggtaacgacggcctctttgccttcgagttctttcaacacatcggcttgagcggcttcgttcggcaggtcgaattgttcgagtttcgcgccgttgtattgggcgagtttggcggtgaacttgctgcggcctttgtggctgtctagatgtaccgtccaatattcctgcgcttcaaacgcgcggatttcgttttcgcgttcgcaaatcaaacgcagtgcggggctttgtacacggcccgcgctcaaaccgcgacggatttttttccacaacaatggcgaaaggttgaaaccgaccaaatagtccaaagcgcgacgggcttgttgcgcatcgaccaagtccatttcgatttcgcgcggatgggcaacggcatcgagcacggcgtttttggtgatttcgtggaacacgacacgctgcggcttgatgtttttcaagccgcgtttggatttgaggatttccaaaagatgccaggaaatggcttcgccttccctatccgggtcggtggcgaggtagatgttttcagcttctttggcaccggcgacgatggcatcgacgtgtttgccgttgcggctgatgagttggtatttcatcgcaaagccgttgtcgggatcgaccgcgccgcttttggggacgaggtcgcggacgtgtccgtaggatgcaaggatttcaaaatcgccgcccaaatattttttcagggttttggctttggacggggattcgacgattaataggtttttcgccatttgtcgttctctggatggtggttttgatgccgacgtttcagacggactcgggcgggccgtctgaagccgcttcagttcatcgtgggtttgttgtcgagtaaaagcgcgctcatcagctcgtcgccgaccaacacgggcagctcgctcttgtttgcccataaaagcagcagggtcagcactttggcggtatctacggtaatttcgtcgcccggaatgtgcatgagcgcgtggatgatgatttcccgctgttcgcagctgacggctttttcttcaatcagatactgcatcagccccatcacttcctgcggcaggttgtcggtttcttctttgctgtacacgcgcaatgcgccgctgtcggcgggttcggcggaaaattcggagctgttgagcaatacttccatcatcatcagggtgttgccgatttccatcgtatcgaaacccgcttcttcaagcagcatacccaagtcttcgggcggcgggcaggtatcgaaatcttggaaatgttcgatgaggtaggcgatgacttcggtcattcgtgttccttaatataaagtgcgttcaagttcggatacgctggtatctgccgccgggcattgcggcaacgctgccgtccaattccaattccaacagtgcggcatacaaatctgcggcaggcatagccaactgtccggcaagcacgtcgggatgaactgggtcgaaacccatcctgtccaagatactgccgccgacgggtcggttctccgtcttttcagacggcattttgccttcaggcagagacagctggtcggatgccgtctgaacggcagtgatgcgcttttcaggtattcccttatttatagaatatgatgaagcacccgtattttgcaatagccccgggcattcgttcaggatgtcgtccaggcattccaccaattttgcgccgtctttaatcagtttgtggcagcctttactgtgtggattgtctatcgagccgggtaccgccatcacttcgcgccccatctccgccgccaatctggcagtaatcagcgaaccggattccaacgcggcttcaaccaccagcgttacttgcgacagggcggcaatcaggcggttgcggcgcggaaaattgccggcatacggccgcgtgccgatggggaactcgctgacaatcaatcctttttcggcgatttcataggcaaggtttttgttgaccggcggataaatgcggtctatgcccgtcccccacacggcgatggtgccgccttctgcctgcaacgcaccctgatgggcggcggtatcgatgcccgaagccatacccgacacaacgggaatgcctttcccacccaacgacttgccgaaatctttggcaatccgcatcgcctgcggcgtggcatgacggctgccgacgatggcggcggaaggtttgtgcagcagttgcacgttgccgcgcaaaaacaaaaccggtggcgcggtcagcccctgcgtcagcatttcgggaaaatcttcatcctgaagcagcatcaggcggcatccgtcccgcatttcccattccaatgccgcttctgccgcctgccgcgccagagcgcgtttttccgcattgcgccaagcctcaagcgcctgtttgtgccgtatcagtgccgccacctgttccgccggtgcggacagggcattttgcgcgctgccgaaacggcgcatcagcagcaggaaactttccgcgccgatatagggcgtaaacgccaattgcagccacgcgaaacgttcgtcctctgtcataaaatccgtccccttacgatttcagacggcatttgcaccaaatgccgtctgaaaacaaaagcccgcagccggtaaaccggccgtccgggcctattcttcggttttttcccccgcccggcgcgaaacgccgatgccgagctgtttgagtttgcggtaaaggtgcgtgcgttccaaaccaactttctgcgccacttggctcatattctgaccttcttgggcgatgtggtactcgaaataacgccgctccacctcctccctcaattcgcgcaggggcaggttgaaattaaacccgcccaccatatcttccgccccctcggcaggcacattctgccccaaaagggaagaaaccgcccctgcgccgatttcctgtccgtccgcctccaacaacagcgttgcaacgacgctttgcagttggtcgaaatttcccggccagtcgtaacgggtcaatgcggcaagtgcctcttcactgaatgaggcaggcgcaatcttttggctttccgccacattgcaggcaatcccctgtatcaggaagggaatgtcttcatgctgcatacgcagcggcggaatacggacgaccgattccgacagcagttccgccagcttttcctcgcaggcaatgccgtctgaacctgccgccctgctgcccgatgcgaccaccctgacgcggcggtgttccgcctttccgacaataaaggcaataccggcttggatgttgcggctgtactgggcgatgtcgccgacatacaaaacgccgccctccgccttctgcaacagttccatcggcatatcgatcagatattcgacccttgccgggctgacccacggcgtaccgtttttatggaaatagcgtgccaccgtttcaaacggcgaacccgcctcgcccgtcaaaagtacgggagaggcacatttcaccgcagcccctacctcacggttcatttcctgaatcgccgcactgttgcccagcttgtcgaatacaggccccgtttcggtttgcgccgcaccgtacttcaacgcgttttcgacggcagacagcagcttttgcagggaaatcggtttttccaaaaaatcgatcgcgccgattttggtggcttccacggcggtatcgatgctggcatgcccgctcatcatcaccaccggcatattgagctgcccgtttttcgcccactccttcaaaagggtgatgccgtcgcaatcaggcatccaaatatccagcagcaccatcgcggggcgcgcctgatggcgcagcttgcgcgcctcttcggcgttttccgccaatgcgaccgaataaccttcgtcctgcaggatttccgacagcaggtcgcggatgccgatttcgtcgtctacaattaaaatatcgctgctacgcataagtttttaccgtttttggcaagatgattctgacacacgcgccacccgcatcctgattgctcaggctgatgcggccgccgtgttcttcaatgatttttttcaccacaggcagacccaatcccgttcccgccggtttgtccgttacatacggctcgaaggcgttgtgcagcatttccctgccgaaccctttgccgttgtcgcaaaccgtcaggacaatccgaccgtcctgccctgtttccgattttaccctgacttcgggcacatcggcttcttccgccgcttcggcggcatttttgaaaatattgtgcagcacctgccgcatggcggtcgtatccgccgccaccgtcagcggttcgccggcaagctccgccgcaaaccggcacggaccggcttcatacaatgccaacacatcgccgattaaggcgttcaaatcctgattttccaatttgagcgaaggggaacgcgcataattgcggaatgcttcgaccatttccttcaatgccgccacctgtttgacgatggtgtcggtcgaacgcgtcaggatttgcgcatcctgctcatccagcttcccgcccaatttccacgccagccgttcggcggaaagctggatgggcgtgagcggattgcggatttcgtgtgccagccgcttcgccacttcgccccacgcggcttctttttgcgcgtgtatcaaaacggtgatgtcgtcaatcaccattaccacgccgttgccgttgtcttcgggcaggacggttgccttgcccagcaggattttggcatcgtccggcgcggcatatttcacatggaccggtttgtccgtacctgccgccgcgccgatggcggcaaacacttcggcaagcagggactgctgcgccgaaacgccgtgccaaccgtgccggctgctgccccacaggggggtaagcggcatccccaaaatctgttccgccgctttgttgaaggttttcagacagccttgttcgtcaaacaccaccacgcccgtggtcagcccctccaacacgcattcaagataatgcctggcggcttcctcgcgccggcggttgcgctcgtctgcttctttggcgatggaaagctgctcggtcatgtggttgaacaacttggtcaagcgtccgaactcgtcgttgcgcaacacggggcgcgtctggctgaaatcgccttgcgccaccgccttcgccccctcggcaagcgataggacgggttcgacgaaacggcgggcgaaatacagtgccatgaccagtgcaagaaaaatcgacagcagcgaggcaatcagcagggttgccaggaaaaaggtctgcaaaccttttttgctgtaactcaactcagcatatttcgcccttgccttttcgattaagacggcatcctctgccacgcctttgggaaccggctgacggaaaaacaaggcgtaatcgcgcccgttgtgcgtacccgccgacagccagccctgcgcgtacaatacgccgcctatgctttccaaatccctgaccgaacccgcccgttggattttttcccaacgcgccttacctggaaacggctgatcgagcttgtgcgggttgatgcttttttcgattttgccgcttgcggcattgtacagggcaagctgggcaaaaccgctgccggcgtaatgttccagcaccctgcccatatccccgggcagggaagccgcgccgatgaggtctatctgcacggggacggcgttgccgagggcgttgtctgccgccaaattcaatgcggacttgctcaaattgaggctgcgttcaagcgcctcgtgggtatcgttgccgaaccacgaattaatcgtgccgttgatgaactgtgcggaaacgccgaacagaaacacgccgggcagtacggcaaccagcgtaaacatcccagaaaggcgtttggcaatctgcgaaccgaatacgccgtcgcgcctgtctttcaacagcaatatgacataacgtgccaaaacggcggacaacaccagcagcagcattgcgctgaacgcaacaatccaccagaaataatccgccagcgaactggtgctgccggttgccgccgtcagtccgtacaacaggacgacggcgcatatggctgcgatcggtagaaaacggcgcattatttgttcccgatgatgtttagaggtttccaacccgaatccaaatgccagttttgagaagtcaatgcattgatttgaaaaggcttgggcagttttgaagtggacagcgtcaggcggatttccgccttggtttcccctgcttccgcaccggacagcgcgcctttgttcaggactttccagttggcaaccgcgccggtcgcgcgcaatgccgcatccaaggtgtcgtagtctgtcgaaaacgcgccgacggtaacgcggtagcggttggtcagcggatggaaactcagtttgtagtcaatattgtcgtcatcgccaatcagttgccccaatttaaaccgataagaagcgattatcggggcggaaagctgccagcttaaggtaaagttgagcggcacgccccggcgcaacgcctgttggagctggtcgggcagctcggtttggaagcggctgctgatggaaagctgcccgccgtcggttatcctcgcttcggcacggctcacatctatcccctccgccgccacattctgaaaggcggggagcatcagcggcacaatcagccatttactgcttttgaataagcgcgtaataaaagccatcttggtgtttgttcggtaagagtacccgcgattcgatcagttctgcatcggcatggcggttgaggaatttttgcaattgtccgtcgttttcctcgacgaacacggaacaggtagcgatcaacatccttcccccgcttttcagcacctgccacaatgcatctagcagggcttcctgctggcgggcggttttgagcgcgtcggtcggacggcgtagccatttcacgtcgggattgcgccgcgccacgcccgaggcggtacacggcacgtcggcaaggacggcatcaaacggtttcccatcataccatgccgacaggtcctgtgcatcggcacacgccgtcgatgccgtctgaaagcccagacgcgcgatattgtcttccacccgtttcagacggcctgcatcaatgtccaaggcggtaacacggcaatccgccagttccaagatatgccccgtcttgccgcccggcgcggcgcacgcgtccaaaatccgttcgccgtctttcgggtttaacaaatacgccgcctgctgcgcgccgaagtcctgtaccgaaacaatgccgtctgaaaaaccaggcaggcggttcaccggcacggcttcttccaacgtaaccgcatattcgtccaacgccttagccgcgataccttccgccaccagtttttccaaatagctttcggcattgccgtgtcggcggttgacgcgcaaagtcatcggcggatgggattgcagcgcggcggcgatgttgtgccagtgtttcggataatggtttttcaagtaagccacccaccacagcggcaggttgtgtttcgctacatcgtcttttttacaggaagccacaagcttgtcgcgttcgcgcaaaaagcggcgcaaaaccgcgttggcaaacgaacggtactgcccgcgtccgattttcgcgatgctttccaccgcctcattgaccacggcgtggggcgcgttgcgcgtgtaatgcagctggtacaacgccgccaaaagcaggctttcgagctgcggattgccaatcggctttttcagcatctgcgcgagcatatgtttcaaactgcccaaataacgctggcagccgtaggcgatgtcctgcaacgcgccgttttcctgcgccataaggtcgggatgcgcggtgcggatttgcgccaacacgtcctgaaggttacgtccttcggcaaccgccgcaatgctgtcggcggcaagtttttgggcaagtgccatactcatattatgtgattcgctttcttcgactgatggtttcagacggcattcccgtttgcggatcggaatgccgtctgaagggatttacagcttcgcccctgcttcgatatgccgtcctgctgcaaacgccgcgatattcatccgcctgccgccggcaggctgcaattcggtaatcttcagcgcgttttcgccgcaggcaacgaccaaaccgtccgccgaacaggacaacacttcgcctgccgcgccttgttgcgccaccacttccgcccgccggattttcatcggcttgccctgatactcaacccacgcggcaggcacggggttgaaggcgcggattttgcgttcgataaccgccgcgcttttgctccaatcgatacgcgcctcttctttgctcaatttttgcgcgtaagtaacaccttcttcgggctgtttgaccgcgttcagacggcctttgctttgaagctgttgcaaatcggcaacaaccgccgccgcaccgatttccatcagcgcgtcgtggacttcgttggcggtatcggtcggttggatggcgtagcggtgttcgctgaccacatcgccggtgtccaaaccgatgtccatctgcataatacacacgcctgtctcggcatcgccggcttcaatcgcgcgttgaatcggcgccgcgccacgccaacggggtaacagcgaagcgtggatgttgaggcagccgtgtttcggcgtatccaacacttcctgcggcagaatcaaaccgtaggcggcaaccaccattacgtctgcctcgacctctttgagcatttgcagggcttcggcgttgttgcgcagcttttcgggctgttcgacgcgcaaaccgagttccagcgcggcttgtttgacgggcggggcagtcagttgcataccgcgccctttcggacggtcgggctgggtcagcaccagcggaatttcaaaaccggcggcggcaacggctcttaaggcggcggcggcaaaatcgggcgtgccggcgaagatgactttcatagcgtgttcctgcgcgtgcgtaaaattgtcggacaagaccgtgccgtctgaaaactttgcagcgttcagacggcacggcaaaagggtcaaatcgtatgtttctgacgttttttcagcttggtcttaatccgcccctgcttgagttgggaaaggcgttcgacaaacacgatgcccatcaggtggtccaactcgtgctgcacgcaaatcgccaacaagccgtccgcctccagcgtgaacttttcgcctttttcgttcaaagcctcgaccttgacgcgttcggcgcgggttacggtgtcgtaaatgcccggcacggacaggcagccctcttcgtaagtggtttcgccgtctttttcaacgatgacggggttgatgaacacgcgcggttcgctgcggtcttcggtcaaatccatcacgaccacgcgctcgtgcacatcgacctgcgtcgccgccagcccgatgccgcgcgattcgtacatcgtttcaaacatatcggcaatcagcttccggatgcgctcgtcgacttgttcgacaggctttgccaccgtgtgcagacgctcgtcgggatattgcaagatattcaataaagccataattttctctttccttcggcggatacgccgcctgtttttcataattaccgtgatggtgcggataattcgatgttaaaatgcggaacattttttatcacgcggcacatcccgaggggctgccgccgctttttccaacccaatcaagcaagacaaaccgaaatttatcagataaggggaacggttatgcaacgtcgtattataaccctgctctgcgcggcaggtatggcattctcaacacaaactttggcggcaaatttggaggtgcgcccgaacgcgccggaacgctacacggtcaaacagggcgacaccctgtggggcatttcgggcaaatacctgtacagcccgtggcaatggggccgcctgtgggacgcgaaccgggatcaaatccacaatcccgacctgatttatccggaccaggtattggtgttgcgccacgttgacggcgaaccgcgcctcggcttggaacagacagacggcatccccgtcgtcaaaatgagtccggataaggaagtgtccggatacggtattcccgccatcgatgtcaacttctaccgcatctttatgcggcatccgcaaatcgtttcccgcaaagaaaccgctgccgcgccgcgcctgctctcgggcccggaaggcaggctgctgtacaccaaaggcaccagggtttacaccaaaggcctgaaagagccgggccgctacctgacctaccgaatcaataaaaacatcaccgatccggatacgggtaaattcctcgggcaggaagtcgcattcagcggcatcgtgcgctccctcgactataccgactctgtcctcgaacaacgctcgaaacaggctggagaacggccgaaagacaacgaataccatacccgcacccatcctttgattaccccgctgcgcaccccttcgatacagccgctggtggtcgaaaccgccatttccgaaatacagcagggcgactacctgatgaaaatgccggaagacaccgaccgcttcaacatgatgccgcacgaaccgtcccgcccggttcaggctaaaatcgtttccgtgtttgaaggcacaaggattgccggccagtttcaaaccatcaccatcgacaaaggcgaggcggacggtttggacaaaggcacggttttgagcctctacaaacgcaagaaaacgatgcaggtcgacctctccaacaatttcaaaagcagggataccgtcgagctgatttccactcctgccgaagaagtgggcttggcaatggtttaccgcacctccgaacacctgtcgtccgccatcattttggaaaacatctccgatatttccgtaggcgacaccgccgccaatccgggacgcgatttggacaatataccggatcagggccgcagccgcgtgaagtttggcttcaaccgctccgaataattaatcatccgacaaaaatgccgtctgaaacaccttccgtttcagacggcatttttccatcttcaataaaatatccgtttggacttttccgatgtttttgaaatctcctgcaacgcctgattgagtgcgcccaactccaacgccgtttccgaacggcaggcatcgccgaagatgtttttatattccgccgtcagtttcaacattcctttgaacgcgcgcccttccaaagccgccgacaactcgaaaatatcggcgaacacgcgtccataggtttcgcccgaggcgaccgcgtccgtccccaatgcgaacatatccatttttgccaactcggcggcaatcgtgcgcgcgtcttcgtcgtcgggcagcacttccgccttgaacctgacctgttccgccatccctttgccgtggtttttgaccagcagggcgagtatttgcggcttgtgttccaagtgttgcaaagaggcgtgcaggacggggtgtatgctttcgttctgtatcattttttcgcggtagaacttttccgccttggcctttgaacgcgccgacacgaacgcccacgccagccacaccagcgcgacggcggacaatgcggacagaagcggaggcagctcttcagtataggctttctgattgaaccagatttgcgcggtcaaaaaaccggcaaagaaaatcaaaacataaagtatcggtgcgaaacggctttggacagaagcgtgcatcatcattccatttcagattggcaaaacaggcggcagacgaaatgccgcccactcggtttaagggaatccgtcaggcttccgccaccgaatcccggctgtaggttttttcgcagtagtggcatttcagccgcgtctgcccgttgtgctttttaacataaaaccggcttttgaccggctcgccgtggccggcgcaattcgtgttcggacagcggaacacttcggcgatttcgtcgggcaggttcaaatgccgcttctgcacgaccttgaaattgtcgatggtgttgaccaccgcttcgggggcgaacagggcgaggcggtcggcggctttgtcgtccaagcacacgcctttgattttgatgatgtctttgctgccttgggttttgctgggcaggttgaagcccacggttaccgcgttgccgtagtgcaaaagtttgaactggcgcaggatggtcagccccctgccggcgggaatatggtcgataaccgtacctttttcaatggcttcgacactgagtttcggggtttccatatcggttcctcacacttcttcgttcaacaccagcgacaatatcgccatacgcgcataaacgccgttggtcgcctgctcgaaataataggcgtgcggcgtggcatcgacatcgggatggatttcgtccacgcgcggcagggggtgcagcacgcgcaggttcggtttggcgcgggcgagcatagacgcttcgaggttgaatttgccttggattttggcaaattcctgttcgtcgaaacgttcgcgctggacgcgggtcatatacaggatatccgcccattccgccgcttcttccaaactaccgaggatacggtatcggcagccggcttcgtccaactcttcggtaatatagtcgggcatggctaggctgggcggcgaaacaaaggcaaattcacaattccagcgtttcaacgcctgacaaagcgaatgcacggtacgtccgtatttcaagtcgcccgccatggcgattttgagcttgtccaaacgtccctgtgtttcataaatggtaaccaggtcgagcagcgtctgactggggtgctggttcgtgccgtcgccggcgttgataacggggacgcgcgaaaactccgctgccacgcgcgccgcgccgtctttggggtggcgttggatgatagcatcagtatatccggaaatgatgcgggcggtatcggcaagcgtctcgccttttttggcactggtattcgcgccgtccgagaaaccgatgaccttgccgcccaaacgctgcaccgccgtttcaaacgacagcctcgtgcgcgtggacggctcgaaaaagcacgaaccgataagtttgccttccaacaggtcgccgcgcggatgcgccttcagcttcaatgccgtctgaagcaggcattccaactgttcgcgcgacaaatccgaaatggagatgatatgctgtctgtaaagcggattaggcatttttgccccccttccgtaaaaaacccgcgtcaggcgggtatccggttatacgtcgtccacgccgcccgtatgtttgcggaacagcttcgcaaaagcggcaatacggcgcgtattatcgcacatttgccgccgcaaagttttaccgcacgaatcccgtacttttcagacggcatatccaaacacgcccgcataagcataaggtataatcgcgctagacatttcttttcaggaagccgccatgttagtctgcaacccctacgaagtcgtcatccacggcacaacgagttccggcaagattttccgtcccagcgactgggcggaacgcctgtgcggcattctgtcctcgttcaccaaagaccacaggctttcctattcgaaatgggtgcgccccatactggtggacaacatccgctgcgtcgccgtcgataaaaaactggaaaccgacaatccccaaatgttccgcttcctgatggactttgccgccgacaacgacctgcgcgtcatcgactgcaaagccctgctcgaagaacgcgaacagggcggacaaaacaaccctgccgacgaacacgtcatgctggcacaggcaatcgaagaaaaacacgccgccgagaaagcacaggaacagaccgcctcgggcgcatcctacgttttgcgcgaaatcggcgcggacgacaccgccaccgcctttgcagccttgagcgttttgcgttccgccctgaccgacatcaaccgctttaccgaacagatcaacaaagtccaacgcccccaaggctaccgcctgctgggtatttttgaagaaggcaaacacaatgccgtcgccgtctgcggcttccgcgaagcctgcaccctcgccagcggccgccacatccacatcgatgacatcgttaccctgccgcaaagccgccgcaaaggctacgcctcgcgccttttggaagaagtccgcaaaatcggcgcggaaacaggggtaaccaaaatccacctcaacgtccacgtcaaccacgaccgtgccgacgcgcaccgcctgtatttcaaaaacggttttgaaatctgcgcataccacttccgttgcgaccccaaatgaaaacccccctccccatctgcaccctgtcggcactcgccgcctgcaccctttccggacaaggcggcagcagggtttacggcgaaatcaaagcccgagacctttgcgttaccgctcctatcctgctttctgctttctgtcttgcctgctctcgttgagccaagcgttcttgcaagctcgcttgcacgttggcaagcattgcactctatcggctttcttttcctgttgcggctggtggttcaggctcgcgttgtacgctttgcactaaagcgcaccgtgaatcgatgctcgctatttattctatcaatattttgatttataatgaaaaaagttttttcagagtgactctttactttgtaaaaaactttgtatcattctcaaaacctagaaaatcaaacgaaatgatgcaaaaacacaaatgtctaatagattttattttgactgttgccagccaaattgcttatgctgacttacctttaagtttggaagaattattgactgacaagggtaaattcaaactagaaagcagtattagctacatcaacactgaacgcaatcaaagcgaatttgctaatcctatttatgtgcaaaccagcgcaacgaaaattgcaactgtaatggctatgatgattacacctgtaatggcgcaaaatttagacagccaagtttttgacagccaaaatgtgaaagcaattcaattatcacaggctgaaatgaaagaaacacaaggtgaatttgttcccattattgcagccgctgcttttggcggtgcattaggtgcatgggggtatcatggtgctaatttgtataatcatggtaaattaggaactgcgcaaggcgcggctactgcgacaggaatcggtgcggcaacaggagtagcggcaaaacagggctggctgctgctgccggaggcggattggctgggaatttggcatggagaccgggtattcatgcactaggttttggtgccaatgctgccaacaatgcagtcaattctcgaaaataatcattaataacttttagttagctaactaatttccacaatagaattagttagctatttattaatatagagtttgcatgatgatgggtgtattaattttttttctaatcgttccaattttgggatttatttgcgctacgataaattattttattattaataaatttaaacttccaaaatacatggcgtatttactcccatcattatctattttattcatatttattcatgcaataaaattgcatatgattttatttttttatgtttcatgcgtttattccgcgtatacatattatgataaaaaatctttataaattgataaattatgcggctttgattggtttcgccccaaatatagtttttgcttggcctatgtttgttgaccccccgcttcttaccaaaacatccatgtacggagttggaaagcacggcgagattccggcatagtaaaacaagatttggatttttcttgcggcgcggcttcgattgccacgttactgaataatttttatggcagacattattctgaagcggaaatcttagacaaaatggataaaacccaaatgcgtgcttcttttgacgatatgcaacgcataatgcccgaactgggttttgaagcacaaggttatgctttgccatttgaacagttggtacaactaaaaattcctgtaattgtgtatttaaaataccgtaaaaacaaccatttttcggtattgaacggtattaacggagaaactgttttgctggctgatccatcgctggggcacgtctcaatgagcaaatcacaattcttgagcgcatggaaaacacgtgatggcgaaatggaaggaaaaattttagccatcgtgccaaaaaatactgattttgttagaaatcagatgttttttaataagaatcccgttcgtcaaacacgttttacggtagaacaaatccaaatgcggcaaaaacgataataaaccgatttttgcccatttattttatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaagcaaagaaaccgccattagcactacaccccccaagctgcggctgccaaacacatcggctgcttctcgacgcacccgctgaaaaatgcgtcctatccgtccgccttgcccgcaccccctgactttgccgccctgcccgatgccgtctgaagcctgaaccgccccaccagcccgatgacgcacgacaccgccggaaagggcatacacaaagccgtcagcacataacgcgcattccccgtattgaccacgtccgcgcccttcagcagcagcggcagcgcgttcgcccactcccacaccgacggcgcgctgaacgccaataccgccaccagccccaacatccggaacaccccgatttccaacacctgccgccgccgcaccgaacggttgagcaaaaacacaaccgccaacccgaaacagaccaccgccgccataccgccgttggcgacaatctgcaaactgttgaatgcaatatcgggcgtaaccgccaacacgccttccgaatccggcacggcacgctgcaaatccaaaccctgcaacacattcaacacaaaaccgtagatcaaatcaaaaaacaccacgcctatcggcaaagcactcaaaacccgccacatcttcctgtccgaccaaccgttcaaaactttcattttacccgaccacgcaagccgccgaacaaaaaacaaggggctgtcctagataactaggacaaacttgattttactaattgttttaaaatggaacaagaacttttatctcactgttgttaaaacgccattcgcactcctttaaatacagctcaaaatgcgctttgggaatgccgttaaacttgcgtaaatgacgttttgcctgattccaaaagttctcaattccattaatatggttttgtcgttcggcaaaatgtgtgctgtgattgatacgaaaacgaagtttcagcgaagctaaaatggctaaattcgcgcacatctaatacatcatagctacgataacaatccgtataaaaaatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgtgacaaacagttcaatgagtttattttgtttatactggcttagacgactttttctcatagggataattctaacttaatttgaatttccctagttatctaggacagccccttaaaaaatatccctttgaaagattttgatgaagtttgtgaaaagtgggagaaatcctttaaagaaaatggaaaagaaattgaatataatcaaaaatattcaagaatttatggtgaagttcgtggagctggctttaatggcgatatcggagaaaagctacatcgttgtgccgtgatggaatgggctgaaaatgagaccgtgaaattagcccaaaaatgggaacaagagcagaaaaaacaacaaattcaacagaaaaaggaaactgaaaaatcgccaaaacacaaagccagtcgtgatgattgggaaatggaacgttaaaccgctattttcatgtattctattaaattatttgaaaaaagacttcactttttgttaaagaaaaatgaagtcttgttctgttcaacctaaattcagaattttatctgccgattgaattgtttcttggcggtgtgcaaccattattttcataataccaagactttttaggttatggttaattttttgttcattttctacatctaaatggctacttgcttcgtctaaaaatagaattttgggtcgtttatacaatgcacgagccaagataactctctgcttttgtccacctgataagatatttcccatatcgccaatcaaggtctcatagcccattggcattttaagtatatcgtcatgtatttgtgccatttttgcacattgttcaatgagctccatatttgggctttcatcaaaaaatgaaatattttccccaatagaacctgcaaaaaggacatcatcttggcgaacaatcccgctcaatcccctaataaaggatggagaaacttgatatatatcatgcccattaatactaactgtaccagtttcaggttttaggctacctgttaaaatgtttaacaaagtggacttcccccgaccagattgtcctgttaaaacaactgcttcattatctttaaattccaaattaatgttttcaaaaagatatggctcattatcagcatatctgaatgagacgttttcaactttaagaaccagttgttcattatctaatttaggtatatgattatacttaataatttcagtttctgtttcatttaaagtaatgtcagccaaacgttcagcatgaagccctaacattttgatttggatgtattggtcaacgagagaagctgttctgctttcaaattgccctttataagccaaaaaagccatcagaacaccgactgtaaatgaaccatctaaaattgcgcttgcaccaagataaattatgataacattttccatgctaaacaacagtttatttgaaaattcaaataaagcagagagtttatctgttgtcagcttggtattgactgtattcacaaataggctcatccaagtgccatgtctttgataatgtttatcaaataatttaactgattggataccacgaatggtttccatgaaatatgagttttgtttggcttcatgaacaatattttcttctgttgcatttcttaatgggtaatatgcaagccaacgaattagtatgtacaaaacaagtgttaaaagaacaatcagcgataattgagtgctgtaaattgtcattaacacgaaagtaaaaacagccattaagctatttaaaactaaaacaaaaaaagtagaagttagtgtttcttggatatgatctattgaaccaaatcttgaaatcacatctcctaaatgtcgtttactgaaatagtcattaggtaagtcaagtaaccttttaaatatattggctttccattgtaaattaagagttgtagataggtgcatacctacccatgcttgtaacaggctaattaactgttgcaggatagtcagtaaaccaaatcccaaagtaagggtcaataataaatttttatcagcagttacaatgacatggtctattacccattgcataaagaatggactaaccaatgcaaagacttccaaagaaatagctaatataagcatttgaattaaagagcgttttaagcctgacccccccttaatagagataatattttgattttctttgtttcttttttctcttcaaaatgggtattggggaataattctagggcaatccctgtgaatttttgtgaaacttcgtccattttgatttttcgcataccgacagcagggtccataatgacgatactgtctttggaaatggaacaaagtacaacaaaatggtttaagttccaatggagaatgcagggtagttgtaaatttgacagctcatctaactctaaacgcaaagctcgtggcgttaaattcatttcattgccaaatctcatgatgtctgcaagatttgcgccctttaatgacagggtgtatttttggcgtaacgttcttaaatcagtgtgaaagccataataggacaagatggatgtcaggcatgctaaaccacattcagcaacttctgtttgcagaatgacaggtagctttttgttaaatccaaaggacagtcttgataaataatccatttttaattgatttttcctgaaatgctgtaaagtgggtcaagtacccattcgtacaattttttcgttcatggagaatatctgcttctaaaatcatgccaatttgaagcggcttgttttctccgtatgctttaatcgtttgtttttccaatttaactttcacaagataggcaggttcatttaataaggttgggttagtgaaaatgatacctaaacctgatagcttttgtttaccgagagcagttctggcaactgaaataatttctcctgtggcatgtccaaatttttggtaagggtacgcttggtaacgtaaaacaactttatctttcggtttaataaaaccaacagctttactgggtatgtaaagattggcgaccaattcagtttgttcagggacaatgcttaacagcaatttagacggttcaacttgttgccctatatcaacattaattgttgatatataacctgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagattatttttgcaaaggtctcaacctgatttactagctcgtatggtttgttcggatttcaaatcaaaatccaaaatttcttggttcatttccgtaatcgcacggttgagttggctcaattcggttttatggcgttcaggcaggctgcttaatgtgattttctgttcatcaagttccctgattgcattattttgttcacgttttaggctctccaaacgtgagcgttgttccaataaatggctttcggcggtcatcttatcttgttgggatactgcgccttgactggctaaaaacttgttcttgttaagggttttttccgctaaacgaatttgacgattttgccctgtaatttgctgtttaatattctctaattgattgtttaaacgatgaatgttgttatgaacatttttttgctcattttgatgaatgcgctttaaacgttccaattcttgtaatgccaaagtttttttaaggttggcttctgctgccaatttggcttgtacgtttcctttttcgccaaaacgcgatgtggaaagtttgaacaatggttcgccagctttgacaaagttaccatcttcaacaaatttatgcgtaatcgtgccgatatcggaagagtaaacacgaaccacccccatagttggaagtaattgaccttcaacggttgttttattggtatagctaccaaaaatcaaaaagataatgatacacagagcaatgagaaaagcgcaaaaagtcagaaataaaaaagagaatggacgggtcaagataacctgacctgtccacttattttgttgggctacaaagacttcttttcggaataagtgggacatttattattatttcttaaaaaaaaatggatagaaaaataccaataattaaaatacttatgcctaataacataaatttgctattgattgatgtttctattttaattacattaaatttaaccaataatccagaaatggttgcagctaaaatgcaaaagacagtggcgtaaatggtttcagtattcataatttttctctttcaaaattgttcaatctaaatagaaaaaggtaacttcaatacatattgctgtaactgaaattaccttttccttaatgatgtaattatcttatggcttcatcatgccacgaccgatattgtatccgccagcaacagagaaaataccagctcccattgcgtcaacccagcctactggtcctgtccacttgttccgttgagctacaaagacttctggtctgaaaaatgagtgattgttagacatgtgtacttatttatgtttctttgattgggataaatttgtaaaaacaaaaaaaaggcaagttgttattatagaagaacttaaaatgcttaacatactcattgaggtttgtaccacataatgagatacgagataatttgttgggagtaaaatcaaaaaaaagattaaatatttaaaataatcactatattttttcattatttgttcctttttgtatttaagttcttatgaaaaactagggtattttgaatagaaaatatcaaaataccctagttttattaaggaatattaccaccaacaagtgcttccatattgtacagcaccagtgattgcaccaccaatagctccgaatttcgcacctggaatagcaccaataccacctgcaaatgaaccaacaattgccccaccagctgctccacctaatgcactaccaatggtattttttgagaaatcacgccagttacaagcagcaccagaaacttgttaaatttcattcaaagtcaaaacttgcataatattcacctttgttaagtgtggttgagaaaaaagtaaattttcatcgttactcattatttgcaatcatgcatatactgtaaccaagcactatattcagttggatcatagtttttcctactgggttgtctgatatgactattggcactattggcacaattgggattagcaactttattgtgagtacctaatggattgatatttcctgtaaagtggctattgcatgcgcttaatgagcatagatttattaatgtcagaaaggataaaacaaaaaatcttaccattttttactaataccaaaagtaggtttcgaaaactgtacaccaagaccttgtacatatccaaattgcttgctaacagaaaactctactccactattgttaggggaataggaagcaccaattttaccaacagcaaccatatcttttttacctaggttgccgccaccctgtgcaaagatatggaatttgccacctgacacttcaactaattcagaggtgtgtaactctttcatgattttctcctgtaaagaagtatggttggaaatgtaaatcagaattaacctttcttaagtttaatttaatactttttttgcaagtattttattttaaattaaatcaatattttaaaaatatttacttgtatactgaaaaagaaactcctaatggtggagtggggcttttgtttaagtaagcattaaaaaaatttaaatttcccattatgattaacttaatgcaagagctttttcaggacgtacaaaccagcgaacgggcgttctgatgtgggcagcctgccgggaagtctgctctattgttcggacaatagggggaatataccaattactttaactacatcattttttgacatttttcttgcctttcaatttaaaatccaaaatcatactgccataatttagcaatccaaaaaaatttaggcagcagtaatggtttcgtattttagaaaacgaaacttggtttggtgttttgaagcatttcagtacacaaacggggctgtcctagataactaagataaactcgattttactaattgttttaaaatggaacaagaacttttatctcactgttgttaaaacgtcgttcgcactcctttaaatacagctcaaaatgcgctttgggaatgccgttagacttgcgtaaatgacgttttgcctggttccaaaagttctcaattccattaatatggttttgtcgttcggcaaaatgtgtgctgtgattgatacgaaaacgaagtttcagcgaagctaaaatggctaaattcgcgcacatctaatacatcatagctacgataacaatccgtataaaaaatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttctaaatgtgggctgttttgataaattaagtcatcgtaaacgatgaaaataataggctgcggtatttttattaacgcctactaactctgctgctgttcttgcagttacacctgcgacaaatagctcaatgagtttattttgtttataccggcttagacgactttttctcatagggataattctaacttaatttgaatttccctagttatctaggacagccccaaaataaatttagcctaagtcataaaaccgtgtaattttgcgccaaaaaaggcggtttgcaggtaaaatatcaaactattaatttaaatcatatttttacagaatattccgccgcgttcatcaaatggacatcaaaccggttccaaatttctgtaattttgtaacaaaataccgcaaaacacccgattgagaccaaaaggactttcatatgaaccagacaagccgcgatctgacccgcatcagccacaacactaaaatcgtcgccacccttgggccgggcagcaacaacgtcgaactgttggaagacatgatccgcgtcggcggtctgaacgtcgtccgcttcaacttcagccacggcacgcccgaattccatcaggaaaacgccctcatcgtgcgcgaggcggcaaaacgcgccggacaggaaatcgccatcattgccgacctgcagggcccgaaaatccgcgtgggcaaaatcgccggcggcggcatcgaattgaacaaaggcgaaacgctggtactggatgccgcgctcgaaggcgaaggcacgcgcgaggcggtcggtttggactaccgcgacctgcccgacgacgttgccgcaggcgatgtcttgtggctggacgacggcctgctgaccctgaccgtggaatccgtcgaaggcagcaggattatcacaagggtggaaaacagccacgtcctgaaaagcaacaagggcatcaacaaacgcggtggcggtctgtccgcaggcgcgttgaccgaaaaagacttccgcgacctgaaaaccgcgattgccatcggttgcgactacctcgccatcagctttgtgaaatccgccgaagatttgcatatcgcgcgcgccaaagtcgaagaagaaatgaagggcagcacggccgtgcgccccggtttggtttccaaaatcgaacgcgtggaagcgattgaaaacttggacgaaatcatcctcgccggcgacggcattatggttgcgcgcggcgacttggcggtcgaagtcggacacgccgccgtccccgccctgcaaaaacggatgatccgccgcgcccgcgagttgcgccgcttcagcattacggcgacgcaaatgatggaatcgatgattaccaaccccgtaccgacccgcgcggaagtcagcgatgtggcaaacgcggtattggacggtaccgatgcggtgatgtgttccgccgaaaccgccgtcggcgcgtatccgtttgaaaccgtcagccaaatggcgattatctgcgcggctgcggaaaaagagcaggattcgctcaacggcgttgccgaacaggtcgagtatcccgaagcggtcagcaccaacctggcggttgccggcggtgcggtcagcgtggcgcgcgcggttcacgccaaagccatcgtcgccctgaccgaaagcggttcgaccgcctttgaaatcagccgccacaacatcaccctgccgattttcgcgctgaccccgagcgtttccgcccaacgccgtatggcgatgtaccggggcgtgcgcccgctgattttggcaaccagtaccgaccacgacacggcgttaaacgaagtcgaaacgatgctggtggaacacaacatcctgcattccggcgaccaatacatcattaccagcggttcgcaaatgcgcgaatccggttcgaccaacacactggaagtgctgcgcgtcaaataatccgccctgagtggaaaatgccgtctgaagccgatgcccgaggcttcagacggcattttttgcggcggcgcggcggttcgggcaaactctgaaaaaattgtgcaaatccggcaacatcggataaaatcgagtacctatactaaagcgaaacaaggcatttccgactgccttttttatagtggattaaatttaaaccagtacagcgttgcctcgccttgccgtactatctgtactgtctgcggcttcgtcgccttgtcctgatttttgttaatccactatatttatccaccgtccgcctttttacggaaaccgaaatgaccccttccgcactgaaaaaaaccgtcctgctgctcggcactgcctttgccgccgcatccgtccacgcatccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaccgccattccttcggcgcaggcatcatcgcccaacatacttccgccgaactgcgcaaatatgccgactgggggattaagagtaaagcagagatattgacggcaaaaccgcccaaacctaacggtgtagccgaagctgcaaaaattcaggccgacggacacgccgatgtcaaaggcagcgattggggcttcggctaccaactggcgtggatgtgggacatcaacgaccgtgcgcgcgtgggcgtgaactaccgttccaaagtctcgcacacgctcaaaggcgatgccgaatgggcggcagacggcgcggcggcgaaagcaatgtggagtacgatgcttgcagcaaacggctacacggcgaatgaaaaagcccgcgttaaaatcgttacgcctgagtctttgtccgtacacggtatgtacaaagtgtccgataaagccgacctgttcggcgacgtaacttggacgcgccacagccgcttcgataaggcggaactggtttttgaaaaagaaaaaaccgtcgtcaaaggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctacccgacggcaaccgcatctggttctccgccggtatgaaataccatatcggtaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggtctgcaatacacctacaaattcaaataaacggcccgccgtttgaatgtaacaatgccgtctgaaacagatttccgtttcagacggcattgttttaggctcgatttatagtggattaacaaaaatcaggacaaggcaacgaagccgcagacagtacagatagtacggaaccgattcacttggtgcttcagcaccttagagaatcgttctctttgagctaaggcgagacaacgccgtaccggtttttgttaatccactatatttggaaggagcgtaacccttccgaatcaggacggcacatagggcgacgttttttgtatcgtcctgtgtgttgaaacatcagcataggcaacacaggaaaagccggctgttttgcgcctgcgtaccgtattggtcaaaatgccgtctgaaaccgataacagggtttcagacggcatttccgtcaattttctctttatctgccgaacaggttggcgatattttccatctgttcttcggtaaaaccgttttcgcccaatctgacggcaactgcccattcgcccgacaaaccgtgttccgcaccgagctgccgccatttttcgactttggcttcgtctgtggttttttcgggcagcggtttgacgggaatcctgctttttgggacggtattcatcggtttgcccctaatcgatggaatagccgcgaagatactgtatccgttcgcgcgtcatccgcgtgtcgcattgcagcttgaggtattcggcgtattcctgccggtctgcctgcgcggcggcttgtcggcagttgctgattttttcctgcgcccacttgcgttgttcgccgaccaactctttttgcacgtcggtatcgagtcctccccaaagtttggtaatttcggattccgcacgctggttttgtacgcgcgcctcttccacttcgccccgtgatacggtaacggtatcggcacgctcgccgtcgtcaggatgcaggatttccggttcgggcgcgccttctgcggcttggggtacgcccgcatcgccgccggcggcattgtgttccaaaatgtcttcgggcgtgggtttggacggttcttcttcacgggcttttccgctcaaaatcctgaccgcgtcttcttttttcaccgccttgccgtctatcatcacgatgctcttcacgccgtaaggcagcagcgcggcagacagcgtttgcgccgccataccgaccgtgttgtcgacaaatgccgtctgaccgtctttgacgggcaggaagcggacggctgccgtcaatacgccgtctttaaactcgacattgccgcccgtcttctgccgcacaatatccgacaaagcagtttccccgtacaacagggggctgtttgccttggcatcggcaagcgtttcagacggcacggtaatgttcaaatcggcgatacagaacgtgcgcccgccttcctgcgtttccgaagcgtgttccaaagaaaacgccaaaccgtaggcggcggcgataattttgtcggcatcgacaaactgcctgccgtcttcgcgcgcgaaagaacgcgcttcctgcgtgagcgtttcctgaatattgccgcgtatgccttgcaacacggcggggttggcgcattccaatgccttgggcggttcttccctgccgcaagcggcaagcagcagggcaaacggcagcgcaatgagtttccgatacatgatgttccttccaaacggtgcagaccgatagcggctatcatagcaaaagcacctgcaggcggtaaaccttgcaggtgctttgtcggaaaggcggaaaatcagcctttaaagaaattcacaaaaccggtgagaatcgcggcattaatcaaatcgacgaagaacgcgccgaccataggcacaatcaaaaacgccttatgcgacgcgccgaaagtatgcgtgacggactgcatatttgccaccgccgtcggcgttgcacccaagccgaaaccgcaatggccggcagccaatactgccgcatcatagtcgcgccccataaagacataggtaacaaaagtcgcgtacaaaaccatcaccacggtttgtacggcaagaatcacggttacaggccccgccaaaccggtcagctcccacagtttcaaattcagcaacgccattgccaagaaaagcgaaagcgaagcattgccgaacacatcgatggcgcggtcgaacatattgaccttgaatgcggcagtgaggatgttgcggatgaccacgccgccaaacagacaccacacgaatttgggcaggtcgaacagatattctttgtcgaagccgtccataatctcggcaaacgccaaacacgcggcaaacatggcaagcgtttcaacggcagattccgccgtaatcaggcgggtgcgttttgcctgctcgaacacgtcgtccgcgttgtcgtcctgatcctgttttttgttttcaaccggtttgcggcccattttgttgatcaggcggcgcgcaaccggcccgccgatcaggccgccgaacaccagcccgaaagtagccgatgcaatacccaaaccggttgcgccgaccaagccgtattgcgtttcaaaattaggtccccacgcacctgacgtaccgtgtccgcccgtcagcgacaccgaaccggtaatcagaccgatgagcggatccaaacccaaagccgtagccagtccgaccccgacaaagttttgcaccaagataaatccgcccacaatcgcggtaaaaaccaccagcggcaaaccgcccgccttcaaacgggaaaaatccgcgctcaagccgatggacgtgaaaaaaatcagcataaacgcattttgcagcggtttctcaaatttgaagctcacgccgtacgcctcgtgcagggcgaacaggacgatagcggcaatcaaaccgccggctaccggctcgggaatattgaagtctcgtaagaatttgattttttgaaccagaaatttaccaaccagcaacacgagcgtggcggcaatcagtgtgtaataactgttgaattcccattccatgttgtttcacctcctagaaatatttttccgagcatccgtttttgttccggatgtagtgtgtttcaacgcttggcgttatccgccgagtgtcatggtattgatgcgcggacaaggtgttttcagaaagaaatgaaaacaatggcgtgtccgtgaaaaataactggcaaatattaggggaatagttaaagattgtcaaaaaatgcgagtgtaaatcttttcagacggccttttgtccgatggcatggtgtgcttcgcgtcgccattgttctaatagggatattaatgattcggccgaagtgtggccgttgccgatggcggcctgcagccagtagcaggcggtcggaacatgacagccgacaccttgcccgtgatagtaaaaacaggcgaggtggtattgggcggaagggtggttttgttcggcagcaatggcgtaccagtgtgcagccgcccgaggatcttgcgccgtaccgaggccgtaatggtagatgcggcctaaggctgccgctgcgtttttatggtggaacccggcagcttccatgtaattttttcgcgcggcattgtagtcggcgggacggccgatggcgcaggcttgtgcttccgccaaacggtagatggtttcggtttgttgttgttgcaggcggcagttttgatttgttcgtattgttgcggatggtacagcgcggcgtcgctgatgagtttttgtgctgcggcggcagaacccagcgcggcggcacggtggtagtaatcttgcgcgatatggttgtcggctttgataccgagaccgtagcggtagaggtcgcccatgattttcagggcttcaggatggtttttctcggcagcggctttggcatatcgtgccgcttggaacggatcgcgttcggaaagttcgccggtcagggcgtattgggccagcttagactgtgcttccgcttgttccttatcggcggcacgacgataccattccaaggcttcaggtttgcgttgggcggcaagaaggtcagccagcagcgtttgtgcggcgatgtggccggcttgtgcggctggttcgagatagtgttcggcttgtgcgtggttggggctgacacctgtaccgtagaagtagatttgaccaagttgccagcaggcggcagttacgccgagtgctgccgctttttcgtattgttcgatggctgtttcaacgtcgccttggcgttgatgatggcgtgccagatggtaatacgcaggtgcggcatatcgggcggcagcaagttccgcccagtagagcgattgtggatcgttgcgttgcgcgtggtaacgcatgaggattaattgggcttctgagtgcccctgctcacccagccaggcatagtcgttgagaagctgtccggtcggggtgccgttgtgttcgcgttgttgcagcagggagaagagtgctttgggatggcgttgggccgcggcggcttccaaccatgaaagtgcctgctccggttggccgttttgcagcagatggttgcccaatacgaaagcagcttccgcataaccttgctctgccgcctgttgcaacaggggcagggcttgggcggtattggattgttccaaaagggcggcggcttgccggtagaggatatcaggagcggcggtcatggtttgcgggcggatataaagtggaagacggatgctgcggcatatgggcggcgataccggttgagggctttgtaaaaattttgctcggcatagttttatagagtgtattgccttgccggcttatctttaggatgtttggcttgttatattgttttgcctagggatatatccatattttgtgtgttacaaagggctcaggttgagtcggtatgcgctcatggcagctcggtcattatactgtttttgtaatttattgttaatgataaatgcagatttttgtgttttatttacatggcagtagctaaggtattgattgtttcaggccgtctgaaatgttttcagacggcctgaacttccttcgctaagtcagattactggtgtggaagagttggaggtttttttgttggggaaaaacacctgactgtagaagttgccgttaatttgggtcacgttgaggtggtacattcggtaggcatggaacagctctttgtcaggcggtgtcggatgattccaaaattctgccaaggtattttggtcagtaatgccgggaatatcataataggcacggccgagaaccttaactggcatattgtgaatcagtccggacaggccgctggtgctgttgatggtgaccatgccgagaccgtggcgcaggaaaacgggcagggggacatcatggacataaatcacacggcctttgagttcggggtgttctttgataaagcgtttaatgtcgcgccagtagtcgataaaaccgcggtccatcggatgatgcttgatgatgatgttggtatcggcaggcgcgtgctcggcaaatgaactcaaaacatggagcaggaagctgcggacgctgggaaagtcgcaatggatacggacttggctgtcgttgaatacctgtaagggaacaataaaaaacttgccgtatttgcctgcttccacacgtttggcgatttggatgtcttcaatatagtagttcaaacgcttgaggatggagagcgaccacggtttgaggtaatggccggcattgggtgcgcggtggtggatgtagtcggggtatttgcgtggattgcggaacaactcgatatagtaacggatagcgttttttgccatgggcgtaaaaccgccgtgtaccggcgttggcgctttatattcttgctgggcaagcttagggaattgttcaagaaaaaagtcggcacggcgcggcaacggggaaaatgcgttgacgccgtctttttctaaggtgatgtagtaggggcggaaatagccttcttcaaacgcccagaaactggcttggttttcgtttgcaatgcgttttgcaatgacgtgataagggcgtgtgtcgccaaagcagacaacggcctggatgtgatgttgagtgatgtattcttgcaaaaactcaggaaaggcatcgtagttgtcgttaaaaacaacggtatgcgcttgagtgggcggataaaaatagtcgtcgcctgcattaaagttgaatttatgtacggttttgccgtttgcagtcagccagtcggcaaggcgcagaaaaaaatcgccgacagggccttgaagcagcaggatattttctgcgctttcaagcaggttttgcaggttatttttgaggacggtctgtttcatgttgcaatgtggttttgttttttatgtaatagttttaggttgaactttcaagcatacgccaagagaattaacgatgcaaaggcaatgatgccgcaatagaggcaagtttatgacgcatcgttaactttgatggtatttatttgaaagatcgatatagttgtttgattttacctaattttttggcaaagcacccgcgatgtaatccgttgttgtttttttgcatatttttttgtcgtatcaggatttgggctgcggtttctgcatttatggcctgatgggtttcggggtggatgtagtcgggatagtggatgagcgtgccggcaatcagctgccaaagctcaagtctgcggctacggcgcgggatggggagcagatcttgggtaagcccccagcctgcgtaaaaaggcaggccgtagcagctgacttttttgccgcgcaacaaggcttcaaaaccggtcagcgaagtcatggtatgtatttcgtctgcgtattggagacaggtcaggatgtcggcttgttcggcggtttggtcggcatatcgtgcagcatcttcaggggaaatatggccgatgcggttaccgctgactacatcgggatgcggtttgtagatgatataggcattggggtttcgttcgcgtacggtacggagcaaatccagattgcggtagatttggggcgaaccgtagcggatagacgcatcatcttcaacctggccgggaacgaggatcacggttttgtcggttgacggggcggtgaagtctgagctgccgacgttgtatttactgatgtggttttcggtcagcattttttgcagcttcaaggccgtctgaaagtcttgatcgtcgaagttttggttttgtaggatgtattcaagacgggacggggtttcggcattgaaataaatgctcatatcgtcggtaacgagcgacagcggcggcactaagttggagccgagtccgaccgagcggataaagccgtcttccatgcgcagcagggggatgtggtgttgttcggcaaagcggacgatggcctctttgccgttgccccaagccaggatgcgtgcatcgtcggacagtttgacccttgccagtttttgggtggaagagataaatttcagacggcaagagggtacgttaaagaacggtttggcaaccgcgcgtttccacaaagacataccgacgcaatataactcgccacgcaatttgtcgtttttacgtttgaccgtcgccagatagtcgatgacatcaaagaggctgcctgcttcgccggtattggggttgaggtagcggctgtattgcagataggctgcggcgaagagctgcagcaagttgcgggtggcgcggcgttgggtttgaacaaggcggttgatttcaggatggcggtcgtcgcttacaccccatccggcataccacggcaggccgaaagtggtcagcggtttgccgcacaaaagcgcctcaaaacccatttgcgaggtaacgcaataaactttatcaacgttttgcaacaaagaaatcggattgatgtcttctgccaaaagatggacgcggtgttgctgcgccagttgggtcagatagccttgttttttgccgcacaaaacatcgggatgggtttttacccagatatcggcttgcgggttttcatttaaggccgtctgaaacatcagttcaaacgtagaggcgtctgcgccgccatattggatggccatatcgccgaaggtttggtcgatgatgaggacggtttcgggtttggatggggaacgtaaaggatggtcgtctgaaagttcgggcgcgtggttgtatttggacaggtggtgttgcaggatgaaatccatcgcctgctgcgcctgagccaaggtttcagacggcatggtatcggcggcaagaatcagttgttccaaacgcgaaggacgtgtggtgtcgtagtagatgccgatgtcgtcatagacgatagagtagggcggataaccggcgacacccagtccgagcgatcgtaaaaagccgtcttccaaagcaataaagggaagctggtgttcagcggcaaaagcacgcgctttgtgtgtcgtcgggcgcaaaccccagccgacaacagcctctgcttctttcccgtctttgcagatatgaaattcaggcaatagggtggagagatgggggattttgcggatgccgcgagaggggatgtaggcgtttttcacaatgcgttttcgtcgattattgttattaatggattgtaggccgtctgaaaagaggaacattctttcagacggcctgaattatttttaaaacgttaccgcttcagacaatactttgcctgccaagtctttaggcgacaggttcggctcgccttgcaacggccagtcgatgccgacggtcggatcattccaaatcagcgagtgttcggctttggggttgtaatagtctgtgcatttatagacgaactcggcttcatcgctcagtacatagaagccgtgtgcgaaaccttcgggtacccacagttggcgtttgttttctgcggacagaatttcgcctacccatttgccgaaagtgggggagtctttacgcatatcgacggccacgtcgaatacttcgccgacaaccacgcgtacgagtttgccttgtgtgttttcagtttgatagtgcaggccgcgcaatacgcctttgccggatttggagtggttttcctgcacgaaggtgcgttcgcagacttgggttttaaaccactcgtcgcggaaggtttccataaaaaagccgcgcgcgtcgccgaagacttggggctcaagcagttttacgtcaggaatggcggtatcaatgatgttcatctttttatctttcatctaaaggccgtctgaaaagtttcagacggcctcaaacattattttttcaacaggcgcagcaaatattggccgtattggtttttcgccatcgggcgcgccaattcttccagtttttcatcggaaagccaaccgttgcgccaagcgatttcttcgaggcaggcgatgtgcaggttttggatattttgcacggtttggacgaatgaagcggcttcgtgcaggctctcgtgggtgccggtgtccagccacgcgaaaccgcgtcccaatatttgaacggagagcgagccgtcttccaaatacatccggttgaggtcggtaatttccaattcgccgcgtgcggacggtttgagctgtttggcgaactcgacggcgcggttgtcgtagaaatacaagccggttaccgcccaatcggatttgggccgttgcggtttttcttcgatggaaacggcgcggaagttttcgttaaattcaaccacgccgaaacgttcggggtttttgacctgataagcaaacacggttgcgccgtgcgtttgcgctgccgcctgtttcaatgtttgcgtaaacgactgaccgtaaaaaatattgtcgcccaaaaccaagcaaacattgtcgttgccgataaattcttcgccgatgataaatgcctgtgccaagccgtccggactgggttgcacggcataactgatggaaatgccgaaatcgctgccgtcgccaagcaggcgtttgaaagaggcgttgtcttcaggcgcggtaatcaccaaaatatcgcggattcccgccagcatcaaaaccgacaaggggtaataaatcatcggtttgtcgtacacgggcaggagctgtttggatacgccgcgcgtgatggggtagaggcgcgtgccgctgccgcctgccagtatgatgcctttcatcttttctttcttcctttgcgatgggttttcagacggcattgcgtcgggatgccgtctgaaaactattttccagtacctaaacgttccaaacgatagctgccgttcaatacattttgccaccaggttttgttgtccagataccattgcacggttttgcggaggccggactcgaaggtttccaaaggcagccagcccaaatcccgcctgattttggctgcgtcgacggcgtagcgtacgtcatggccggggcggtcttgtacgaaagtaatcaaatcttcataacgcgccacaccggccggtttttcgggagcgagttcttccagcagggcgcagatggttttgacgacttcaatattggctttttcattgtggccgccgatattgtaggtttcgccgacaacaccttcggtaacaacctgatacagtgcgcgcgcgtggtcttcgacaaacagccagtcgcggatttgcataccgtcgccgtacacaggcagcggtttgccgtcaagcgcgttcagaatcatcaaaggaatgagtttttccggaaaatggtaaggaccgtagttgttggagcagttggttacaatggtcggcaagccgtaagtacgcaaccacgcgcggacgaggtggtcgctggacgctttagaggcagagtaggggctggacggcgcgtagggcgcggtttcggtaaacaaatcgtccgtgccgcctaaatcgccatagacttcatcggtggaaatatggtggaaacggaaggcttcgtgctgttcagacggcatttgttgccagtaggcgcgggctgcttcaagcagattgaatgtgccgacgatattggtttggataaactcgcctgccgaaccgatagagcggtcgacatggctttccgccgccaagtgcatcacggcatcaggccggtattgcgcgaatacgcggtcgagttcggcgcggtcgcaaatatccacttgttcaaaagcatagcgaggattatcggctacctcagtcaaagattccaaattgccggcataagtcagcttatcgacattgacgacagcgtcccgggtgtttcggataatatgacggacaacggcagaaccgataaagcccgcgccgccggtaacaaggatttttctcataaatttcagaggatagccaaaaaatataaacagattatagcagacagaatgtgtgtttttcagataaagaggccgtctgaaaacatctctttcagacggcctgtatcaggtcaacttaatcgtcgtagccattcggattattactcacccagcgccatgagtcttccatcatttgggttaaatcacgctgggtttgccagccgatttgcgcctttgtataggaagggtcggcatagaagcacgccaaatcaccggcacggcgcggtttgacttcatacggaatcgtcaaacccgaagctgcttcaaatgcgcggatgatttccaacaccgaagaagcgcggccggagcctaagttcagcaaatgcgtgcctgctacattactttttgcctgcatagccgcgacatggccttctgccaaatccatcacatgaatatagtcacgcatccccgtgccgtcgggggtagggtagtcatcgccaaataccgccaattgcggcagtttgcctgccgccacttggcagatataaggcaacaaattattcgggatgccgtttggctgctcgccaatcaagccgctttcatgcgcgccaatcggattgaaataacgcaacaaaatcatgctccagcgcggatcggctttttggatgtcggttaacatccgttccaccatcgctttggacgcaccataaggattagcggtatcgcctgggcgcatatcttccgtatagggcattttacgtatcatggcgcgacgcattaaagtaaacgccaaagcgcgtttatactggttatccagtttccctatatttttacgttacaaatcaagttgttggtattcatcgtgaaaatagaatttttcggcataacgctgactcataaaaccggcatgcgggctgcctgaaaaaatcattgcgacatcatcgtcatttaatgtttcatggttgttttctattaatgctaaagcaatttggtaattaattgccaaaatatcgttagtaatcacacgatagccgcgttttttggcttcgtaggcaaaggaacagcctccactaaatacatctgcaactgtatctacatcagacggaagctggtcacaaatccaggaagctattttctctttattaccgatatagttaattttcggatattgcttattcattttcactcatttttaaaatactttcagcaatagcttttgccaataaaggcggtacggcgttaccaacctgctgctgctgggcaattttgctgccgcaaaaaataaaattatcagggaaagattgtaaggcagctaattcacgaacggttaacgcccgattctgttcatagtgaaaaactttgcgcatatctcctgtaatacaaacggctggttttgttgctgttgtaacggatgtatttacggatatcacctgttttcggacgtaatggttcaggaatatcgttacggttacctccatttttaacaaatgccattttttctaacatttgtgccgaatgattcatagcttcatgatttgcaacgtgtggattgctttcgccagcagccagttttggaaaatgtcctattgctgatccaacagtctgatgggaaatctgcaaaggttcgggaaaggaaattttgcctttatccctcctcccgataaatatcactcggctacgtatctgaggaacaccgaaatcggctgcactcagtatcttacattccaccgaataaccgatattctgaaatgcttgaataatctcaatacgtgttttacctgaattgtgtgtatagagtcgcgctacattttccataacaaaaaaatatggttggacaattttaactattcggacaaactctttaaataaatggttgcgtgggtcatctgtaaatgtccgtccaatctttcctgccatactaaaaccttgacaaggtggtcctccaataatcaaatcaactgcttgtccgttaagacaattgattaaatcttgttcggttagtgtggttaaatctttttgcagtaattgatgatgggggaagttggtacggtaagtctgacaataatcagactccatttcaacagaaagcaattgttggaatccggcttgttcaaaacccaaggataggcctcctgctcctgagaaaaggtcaatataggtaagtggtgtgtgcataagtcaaaatccataaactcttcgattattttaccgcttcagcttcgcaaacgcatccgccatcgccgaattggctggggcgcggtcgttgcgttggggtttgcggccggctgtccgttcgcggctgcggttttcagacggcattttatgttttgcgccgcccggttcgtcatccaagcgcatggtcagcgcgatgcgtttgcgtgcagcatcgacttccagcactttcactttcaccacgtcgccagctttcaccacttcgcgcgggtcttggacgaacttgttggacagggcggagatgtgcaccaagccgtcctgatggacgccgatgtccacgaacgcgccgaagttggcgacgttggaaaccacgccttcgagtatcataccgacttgcaagtcgctgatttcgtggataccttcggcaaacgatgccgtctgaaactcgccgcgcggatcacggccgggtttttccagttcggacaggatgtccaaaatggtcggcaggccgaagcgttcgtcggtgaagtcggacgctttgatttgcttcacgcgctcgcggttgccgatgagttcggcggcgctaatgccttgttgcgccagcattttggcgacgacgggataggcttcggggtggacggcgctcgcgtccaacggctctttaccgccgttaatccgcaaaaagcctgccgcctgctcgaaggttttttcgcccaaacgcggtactttcagcaattttttgcggctgtcgaacgcgccgttttcatcgcggtaggcaacgatgttttgggcaagggtttgattcaagccggaaatccgcgccaagagcggggcggaggcggtattcacgtccacgccgacggcgttcacgcagtcttcgaccactgcgtccagcgatttggcgagctggttttggttcacatcgtgctgatactggcccacgccgatggatttagggtcgattttgaccaactcggcaagcgggtcttgcagcctgcgggcgatggacaccgcgccgcgcagggaaacgtccaagtcggggaactcgcgcgccgccagttcggacgcggaataaatcgacgcgccggcttcggacacgacgattttgtgcagccccatttccggcattccgcgcaccagttcgcccgcgattttgtcggtttcgcggctggcggtgccgttgccgatggcgatgagcttcacgccgtgttgcttaatcaggcgcgacagcgttgccaacatattgttttcttgatgcaaatagacgatgacggtatccagcagcttgccggtgtcgtccaccacggcgcatttcacgccgttgcggtagccggggtcgagacccagcgtggtcagccgtccggcgggcgcgacgagcagcaagtctttgagattgcgggcgaacacggtaatcgcgtcggtgtcggcggcttctttcagacggcctagggcttcaagttccaacgacaaaaagattttcgcgcgccaagtcagacgcacggtatcgcgcagccatttgtggccgtctgaaaccttgaagcggcaggcgatgatttgctcgtattcgctttgccgggtaatcggcgtgtcgtcgggctggtatttgagcgcgatgttcaacacgccttcgttgcggccgcgcaaaaccgccagcgcgcggtggctgggcatagtgcggacgggttcgcggtggtcgaaataatcgctgaatttttcgccttcggtttctttgccttcaacgacttgcgcgtggatttcggcttcgttccacagcttgtcgcgcagcgtgccgataagttccgcgtcttcggcaaactgctccatcagaatcgcacgcgcgccgtccaacgcggctttggcatcggggacgttttcgttcaggtagccttgtgcggcggcttccacgtcctgcgactgctcggcaagcaacacgtccgccagcggctgcaaaccgtgttcgcgcgcgatttgcgctttggtgcggcgtttgggtttgtagggcagatacaggtcttccagcgcggttttgttatcggcggcttcgatttgcgccctgaggtcgtctgaaagcttgccttgctcttcaatgctttttaaaacaacggctttgcgctcttccaactcgcgcagatattgcagccgctcggcaagccggcgcaactgcgtatcgtccaacccgcccgtcgcttccttgcggtagcgggcgataaacggcacggtcgcgccgtcgtccaaaagctcgacggcggcggtgatttgcgcggcagtcgcggagagttcttgggaaagaatttgagtaatgttcatcaatagaattccaacggacaggccgtctgaaatttcagacggcctgatttaaaaacaatcgctttaaggcagcgaattataatattcgtaggctttgtccatatcttcaaactggtacatatgccctttttccagcaccatcgcattatcgcaatattgcttcatggcgctgtggctgtgcgacaccaagatgatggaacggtctttgcgcttttcaaacaactcgtacttacatttatcggcaaaacgcgagtcaccaactgcaatcacttcgtcaatcaggtaacagtcaaactccaccgccaacgacagcgcaaaagccaaacgcgctttcatacctgaagaatagcgtttcaccggctcatacaaatattgccccagctccgaaaattcttccgtaaacgctttcacataatcgatatcgacattgtaaatccggcagatgaaacgcaaattgtccataccggtcagactgccttgaaacgcaccggagaatgccaaaggccaagaaatactcattgtccgcttgatttcacccgtggtcggcggctcaacgccactgatcaaacggatgagcgtcgatttacctgcaccgttgcggccgagaataccgattttctcgcccttctccattttgaagctaatatcgtgcaagactgtccgccaaccttggcgggtcagatagcgtttggaaacgtgttcaactgaaatcattgcggctcgactcctttactgaatttactgaccatcgccaagccaaacaacaacaacaccagattgcacaatacgatataccaaggattttcataggtaattacatcgctgccaaaatatccggcacggaacatttctgtgccatgcaccatcggaatcattaatgcatattcttgtaccttgggcggcaaattatgcacaaaaaagaacgcaccggataacggcatcatcacaaaagtcaatgtgccccaaatcttgccaaacggctcgaaattaaaggcaatcgaacaaatcaccaaacccaaaccaatcgcaaaaaaagccatcaaaagccaagccatcagcatataaaacatatctgccggcatttcaatccagccaatcgcaatcaataccgccataatcacaatctgcgcaatggttgcaccagcaatttccaaaatcatgcgcgccaagatggtatccaaaactcttacattgcggtgataaagcaagctggcatttgaagaaatcgacccaactgcccgttttgaggcattacgccacatcatcaacatcggatagccagtaatcgcaaatgcgacaatattcaaagttgaatatcggtctgcccttaaaaatttccacatcaagacgataacgaatgtcatcagcaacggctcaacaaacagccataaaaagccaatattattgcgaccgtaacgggtgataatttcccgcatcaacagcgcaccgattacgcgcctttgaatggctaaagattcccaaaatgatgttttatgcaaggctttcatcagtttttatgctcacgaatgctggcagtcaacaggctcaaaataccataaaccatcaagccgataatcagagtggcaacaatgttgtataaccgtttaggctcatgtgccaaatccggcaggctcggttgcgagatcacttccaaataaagctgctgacggtctgcttcaaccttggcactttccaaagaagtcatggcggctgccaactgctgctctgccaactggttttccaaatacacacgctgatattcggcagcctgattagacaacgaagaatgcccaccgcccgaaatggcacgtaactgttggtcaatttctttacgcaagctctgctcacgcgcctgcaaacccggaatctgcggattctccggagtgactgctttcacctgatccagctgggtttgaatcacaatcaattcatcttgcagcttggaaaccaaccccatttgcacttccgattgcgctttcaaatcaaaaacgccattggcaatccggtaatccgtcagattctgagaggcttcctttacccgctctgccgccgttttcactacttcttccgcatagcgcaccgtatcagcacgtgcacgatcgttcaactggttaatcaatgcttcaccttgttttaacaaagcctcattgattttcttagattccagcgcatcaaaggaagttacattcaacgtggaaatacccgaaaccgtatcaaaattgatcatcacctgatttttatagtattgataaaaagcctcttcctcgccacggaacccaaacccattaaagcggctgaacgcatcacctttggtttcataaaactcacgcaccggcaagattttacgcagttcatccaaagacgagcgcgaacgcatatactccccaaccgtgtaaatatcatcttgcgcacgggcaaaacctgtgccctgcaaaatggcacccaggccattgagagaagattggcttttaggcgagcgcaccacaaagctcgattgcgacgtaaaacgatcggaagcgaagaagccgaaatacaccaacgaaattaccgtagggataatcaccgttacccaaaataaagggcttagctttttaatccaacttttctttttcggctttttacgctcggctttggtttcagtggcaactgccacaggaagttgctcagacatcttaattactcacattaattagttaaattattaatactgttcgcgccactggtaaccggcgagaacacaaacgacaaaaatttctgcacttcagccaacggcgcattcgacacatacaatacatctttattcttcacaggaaagcgctgcatagaaaatagcgaatgcgcatcagccatattcacacgatataccgttggaatctctgcctcactgccataaccttgagcaatccatttatcctgacgttctgccggcaattccaccaatggcgtatagcggaacacaaacacaccacgcgcatcagaacggcgatcttgcaaaccgcccatacggccaatggcttcagaaagcgataagcctctggctgaaaaaccgatttcttgtgttctccccaccgcacccatagacgtaaaggtatagggattggtaatcatggtaaccacatcaccgcgacgcagcaaaatattttgtcgcggatttgcaactaaatcttccaaggcaacagttcgtactacattgccacgtgtcagctgcacattcgtatcctgcacatttgccgttgaaccacctaccgcagccaccgcatccaacacacgctcaccggctgccgtcagcggcatacgcacactattcccagcacgaatcaccgacacattcgccgcattattctgcaccaaacgcaccatcacttgtggctgattggccatttttttcaggcggcctttaataatttcctgaacctgaccaggcgttttaccgaccaccgaaatatcgccaacaaacggcacagaaaccgtaccacgtgccgtgaccaactgctctggcaacttagtttgatgcgcactacccgagcccatcgaagaaaggccaccaccaaacaatactgccggcggcgcttcccaaatcataatatccaatacatcaccaatatttagcgtaccagccgaagcataaccatcgccaaactgagtgaatgactgatttatctgagccttatataataactgagcaaccgtatgattcacatcaatcagctccacttcaggaatttgaacttcagattgttgccctaaagagacaattttttttgcgctggggcctgatgaaggaatcgcagagcatcctacaattaaacttccacacaataataatactgcgtgacgaatataaaatttcactttaaacacaagccaaatcctaatataattataaatggcctaattatagcacttaatcgaaataaatttatgagtacgtagagtataattagtattcttctttccaacttccttatacttatatacttatagattctaaaatcatgaaaagaattctttgcattacaggtaccagagccgacttcggcaagctaaaacctttattagcctatattgaaaatcacccagaccttgaattgcatttgattgtaactggtatgcatatgatgaaaacatatggcagaacctacaaggaagtaactcgagaaaactatcaacatacatatctgttttcaaatcaaatccaaggtgaaccaatgggtgccgttttaggcaataccattacgtttatctctcgtctatctgatgaaattgaacctgatatggtcatgattcacggcgaccgtttagaagcactagcaggcgcagctgtaggtgcattaagcagccgtttagtttgccatatcgaaggtggtgaactatctggtacagtagatgactccattcgtcattctattagtaaactttctcatatccacttggtagcaaatgaacaagctgtcactcgcctagtgcaaatgggagaaaaaagaaagcatattcacatcatcggctcccccgatttagatgttatggcctcttccaccctcccatccttagaagaagtcaaagaatattacggtttaccatacgaaaattatggtatttctatgtttcaccccgtgactacagaagcacatttaatgccacaatatgcggcccaatatttcaaagcattagaattaagtggccaaaatatcattagcatctaccctaataatgacactggcactgaaagtattctgcaagaattattaaaatatcaatctgataaatttattgcatttccttccattcgatttgaatattttttagtcttattgaaacatgctaaatttatggtcggcaactcaagtgcaggtattagagaagctcctctctacggtgtcccttcaattgatgttggtacacgccaaagtaaccgccatatgggaaaatctattattcatacagattatgaaactaaaaatatctttgatgcgattcaacaagcatgcagtttaggcaaatttgaagcagatgatacctttaatggcggagatactcgcaccagcacagaaagatttgctgaagtaatcaacaatcctgaaacgtggaatgtttctgctcaaaaacgttttatcgatttgaatctttaaattatggaaaaacaaaatattgcggttatacttgcgcgccaaaactccaaaggattgccattaaaaaatctccggaaaatgaatggcatatcattacttggtcatacaattaatgctgctatatcatcaaagtgttttgaccgcataattgtttcgactgatggcgggttaattgcagaagaagctaaaaatttcggtgtcgaagtcgtcctacgccctgcagagctggcctccgatacagccagctctatttcaggtgtaatacatgctttagaaacaattggcagtaattccggcacagtaaccctattacaaccaaccagtccattacgcacaggggctcatattcgtgaagctttttctctatttgatgagaaaataaaaggatccgttgtctctgcatgcccaatggagcatcatccactaaaaaccctgcttcaaatcaataatggcgaatatgcccccatgcgccatctaagcgatttggagcagcctcgccaacaattacctcaggcatttaggcctaatggtgcaatttacattaatgatactgcttcactaattgcaaataattgtttttttatcgccccaaccaaactttatattatgtctcatcaagactctatcgatattgatactgagcttgatttacaacaggcagaaaacattcttaatcacaaggaaagctaaatgcaaaacaacaacgaatttaaaattggtaatcgttcagtaggttacaaccacgaaccattgattatctgtgaaatcggcatcaatcatgaaggctctttaaaaacagcttttgaaatggttgatgctgcctataatgcaggcgctgaagttgttaaacatcaaacacacatcgttgaagacgaaatgtctgatgaggccaaacaagtcattccaggcaatgcagatgtctctatttatgaaattatggaacgttgcgccctgaatgaagaagatgagattaaattaaaagaatacgtagagagtaagggtatgatttttatcagtactcctttctctcgtgcagctgctttacgattacaacgtatggatattccagcatataaaatcggctctggcgaatgtaataactacccattaattaaactggtggcctcttttggtaagcctattattctctctaccggcatgaattctattgaaagcatcaaaaagtcggtagaaattattcgagaagcaggggtaccttatgctttgcttcactgtaccaacatctacccaaccccttacgaagatgttcgattgggtggtatgaacgatttatctgaagcctttccagacgcaatcattggcctgtctgaccataccttagataactatgcttgcttaggagcagtagctttaggcggttcgattttagagcgtcactttactgaccgcatggatcgcccaggtccggatattgtatgctctatgaatccggatacttttaaagagctcaagcaaggcgctcatgctttaaaattggcacgcggcggcaaaaaagacacgattatcgcgggagaaaagccaactaaagatttcgcctttgcatctgtcgtagcagataaagacattaaaaaaggagaactgttgtccggagataacctatgggttaaacgcccaggcaatggagacttcagcgtcaacgaatatgaaacattatttggtaaggtcgctgcttgcaatattcgcaaaggtgctcaaatcaaaaaaactgatattgaataatgcttattaacttagttactttattaacagaggattggctattacatatagctaattctcattaatttttaagagatacaataatgctaaagaaaataaaaaaagctctttttcagcctaaaaagttttttcaagattcaatgtggttgacaacatctccattttatcttacccccccacgtaacaatttatttgtcatatctaatttaggtcagcttaaccaagtccaaagcctaattaaaatacaaaaattaaccaataatttactagtaattttatatacttctaaaaacttaaaaatgcctaagttagttcatcaatcagctaacaagaatctatttgaatctatttatctatttgagcttcctagaagccctaataatataactcctaaaaaattactttatatttatagaagttacaaaaaaatccttaatattatacagcctgctcatctctatatgctgtcttttacaggccactactcctatctgattagtattgcaaaaaaaaagaatattacgactcatttaattgatgaagggactggaacatatgctcctttattagaatcattttcatatcatccaacaaaattagaacgttatttgattggaaataatcttaatattaaaggatatatagatcattttgacatattgcatgtcccctttcctgaatatgctaaaaaaatatttaatgcaaaaaaatataaccggttttttgcctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgattcacaaaaaataggtacacgaaaaacaagttaagggatgcagtttatgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttctgtttatctttgtgtgatattcttgatttttttctatttaatctgataagtgagctattcactttaggtttaggatgaaaatattctcttggaaccatacttaatatagaaatatcaacttctgccattaaaaataatgccaatgagcgttttgtatttaataatcttttagcaaacccgtattccacgattaaataaatctcatcagctatactatcaaaaacaattttgcgtattatatccgtacttatgttataaggtatattaccaaatattttataggattggtttttaggaaatttaaactgcaatatatccttgtttaaaacttggaaattatcgtgatcaacaagtttattttctgtagttttgcataatttatggtctatttcaatggcagttacgaaattacacctctgtactaattcaagggtaaaatgcccttttcctgagccgatttcaaagatattatcatgttcatttaatcttatatttgtcattattttatctatattatgttttgaagtaataaagttttgactgtgttttatatttttctcgttcattataaccctctttattttttcctccttataaaattagtataattatagcacgagctctgataaatatgaacatgatgagtgatcgttaaatttatactgcaatctgatgcgattattgaataaaagatatgagagatttatctagtttctttttttacaagaaaaaagaaagttcttaaaggttttatacttttggtcgtagagcacacggtttaacgacttaattacgaagtaaataagtctagtgtgttagactttaatgtttttttaaggcattagtgcatttaagcgtcagagcatggctttatgccgagaaaactattggttggaatggcgtgtgtgttagccaaagcttgatatcgaattcctgcagataaatattcttggtaatcatgttgcaatggcacaacctgctttaatagcttattaaactcatcagttgtaatcacctttttagtagcatagcaatcaagccaatccggatctgctatttttggggaagtgaaatctatttgatcaaaataaactaaaaccccactacctaaaaaatgctgatttgcataggatttagaaaagcctaagtctgcaacaacaccaacagggatacccttacattcagcttcaaaaagcatagtagatgaataagataaacaataccccatttcttggaaggcttgcgcggtactttttcgctctattgtcaaattactcggcaactgaaactgctttgccagctctatatacgaatgtttatcctgatgcacagtaatatctttatctgcaacccttagcaaaatagtaaattctttctcagggtatttttcagccaaggcaatcaatttttttaatgtataaattctttcttcttttttaaatgggattttaacttggtcaataaagtaaattttctctccatgacaacctttcgaagcatggcgaaaaattggataaccataaagtatattttgacaacttaatttatattgtttcttatattcctctgcaattctaaaatcatgcttattattatataaaacaatatcagcccccatacgagatagaatacttgcctgatcaccgaatactacacctggaaacaaggtaataatcaatggccttgaagcaatatttaattgcgcattctgcttaaagaacctttttaacaacccatttccaaccgataaaattactgcgtcataatattgatgcatattcttaataaagtaatcatcaatatgaaaaaaaaaattgcttggtctttatctatccctgattctaataactgtcgatttgaaagaatgttttctcgacttttgtggatataaatatcaatttgagcatcttttatctcttttgcaacagcatagcccgagttaaggaacgagtcataactggcaattagtaatacttttttcactattttcccttaattctacaccatatgaataaaattatagtattttaccttagatatcaaatatacttaaccaaaaaaatctgaagaaatctactgctacttcagggataattatttcattaagattttacaaccattattatcaatctatcaaagtatttttagtattttattctatgaaaaaaattctcgttaccggcggcaccggttttatcggctcgcataccgttgtttctttgctgaaaagcggccatcaagtcgtgattttggataacctatgcaattccagcatcaatatcctgccacgcttgaaaacgattaccggccaagagattccgttttatcaaggcgatatccgcgatcgtgagattttgcgccgtatttttgcggaaaaccgcattgattcggtgattcattttgccggcttgaaagcggtgggtgaaagtgtggccgagccgatgaaatattatgataataatgtttccggcagcttggtgttggcggaagaaatggcgcgtgcgggcgtgtttagcattgtgttcagttcttcggcgacggtttatggcgatccgggcaaagtgccttataccgaggatatgccaccgggcgacaccaccagcccttacggcgcatcgaaatcgatggttgagcgcattctcactgacattcaaaaagccgatccgcgctggagcatgattttgttgcgttatttcaatccgattggcgcgcatgaaagcggcttgattggcgagcagccaaacggcatcccgaataatttgttgccttatatctgccaagtggcggcaggcaaactgccgcaattggcggtatttggcgatgactaccctacccccgacggcacggggatgcgtgactatattcatgtgatggatttggcagaaggccatgtcgcggctatgcaggcaaaaagtaatgtagcaggcacgcatttgctgaacttaggctccggccgcgcttcttcggtgttggaaatcatccgcgcatttgaagcagcttcgggtttgacgattccgtatgaagtcaaaccgcgccgtgccggtgatttggcgtgcttctatgccgacccttcctatacaaaggcgcaaatcggctggcaaacccagcgtgatttaacccaaatgatggaagactcatggcgctgggtgagtaataatccgaatggctacgacgattaagttgacctgatacaggccgtctgaaagagatgttttcagacggcctctttatctgaaaaacacacattctgtctgctataatctgtttatattttttggctatcctctgaaatttatgagaaaaatccttgttaccggcggcgcgggctttatcggttctgccgttgtccgtcatattatccgaaacacccgggacgctgtcgtcaatgtcgataagctgacttatgccggcaatttggaatctttgactgaggtagccgataatcctcgctatgcttttgaacaagtggatatttgcgaccgcgccgaactcgaccgcgtattcgcgcaataccggcctgatgccgtgatgcacttggcggcggaaagccatgtcgaccgctctatcggttcggcaggcgagtttatccaaaccaatatcgtcggcacattcaatctgcttgaagcagcccgcgcctactggcaacaaatgccgtctgaacagcacgaagccttccgtttccaccatatttccaccgatgaagtctatggcgatttaggcggcacggacgatttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagccaaaatcaggcgggatttgggctggctgcctttggaaaccttcgagtccggcctccgcaaaaccgtgcaatggtatctggacaacaaaacctggtggcaaaatgtattgaacggcagctatcgtttggaacgtttaggtactggaaaatagttttcagacggcatcccgacgcaatgccgtctgaaaacccatcgcaaaggaagaaagaaaagatgaaaggcatcatactggcaggcggcagcggcacgcgcctctaccccatcacgcgcggcgtatccaaacagctcctgcccgtgtacgacaaaccgatgatttattaccccttgtcggttttgatgctggcgggaatccgcgatattttggtgattaccgcgcctgaagacaacgcctctttcaaacgcctgcttggcgacggcagcgatttcggcatttccatcagttatgccgtgcaacccagtccggacggcttggcacaggcatttatcatcggcgaagaatttatcggcaacgacaatgtttgcttggttttgggcgacaatattttttacggtcagtcgtttacgcaaacattgaaacaggcggcagcgcaaacgcacggcgcaaccgtgtttgcttatcaggtcaaaaaccccgaacgtttcggcgtggttgaatttaacgaaaacttccgcgccgtttccatcgaagaaaaaccgcaacggcccaaatccgattgggcggtaaccggcttgtatttctacgacaaccgcgccgtcgagttcgccaaacagctcaaaccgtccgcacgcggcgaattggaaattaccgacctcaaccggatgtatttggaagacggctcgctctccgttcaaatattgggacgcggtttcgcgtggctggacaccggcacccacgagagcctgcacgaagccgcttcattcgtccaaaccgtgcaaaatatccaaaacctgcacatcgcctgcctcgaagaaatcgcttggcgcaacggttggctttccgatgaaaaactggaagaattggcgcgcccgatggcgaaaaaccaatacggccaatatttgctgcgcctgttgaaaaaataatgtttgaggccgtctgaaacttttcagacggcctttagatgaaagataaaaagatgaacatcattgataccgccattcctgacgtaaaactgcttgagccccaagtcttcggcgacgcgcgcggcttttttatggaaaccttccgcgacgagtggtttaaaacccaagtctgcgaacgcaccttcgtgcaggaaaaccactccaaatccggcaaaggcgtattgcgcggcctgcactatcaaactgaaaacacacaaggcaaactcgtacgcgtggttgtcggcgaagtattcgacgtggccgtcgatatgcgtaaagactcccccactttcggcaaatgggtaggcgaaattctgtccgcagaaaacaaacgccaactgtgggtacccgaaggtttcgcacacggcttctatgtactgagcgatgaagccgagttcgtctataaatgcacggactattacaagcctgaagccgaacaggttttaatatggaacgacccgacagtcggcataggctggccgcttcaaaccgcgccgctgctgtcgcccaaagaccttgccggcaaaacgtgggcgcaagccgaaaagctccgccttccgctttaccgataaaaaatgccgtctgaacgtttcagacggcattttttccgacagcctacttgcccgccttcagtacgcgctgtgcaaagaaaaacatcccggtaacgaagaacgccaaacccagccaagaagcggcggcatcccagttttgcagattcaacgcgagcggcgcatccgagccgccgttggtcacggagaaggcaataataaacgccataatcacaccgatcaggctttcaccgacaatcaggccggcggagaacaaggttccgatgcgctcggcgtttttcagacggccttcgcggttttccgcttttttaccgatgatgtgtttcaacaccgccgccaacaccgcgcctgccacgatgggcatattgacggacggcggcagataaatacccataccgaccgcaaggacgggcagggcaagtttgccgcctgatgattttttcaacaccaaatcgacgacgattaatactgctccaatcacgataccggtaaagatatagacccattcaaggttgtgggcgaaaatgcccgacgcgatggtcgtcatcaaagtcgcttgaggggctgccaaagcctgcgccgcgtccatgccttcgcgcggcattgcgccggtaaagccgtaggcttcgtaaagcagttccaacacgggcgaaataaccagcgcaccaacgatacagccgataatcagggcgacttgctgccgccaaggcgtggctttgagcaggtagccggttttcaagtcttgcaggttgtcattggaaatcgaagccacgcagattactgccgagccgcaaaacaaagtcagtgccagcaaaaatttgcggttagcctcatccgccaacaaacctccggattcgcctaccagcagcaaaaccagtgaaataacgacgacggacacgatgcccacgccggaaatcgggctggaagacgagccgaccaaacctgccatataaccgcaggcggcggcgaccaaaaagccgatgacggaagccaaaagcgtgcaaacgaccaccaaaagccaagccatgccgcccgtaatgtgcgaatcgccgataaagtggtaaaacgacacgcctaaaacaaacatcatcgccagcacccaaaaaatcatagccttaggcgacaaatcctgttcggcgcgttccgcagcgggcgcaccgccgccaaaactcttgaacgacatcttcatgccttccaccatcggcttgagcagcatcaacagcgtccaaaccgccgcaatgccaatagtccccgcaccgataaaacgcactttctccttccacagcttcatcgcaaacgccgccatttccatatcggaaggttgcggaatgtgtgaggagaaatacggcacggcaatgccccaagcaatcgaaatgcccaacaggatggcgataccgcccgtcagtccgaccaaatagcccgcgcccaacaatgccagtgaaaagcccatcggcagctggaaaatcgccgtaccgcttttaaaccaataactcgcgctgtcggcaatcacgcgcagacctccggcgcaaaagctcatcaatcccgccaacgcaccgccggccgccagctctttgatgccgtgctgcctgacggttatccccttcttcatgaccgcccactttcaaaatttcagcagccgccacaccttccggataaggcaaatcgcttttcaccaccattgcgtaacgcagaggaatggtgaaaatcacccccaaaatcccgccggcaatacataaaagcgtcgtctgccagaacgggaaaccgctccagtagcccgccattcagcaaaccgggcaggacgaagatgatggtcgaaagcgtacccgca

SEQ ID NO: 50 - DNA, 427 bp, Neisseria meningitidis
  misc_feature (6)..(6): N is any nucleotide
  misc_feature (99)..(99): N is any nucleotide
  misc_feature (409)..(409): N is any nucleotide
  misc_feature (427)..(427): N is any nucleotide
aatgancggcggcaggctggcgaccgcgtatccatactttccgtcatgattgaagacaatcccgacataccgcagctttgggcgcaatgttcgattttncctctatccggttccgtatcgaaaaaacaaggggctgtactagattagccctaaatcccacaccaatcccgcagattttaagctgttgagacggtgtgccgaagttaaatcgaaattcgcattctttcaagaacagcgggaaagatttacgatcgattccgttgtattttcgcaagacgcgtttagtctagagtctgtatattacattatttttagggtctgctagccaatttcttgttcccttcattattttatcttctgaaagaaaattatttttttccatgctattaatattaatgatatgattttnatttaaaataaatgtttn

SEQ ID NO: 51 - DNA, 684 bp, Neisseria meningitidis
acaatttctcctgcagcgccgatgatgtttttaacgatatctgcagtgccgttgaaggcttcggcggcattgcccgatctgtccagctcggggctgtatcgggtggcgcgtttgaatccgtcgcctactccttgcgtcagcatactaccggcattgtggaaacggtcggcaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctaaatccgtcaacgggactaccggcttcatcagaatcggaatgtgaggcatggttgtcgaagggggaatggacttcgtgcccgtgatcggaaaagcggacaatgtagccgatatttcctttaatggccgcctgttgaatcatcaggttgcccaactgatggctttgtatttttcccaatccgatatgrccgactgcgctcggcaagttcccccctgctgccgaataggtggtatttcccgtcgggttcgaaatgctgacggtcgagaacctgccggataaaagaatcgtttgccaaatctgaggcgtgtgcatgcatcggcaggcacactgc

SEQ ID NO: 52 - DNA, 28874 bp, Neisseria meningitidis
gcttgcatgcctgcaggtcgactctagaggatcccgaaacgccgtgaaatcggtcacggccgtttggctaaacgtgcattgttggccgtattgccgaaacctgaagatttcagctacaccatgcgcgtggtctccgaaattaccgaatccaacggctcttcctctatggcttccgtctgcggcggctgcctgagcctgctgtctgccggcgtgcctttgaaagcacacgttgccggtatcgcgatgggtctgattctggaaggcaacaaatttgccgtcctgaccgacattttgggcgacgaagaccacttgggcgatatggactttaaagtggccggtacgaccgaaggcgttaccgcgctgcaaatggacatcaaaatccaaggcattaccaaagaaattatgcaaatcgctttggcacaggccaaagaagcgcgtctgcacatcttggatcagatgaaagccgccgttgcgggcccgcaagagctgtccgcacacgcgccacgcttgttcacgatgaaaatcaaccaagacaaaatccgcgaagttatcggtaagggcggtgaaaccatccgttcgattaccgctgaaaccggtacggaaatcaatattgccgaagacggtacgattaccattgccgcaaccactcaagaagccggcgatgcggcgaaaaaacgcatcgagcagattactgccgaagtggaagtgggcaaagtgtacgaaggcactgtggtgaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgagtaacgcttagggtgaaagtgccgtctgaacaggtttcagacggtattttttacgggtatcgggaatgaatggggcttacagccacaggacggcaagtttccataatgcccataatgatacggataatcccgtacacaggcggatatatcggttttgcatgatttttttcagttgcagggaaaaaatgccgattgctaaaagattgggcagcgtacccagtgcaaaggcaagcatatataacccgcccgttgccgcactaccgcttcccagcgcgtaaagcgacgcgctgtaaaccagtccgcacggcagccagccccataatattccgaccgcaaggcaggcgggtatggattttatgggtaacagccggttgagtatcgggttcaggttccgccatatcggtttgccgattttctcgatttttgccgccaaggaagaaataccgctcaagtataagcctaaaaagagcagcaggaggttggcggccgtgtataaaatattctgcaggacgcgggtttggtcgagtgaaacgccgacctgtccgattaatccgagtatcaggccgattgccgtatagctgcttacccgtcctgtgttaagcagcaggatcagccaaaagcggttgatatgcggggggagttggagcgcaaacgcgctgcttaatccgccgcacataccgatgcagtgcgttccgccgaagaaaccgagtaggaacagggtgaggaaagtgatgtcgtggttcataggcagtttgaagtcaaatatttttcgggaaaagggatgatttgcggcagtccggcacataggatccgccgagggcattgcccgtgctgttaaagtcttgaataaggatgcagtttgcaccctgtatttcgataattttgtaaaatccgccctttactgcgccgtcggcgggtttgccgtgtgcgtcaaaatacaggatggtgcggttttgaagatgcgcgcaatttgaaacggccgggtttgccggtatgtttcgggtgcaggcggcaaggattgcacaagggaaaagcaacagtaatatgcggaacatggtgtttcttgtaaggggtaacaaacagtataatggctgattttaatcctcaggcggcgggagatggaagcatttcccttcggtgcgggggatttcggattcggaagcaacagacgatacgggatttcggaacaatatgaacactttgaaatttaccaaaatgcacggtttgggcaacgattttatggtgattgacgcggtcagtcaggattttacccccgaggacgcgccgattgcggaatgggcggaccgcttccggggcgtgggcttcgaccagcttttggtggtcgggcgttcggaaaccgaaggcgtggatttccgttaccgtattttcaatgccgacggcagcgaggtcgggcaatgcggcaacggagcgcgttgttttgcccgttttgttgcagacaagggtttgaccgataagaaagaaatttgtgttgaaacggcaaatggcgttatttttccgaaattgtccgataacggtatggttacggtcaatatgggcaaaccgaagtttatgccgtctgaaataccgtttgtccccgaatcgggcgagggggatgatgcctgtatttacggggtgcatctcgaatccggcattcagcctgtcagctgcgtcaatatgggcaacccccatgcggtgattgtggtcgatgacgtggaatgcgcgccggtgcgcgaaaccggttcgcttatcgaaccgcacaggcagtttcccgaacgcgtcaatgtcggctttatgcaggttgtcggccgaaccgcgattcgtttgcgcgtgttcgagcgcggcgtgggcgaaacccaagcttgcggtacgggcgcgtgtgcggctgtggtggcgggtatccgtctggggctgttggatgaagggaaaacggtagaggtggttttgccgggcgggactttatatatcgaatgggcctgcggcggcgatgtgatgatgaccggccctgcggaagcggtgtttgaaggtgagttggcgtattcatgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataatacggtgcggccgtatcggaacaaaaagttataaagaaagaaattttggatattggttttttaggcggcataggtttaggataaagccatatccgaaatttgtttatgtttcggcgcaaatcccctgcaatcggacaggatgcctatggggattgcgccttactgtcgaaaccttattattcaggagcagaagatgaaaattgcaaacagcattaccgaactaatcggcaacacgcctttggtcaaactgaaccgtctgaccgaaggtttgaaggcagaggttgccgtgaaactggaatttttcaatccgggcagcagcgtcaaagaccgcattgccgaagcaatgattgagggtgccgaaaaagcgggcaaaatcaacaaaaacaccgtcattgtcgaagcaaccagcggcaatacgggtgtcggtttggcaatggtatgtgccgcacgcggctacaagctggcgattaccatgccggaaagcatgagtaaggagcgcaaaatgctgttgcgcgcgtttggtgcggagctgattctgacccctgccgccgaagtatggcgggcgcgattgccaaagcgaaatccttggtggacgcgcatcccgacacttattttatgccgcgccagttcgacaatgaggcaaaccccgaagtccaccgcaaaacaaccgccgaggaaatttggcgggatacggacggcaaagtcgatgtcttcgttgccggcgtcggcacgggcggtacgattaccggcgtgggcgaagtgttgaaaaaatacaaacccgaagttaaagtggttgccgtcgagcctgaagcttcacccgtattgagcggcggcgaaaaaggcccgcacccgattcaaggcatcggcgcaggctttattccgaccgttttgaataccaaaatttacgacagcattaccaaagtgtcgaacgaagcggcttttgaaaccgcccgcgcaatagcggaaaaagaaggcattttggtgggtatttcttccggtgcggcggtttggagtgcgttgcagcttgccaaacagcctgaaaacgaaggcaagctgatagtcgtgctgctgccttcttatggcgaacgctatctctctacgccactttttgcagatttggcataatgctttaatcggattgtcgaaacattcagacgcatttttcggtatcggtgtaacgccgtgccggaaaatgcgtttttgcatatatgccgaaaacgccggttgtgttttaatcaggtgttggtgtcgccgcatcgcttgagggaaatattttttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatattcgggttttatttggcaggacggttttttgccccaacggaaaatagcctgcctgcccgtaaaatcagccgtttgtccgggtgcagccggggctttgggcttcagacggcatattttcggaatggcggcattcttgccgtcggcgcggcagccgtatggggaagggaggggatattgtggtcggtaacggcaaaaaatatgccgcaccattgctggtgctgggttgcgtggtgttcggtctgggcagtctgattgtcagatccgtccccgtcggttcgtatgcaatcgcattttggcggttgctgatttcggtgttcgtattttggtttttagcacggtttttcaggcaaaaattcccaaaaaacaggaaaaccgtccgatatgccctgacggcgggcgtgtttctcgctttcgatttggcgttgtggcacgaaagcatacacgcggtcgggccgggtatttccaccctgctcaacagcctgcaaatctttttcttgtcggcaatcggtgttttctttttcggcgagcgtttgagcgggctgaaaaaggcaggcttaatatcggcagttgccggcgtggcgatgattgccggtgcggaattcggctacaacggtaatgcggtttggggattcgccagcggtttggtatcgggactgatgctcgccctgtcgatggtgtttgtccgcaaaacccatgaaatcgagccggtggcgcttttcccttcaatgatgattttgagtttgggcggcgcggtatcgctggttgttccggcattgctgatggatggcggcgcgctttatccgacgacttggaaagatgcgggtttggtgcttgtgtacggcgtggtgatgcagtgcttcgcgtgggcgatggttgcctatgcgattccgctgctttcgctgtcgctgacggggctgctgcttttgtccgaaccggttgccgccctgttcatcgattatttcgggttgggcaaaccgattgaaggcgtgcagtgggcaggggtggcgctgacgctttcggcaatttacctcggttcgctgaaacggcagtcttcacattgatttcatcagggcaatattggcagttcgccgtgcaaaacctgcgtatattggactgataggtaggaaaatccgacaacgttagactcgcctgtaaaagtgaggaatagcaaatgccgtctgaaactattttcagacggcattcttggcttcctggcctaacggattgccgtaccggacctgccgaaatcgccgaagttcatcaaaatgaacattgccttgccgacaaccagcttgtcatccacaaatccccagtagcgcgaatcggcactgttgtcgcggttgtcgcccatagcgaaatagcgtccttcgggaactttgcacacgaaaccgctgccgtcgtcggcatattggcagtgttccaaaccgctttgctctatggaatatccgttttcagacataatatcggaggtatatttgcccaatacgggcagggaaacggcaggctgtccttcttttttcagaatattgaaggatttgccgtctagaccgctgcggaacatatccgtgttgtggatttcggaagggtcggtgtcgtcgggataacggtatgtgccgtcaggaatgtcggaagtgggtttgccatttaccgtcaaaatcttatcccgatattcgaccacatcgcccggaatgccgacaatacgcttgatgtaggtcatctccggctgcagaggataattaaaaacaacgacatcgccccgttcgattttgcctgtaggaataaatatattgtttaaaacgggtacgcgcaggccgtaggaaaatttgccgaccaaaatgaaatcgcccttgatcaggcccgggcgcatcgagctggacgggatttggaacggttcggcgataaacgaccggatgaggaacaataccaaaacggtagggaagaaactgccgaaataatcgccgaagtggctgctttccgagatttcgggatgagtcttcaggcggtatttatataccccccaagccgtaccgcacaatacaacgaaaatcaggaaaacggcggtaaagctcataaacagggacaaagcggcaaacacgccgaccgctgtcaggatataggcgtattcaaggccggaactccattccccgttttcctgccgcttcttgtcgcttttgaaataaaggatgatgccggcaagcagcgcggcagccgcgcccgacattagcattgtgttcattgttgttccttaatgcttaaaaacccgcctgtccgtgcaaccgttttaaggcggcaaattgcaaaatttgtttgcgggcgcgtgcccctgaaatcagggcggtttgaggggtgttcccgacgcgccgccctgtgtgccggagttatttgtcgctcacctgcaaaatcgccaagaacgcgctttgcggaatttccacattgcccacttgtttcatacggcgtttacctgccttttgtttttcaagcagttttttcttacgcgtaatatcgccgccgtaacatttcgccaagacgtttttacgcagtgctttgacgttttcgcgggcgataatctggctgccgatggcggcttggacggcaatgtcgaacatttggcgcggaatcagctcgcgcattttcgatgctagctcgcggcctcggtgaaccgcgctttgacggtgcacaatcaggcttaaggcatcgactttttcgccgttgaccataatatccagcttaatcaaatcagacggttggaactctttgaaatgataatccaacgaagcatagccgcgcgaagtggatttgagtttgtcgaaaaagtccatcaccacttcgttcatgggcaaatcgtaagtcagcatcacttggcggcccatgtactgcatattgacctgcacgccgcgcttttggttacacaaagtcatgacgttgccgacgtattcctgcggcacaaggatggtcgcggtaataatcggctcgagtatggtttcgatgctgccgatgtcgggcagtttggacggattttcgacttcgattttttcgccgcttttcaacacgacttcataaatcaccgtcggcgcggtggtaatcaaatccatatcgaactcgcgctccaagcgttcctgcacgatttccaagtgcaacagacccaagaagccgcaacggaagccgaaacccaatgcttgggaaacctcaggctcaaatttcaacgaagcatcgttaagctgcaatttttccaaagcatcgcgcaaagcttcgtagtcgtggctttctacgggataaagtccggcgaatacctggctttgcacctcttggaaaccgggcagcggctcagtggcagggttggcaaccaaagtaaccgtatcgccgactttcgcctgtcccaattcttttacgccggtaatcaaaaagcccacttcgccggcttttagttcttgtttttgaactgatttcggtgtgaatacgcccagctgctcgacctgcgtttccgccttggtgctcataaagcgcactttgtctttcagtttgatggtgccgtttttcactcgaatcagcataaccacgccgacatagttgtcaaaccacgaatcgacgataaccgcttgcagcggcgcgttttcgtcgccggtcggtgcggggattttggcaacgatttcttccaaaacgtcttccacgccgatgccgcttttggcggaacattgcaccgcgccgacggcatcgatgccgatgatgtcttcgatttcctgttccacgcgttcggggtcggcggcgggcaggtcgattttgttcaaaaccggcacgacttccacgcccaaatcaatcgcggtgtagcagttcgccacggtttgcgcttccacgccttgcgacgcgtcaacgaccaaaagcgcgccttcgcaagccgacagcgaacgggaaacttcgtaagagaagtcgacgtgtcccggcgtgtcaatcaggttgagttgatacacctgcccgtcgcgtgctttatagttgagcgcggcggtttgcgctttgatggtaatgccgcgctctttttcgatgtccatggaatcgagcacctgcgtactcatttcgcgcaaatccaaaccgccgcagtattggatgaagcggtcggcaagcgtcgatttgccgtggtcgatgtgggcaatgatggagaaatttcggatatttttcattagagttgttttgaatgtcggacagtgggtttgggaaatgccgtctgaacaaacggcgttgcgtccgaatatcgggtgcaacgtggaaatagcccgttattctaacggaaaaccgctgttttggcataagtttgataaaggtcttataaagatttgacgatttctgccaccatttttgcggaatttgccgccgccgttttcaagaactcgtcaaagctgatgtctgctttttcatctgccgaatcggaaaccgcgcggatgatgacgaaaggcgtttccaactgatgacaggtttgggcgattgccgccgcttccatttccactgctttgacttcggggaagtgcttgcggatttccgccacgccttcgctgctgtggacaaagcggtcgccgctgacaatcagcccttgttctaccgccgcgccttcaaacgtccgcgccgcccgttttgccgcctcaatcaaaatgccgtctgaagcaaaccttgccggcagttgcggcacttgtccccaggcatagccgaatgcggttacgtcgacatcgtggtgtgcggtttccgtgccgatgactacgtcgccgactttcaaacccttgcccaaaccgcccgcgctgccggtgttgatgacgcagtccgctgcgaattcacggataatccaagccgttgcaaccgccgcgttgaccttgccgatgccgctcaatgcaagcaccatgcgttttcccgccaattcgccttcataggcggaaaatctgccgaaagagacggctttgacattttccatcatctcgcgcaaaagctcgatttcttgttccattgcgccgataacggctactgttttcaaagacatattgctgacctgttgtgaatttcggatagaatgcctgattatacacgctaacacggcaggattgagtggaggtggtttgtccgtgccgtctgaaacggtttcagacggcacggcgggtttttggtagaatgggaaggtacagattgtttgaagattaggggacgaggatgtttaccgatgaaaatatgaccgcaaaggaagaactgttcgcatggctgcgccatatgaaccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttccagccccgatttggaactgctctgatggcggtatggatttccggacggatggtttgaaatgatttatccgtggcataatgagcaatggcggcagattgcggaacattgggagcgtcgtcccaatgcatggctgtttgccggcaaaaaagatacggggaaaactacatttgcccgctttgcggcgaaggcactgttgtgcgaaacccctgcaccgggctgcaaaccctgtggcgaatgtatgtcctgccatctgtttggacagggaagccatcccgatttttacgaaatcacccccttgtcggacgaacccgaaaacggacgcaaactgttgcagatcaaaatcgatgccgtcagggaaatcatcgataatgtgtacctgacttcggtacggggcggtttgcgcgtgattctgattcatcctgcggaaagtatgaatgtccaagccgccaacagtttgttgaaagtgttggaagaaccgccgccacaagtggtctttttgctggtcagccacgcggcggacaaggttttaccgaccattaaaagtcgctgccggaagatggttttgcccgctccttcccatgaagaggcattggcatatctgcgtgaaaggggtgtggcggaacctgaggaacgtctggctttccattccggagcgccgctgtttgatgaggcggacggtgtccgtgcgttgcggattaaactgttggatattttggcagaaccaaggttgttgaagattttggattacgccgcgcttttcgataaggaaaaacttccgctcgccgtatttgtcgggtggatgcagaaatggctggtcgatttgggattgtgcctgcaacacatgaaacccgtctattatcccgcttatgaagacaggctgcttcagacggtatccggtttccgtccgcgcaatgtatttgcggcggaggatatgctcaaacagcttgccccctacgggtttcatactttaaatgtcaaaatgcagatcgagcatctgctcatcaactatttggaattgaagaaagagaacgggtgaattatgtcagacggacaaaatattccggcaaaaatgatgtcgttgcagctgaaagacatgaatctgctgtacagctcctacatgccgtttttggaacacggcggtctgtttgtgcagaccaacgacgtattttccatcggggacgatattctgcttgccgtagaaatcctcaacttccccaaactgttcctgccgaccaaagtcgcctggatcaatcctgcgcgtacttcctccaaacccaaaggggtggggctggcattcacaaaacacgaaaactgcctgaaagtcaaagaccagatcgaagtcgaactgggcaacacaatcggcggcagcagacctacgtttaccatgtaacgccatgcatatcatcgattcgcactgccacctcaattttgaaggtttgaaagaacgcctgcccgaagttttgtccaacatggaagcaaacggcgtggggcaggcactcgccatcagcgtcagtagggaaagcttctccgaagtctttgccatcgccgaagcgcacgaacacatctattgcaccataggcgtacatcccgacagcaaggaagccgaagaattttccattgcggaaatggtcgaagccgccgcccatccgaaagtggtcggcatcggcgagacgggtttggattattactggtgcaaaggcgatttgtcctggcaacacaaacgctttgcagaccacatcgaagcagccaatcaaaccggactgcccgttatcgtccatacgcgtgatgcggcggcggacaccttgtctatcctgaaagaatgccgggttaattcgggcgttatccactgtttttccgaagacatcggttttgcccgtgcagcaatggatttggggctttatatttctttctcgggaatcgttacctttaaaaacgcacccttggttcaggaggcggcgaaatatgtgccggacgaccgcattttggtggaaaccgatgcgccgttcctcgcccccgttcccaaacgcggcaggcagaacgaaccggcttttgtgcgccataccgccgaacatatcgccaaattgcggaaccaaacattggaacaggttgcggcatatacgacggaaaacttttaccggctgtttaaaaaagtacccgatatgcggaccgtctgaccctgtaccgacgataaggaaaaccatgaaggcaattcatccgtatgcatgtccgcgctgctgccggctgcctgccaacacgtttcggacaggcatggcaaattccgcttccaaattctgcattgccaaaggcggcagacgggaagcaaaaaaagacgaaagcggcggcggatatgccctgtgccatttgccggacagcaggattgtcgaggagtgggaatatttccgttcacaatattgatactgcgcgatatacggcaaatattgtgggaagtttccgcttttgcgtataatgcgccctacctgacaaattttgtcaactttatcaaaaggaataagcgatggcttccatccacgaccaaattaaagaagtagtaacgacacaccgcgtcgtattgtttatgaaaggtacgaagcagtttccgcaatgcggtttctcttcccgcgccgtgcaaatcctgaacgcggcaggctgcaccgattacgttaccgtcaacgtattggaaaatcccgaagtgcgccaaggcattaaggaatacagcgactggccgaccatcccccaactttatgtgaacggcgagtttgtcggcggttcggacatcctgatggaaatgtatgaggcaggcgagctgcaagagctgctgaaagcctgatggattcggcaatgccgtctgaacgtgtttcagacggcattttcttttccggcaaatcaaaaaaaagtataatggcgcgtctcaaaatcacattggaacaccgcgatgaacgttaatgttatcaaccatccgctcgtccgccacaaattaaccctgatgagggaggcggattgcagcacctacaaattccggacgcttgccaccgagctggcgcgcctgatggcatacgaggcaagccgtgattttgaaatcgaaaaataccttatcgacggatggtgcggtcagattgaaggcgaccgcatcaagggcaaaacattgaccgtcgttcccatactgcgtgcaggtttgggtatgcttgacggtgtgctcgacctgattccgactgccaaaatcagtgtagtcggactgcagcgcgacgaagaaacgctgaagcctatttcctattttgagaaatttgtggacagtatggacgaacgtccggctttgattatcgatcctatgctggcgacaggcggttcgatggttgccaccatcgaccttttgaaagccaagggctgcaaaaatatcaaggcactggtgctggttgccgcgcccgagggtgtgaaggcggtcaacgacgcgcaccctgacgttacgatttacaccgccgcgctcgacagccacttgaacgagaacggctacatcatccccggcttgggcgatgcgggcgacaagattttcggcacgcgctaactgactgattttcggagttgatatgaattttcaagactatctcgccacatttccttcaatcgaccatctgggcggtttggacgttcaggatgccgacggcaaaacggttcaccacattcctgccgttcagggtaagctcggttcgctcaagctgtacaatgctttggcggaacgttttgacggaaaattgggtaaagaagcggcagaacagggtttgatatggtttgccgaacacgttgccgacgcgcgtgcccatccgggcaagcatccgaacatcgatctgctggaaaatgtcgtgcaaagcggtgaaacctggttgctcaagccgctttccgcgcaataattttcgaccatgccgtctgaaatccgtttcagacggcattttgtcggaaagaagaccgtaaaacgggcattttcttttctatttcaggatacgggcaatgatgtttcaacacacaggacgacacataaagcgccgccctatgtgttgccctaatttggaaggggttacacccttttcaaataaaatctgatgctgctgccacgaaggacggatgtccgagtggcggggtttcaaccattaaggaaatacgatgaaaaaaatgttcctttctgccgtattgcttctgtcggctgccgcccaaaccgtgtgggcggatacggtgttttcctgtaaaacggacaacaacaaatacatagaagtccaaaaaatcaaccgcaatctttacgaatattcgttcggcagtgcggcaaaaaaagaaattgccatacgcaacagcaaagctgacctgttggggcgttccgacaggtggcaaggtatgggcagcggtcgttgggcaacgatgaaattccaaaacggcgaatttatgtacaccatatggacaggcttcgattccgtgactcatacggaaagcagcggtgtcgttgtggagcgtaggggcaaggaagtcgcacgggtcggctgtacgccgaaaaccgcgcaggcgaatttcaacgatgacgatttttcctagtaatcggggcggataaggcgatggaaacagcgaaacccgtcatgctgattgtccgtccgtcgggcagggccgcagaagatgtcgaaacttgcctgaatgccggttggcgcgcggaagtattgagtccggtcgaaatcgaagcagatgctgccggactggaacttttgtccgaacaatatgcccgtgcggatgccgtgttttgggtcagtccgaccgccgttgaaaccgccgtcccgtaccttaacctttcagacggcataaaggcgcagattgccgtagggcagggcagccgccgcgcattggaacgctgtttggtcagaacggtcatcgcgcctgatgacggcaacgacagcgaggcggttttgcgcctgccggtttggaacagtctgcccgaaggtgcgcgcgtattgtttgtgcgcggacacggcgggcgggattttttgatgaatgccttgcaggagaaaggttttcggacggaggtggcagaagtctatttcagacggcataaacctttgaactttcaaaatttccaaaccgaaaatattgccgccgcctatattacgtcgaccgagctggtgcgcttgctgttcgggcagcttccgccgcaattttcccgattcttcaaatccttgctatactttacccatcatccgcgcattgcggaggcattgaagcgcgaaggcgtgtgttcggtcgaaaccgtccctacgctggaagccgcgctttcccattcttccatttccgtttcagacggcatggtctttcccggaacctcaaattaataaggagcaaaacggtgggcgaacctgaaaacaaatcatccgaacccgtacgcgagatacaggcatcaaaagaaatgccgtctgaaacctcttccccacgcaaagaaaacgaaacagaagtacacattcctgccgctccttttatcgtcaaacagtccggcagcaacgctttggcagtctgcgccctggtattggcggcattgggtttgggtacaagtggttttttgtttgtccaaggacagaatgtcttgaaaaaccaagagctggcattcaaccaaaaaatcgacaaagccgccttgggcgagtcggaaaacgccgccctgttgaaagacaacctcaaccggcaagccgccatacaatcagagctcgaccgtttggacggaaacgtcaaagcaaacggcgaacaaatcttggaaatgcaaaaatcctatcgcgagttgaccaaaggacgcgccgattggctggtggacgaaaccgagaccatactcaatctggcggcgcaacagctggtgttgactggcaatatccaaacggcagtcggcgtattggagcatatcgacagccgcctgtcccgtttcaatcaggcagagcttctgccgatcaagcaggcggtcagcagcgacttggcggaactgaaaaaccgtccctatgtcgatatttccggcacggcattgcgcctcgacaggctggaaaccgccgtatccggactgccgctgatgctcgacggcgtgctgaaaccgggcgtacaggtgaagaacgaagccgcttccgcttcatggtggcagaacgtatgggaaaaatccctcggcacattgaaggggctggtcgaaatccgacgtttggaaaacaacgatgccatgctgatttctcccgaacaggcatattttgtgcgtgaaaacctgcgcctccgccttttggatgcgcgcactgcattaatgcagcgcaacagcgaagtctatcagggcgatttgaacaatgccgaagccgccgtcagacagtatttcgatgccaagtctcccgccacgcagtcgtggctgaaagaactggcggaattgaaggcgttggatgtgcggatgactgcggatgacggtttgaaaaacagcctaaatgccgtccgcgcctatcgcgacggtacgcgcatgacggcggcggaaaatcaagaagcggaacaggcggcttccgaaccggcaaacgaaaaaacagcttccgaaccggctgccgcatcggatgtgaagaccatagaagcaccgtccctgccttcggaacgcaaaccggaacagcctgcaaaaaaacagaccgtaccggaaaaggcagggcgttcgccgtccgctaaaggagaacgcgcatgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggcgtactcaatatccccgaaaagatgcagcgtttcggttcggcgcgtaaaggccgcaaggccgcgcttgccttgaacaaggcgggtttggcgtattttgaagggcgttttgaaaaggcggaactagaagcctcacgcgtgttggtcaacaaagaggccggagacaaccggactttggcattgatgctgggcgcgcacgccgccggacagatggaaaacatcgagctgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaactttccaaggcgggcgcgttgggcaaatcggaaatggaacggtatcaaaattgggcataccgccgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgcctacggccgcaaactttggggcaaggcaaaaggctaccttgaagcgagcattgcattaaagccgagtatttccgcgcgtttggttctagcaaaggttttcgacgaaatcggagaaccgcagaaggcggaggcgcagcgcaacttggttttggaagccgtctccgatgacgaacgtcacgcagcgttagagcagcatagctgattttgggaaatatctttatctgggagaatttgatggggtcttcagattcctttaaggaaaagaaagaaatatttgaaattggaacgcctgcttatcgccaaaagttaattgatgtttggaaaaagagcattaatggaaacgaaaaatcttgggtgctctttgaaaatgggacttgcgtcattttacttgaaccggaaaaagatttggcgaaacaagctaaagagatgttaagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatgaaaacctgctgccgtttaatcatctactgatgattacttaggcaaatgtgcccgtccctcccttttcagacgacctttcattgcggaaaccgccgcaaaggttgtctgaaaaccgttttccttccccgttttacaaacaaaccgaaagccccacatgatctctttgaaaaacgacactttcctccgcgccctgctcaaacaacctgtcgaatacacgccgatttggatgatgcgccaggcggggcgttatctgcccgaatacaaagccacacgcgcgaaagcgggcagcttcctcgatttgtgcaaaaacaccgaattggcgaccgaagttaccatccaacctttggaacgtttcgatttggacgcggcgattttgttttccgacatcctgaccgtccctgacgcaatgggcttgggactgtattttgccgaaggcgaaggcccgaaattcaaacgcgccctgcaacacgaggccgacatcgccaagctgcacgttcccgatatggaaaaactgcaatacgttttcgacgcggtaacttccatccgtaaagcattggacggccgcgtaccgctcatcggcttctccggcagtccgttcacgctcgcctgttatatggtcgaaggcggcggcagcaaagaattccgcaccatcaaaaccatgatgtactcgcgccccgatttgctgcacaaaatcctcgataccaacgcccaagccgttaccgcctacctcaacgcccaaatcgacgcgggcgcgcaggcggtgcagattttcgacacttggggcggcgtgttgagcgatgcggcgtttaaagaattcagcctcaaatacatccgccagatcgtcgccggactcaaacgcgaaagcgaaggccgccgcgtgcctgttatcgtatttgccaaaggcggcgggctgtggctggaaagtatggcccaaatcggcgcagacgcattgggcttggactggacgtgtaacatcggcgaagcacgccgccgcgtcggcaagcaagtcgccctgcaaggcaacttcgacccgttcgccctcttcggtacgccggaatccatccgcaccgaggtcgcacgtatcctagccgactacggacacggcagcggccatgtcttcaacctcggacacggcatcaaccaacacgccgaccccgaacacgccaaaatcttagtcgataccgtacacgagctgtctcggcagtatcacggcgggtaagccggcaggaaaccgcccgatatgccgtctgaagccgagagatggccggttagggtaaaaataaggcaatgcggcaatatccgccgtgtacggatagtacatgacggcggcgttgtcgtattggcgcaatcccaaccgtccctatgttcagacggcatttttgttttcagatgcagggaaaaccgatggcaaaaacgcttaaaaccctttaccaatgcaccgaatgcggcggcacttcgccgaaatggcagggcaaatgcccgcattgcggcgagtggaacacgcttcaggaaagccttgccgcgcccgagccgaaaaacgcccgtttccaatcttgggcggcggatacctcgaccgtccaatccctctccgccgttaccgccaccgaagtgccgcgcaatccgaccggtatgggcgaactcgaccgcgtattgggcggcggtttggtcgatggtgcggtcatcctgctcggcggcgaccccggcatcggcaaatccacgctgctgttgcaaaccatcgccaaaatggcgcaaagccgtaaagtgctatacgtttccggcgaagaatccgcccaacaagtcgccctgcgcgcgcagcgtttggaactgccgaccgacggcgtaaaccttcttgccgaaatccgcatggaagcgattcaggcggccttgaaacagcatcagcccgaagttgtcgtcatcgactctatccaaaccatgtattccgaccaaatcacgtccgcccccggctccgtgtcgcaggtgcgcgagtgtgccgcccaactgacgcgcatggcgaaacagatgggcatcgccatgatactggtcggacacgtgaccaaagacggcgcgattgccggcccgcgcgtgctggaacacatggttgataccgtgctgtatttcgagggcgaccaacattccaactaccgcatgatacgcgccatcaaaaaccgcttcggcgcggcaaacgaactgggcgtgttcgcgatgacggaaaacggtttgaaaggtgtgtccaacccgtccgccatcttcctcgccagctaccgcgacgatacgcccggctcgtgcgttttggttacacaggaaggcagccgcccgcttttggtcgaaattcaggcattggtcgatgacgcgcacggcttcacgcccaaacgcctcaccgtcggactggaacaaaaccgtcttgcgatgctgcttgccgtgttaaaccgccacggcggcatcgcctgtttcgatcaggatgtgttcctcaacgccgtcggcggcgtgaaaatcggcgaaccggcggcggatttggcggtcatcctcgcgatgctttccagcttccgcaaccgccctatgcctgaaaaaaccgtggttttcggcgaaatcggcttaagcggcgaagtccgccccgtcgcacgcgggcaagagcggctcaaagaagcggaaaaactcggcttcaaacgcgccatcgtccccaaagccaatatgccgcgcaacgccaaagagtttccgaacctgaaaatctacggcgtttcgagtttgcaggaagccatcgatatttgccgcgacagcagggaataaacggaaatgccgtctgaaatcgggtttcagacggcatttggtttgtggcggattgaaacaagaaggcataccggcgacagataagatttgcggcaaagttgcctgtgatgtggcaaaaacacacacgcccgtcatccccgcaagggtgggaatccggaatcgtccgtttcggcaatgattgaaaatcacggtaacccaaccgattggattcccgacttcgtgggaatgaggggcgtgtgcatttgatttccatccgccatatgtcggcgacgggcttattcgcctacggttttttgtatcagtttttcggcgtttgccaaagtgtttgccacttcgtcgaaaccgatgcggctgccggcgatgagggcgcgcgtatcggtataggcggcgcgtactttgccgtccgtttcggtaacgaggacgcgtaggggcagttgcagggcgaaggcggggtctttgaccatcagcggcgtgccggctttgggcgtgccgaagacgatgacttttgccggctgcatcgttaagccgtttcggcgggcggcttcctgatggtcgatgacggcaaaaatgtccatccctttgctttttatggcggtttcaaggcggctgacggtttcgtcaaaactgtattttgaggtgagggtatgcgtggtcatagcggtttcgttttgggtggacggttcgctggcaggatgtgccgaagcggttgaaatgcagagtgcggatgcggcaatcagggggagtatgtgtttcatcgtatttcctttttcctttttggttgaaacggtagaatcagactttattcgggaggggtgtaaccctttccaaatcagggcaacacatagggcggtgctttatgtgtcgtgaaacatcattgttccttatcggtttgtttatcaggcttcggacggggcggcgcgcgccgcgcccgatgttgcgccgcgtgccggaacgccgtatgccgtctgaaagcctgtcctttcagacggcattgcgtcatttcatcccttttttgagcaggtcttcataaccgccgtgattggcaacatttgtataacctgcttttttcagctcttgaagggcggcttcggcacgccgtccgctgcggcagtagaggttgaccggcgtgtctttgtcgggcgcggcttcgtgtatgcggcggacgatttggtcgacggggatgttgaccgcgttgtgcaaatgcccttcgctaaattcctgttcggaacggacatcgatccaaacggccggatgttgcgcggtttgggcggcggatacgggtttttgcggggctgcctgcgcggcaaaggcggctgaggcaatgagtgcggcggtaatcaggtgtttgatattcatagggttttcctgcggttgttgtccgaaaggacgggaagttattttatctgttccaaagcggcggcatctatgtcccaacgccaaacgccgccgcctttgccatccaatccgcgcaaaaacaggtagcggacggaaacggcggcgggcggttgtccgcgcagcttgaagtagcgtgcggcggcaacggcgtaaatcagtgcctgaaggtaatagtggtggtgtgcgacggcttcgtccattgcctgttgcgtgtaggcggatgcgtccgtaccgaggtggtttgatttgtagtcgatgacgcagatattgccgtcggggtcttggcagaccatatcgacaaagccgtttaaaaagccgttgacggtgtggaagtcgagcgtttcggcagcggcacggcagacttcgggcagcctgatgtcgtcgcgggcaaaccagtcgcgcaggcgtttgaggctgaagtcttcggtgtggagggtaaagcccatttcgggacagcggcactcgggtgagatgtcggacaggtcgtatgcccccgtcagcggcgttttgcggcaggcttccgccatttcggcaacggcgggcagccatatttcttcaaaaccgtattttttcagcttgtcggcaatgagggtttcctgtccggcggctgcttgtccgaatttgaaatcttcaagaatttcgtgcaggcacagccccgcctgcgtgcctttcggaaaatcgtgtatcgatatgccgtctgaagccgtcggcgtttcagacggcatcgccggcaccgaggtttcggcggcatccaaggacgggcaggcatcttcttcgccgccgtcgggcgtttgggtatggcggcttaaggcggtaaagctagtgtggcggacaaatcggaatccgcgttcgggaatgctgtttgcggcaaattcggcggtttgaccggcgttgctgcgataggcggcagggggcggcgcattttcggtgaaggcgaaatttgtgccggaaggggcgttgtccgccacgcgccgccagttgcgtttgagcatcgcgatgccgtctttttcacacgcataggcacggcggacggtttcacggctgtcttggggcgagccttcaatcaggtaggcgagggggttgtcggcagtattggtggagtacgcggcgtagatgttgagctgttcctcggcacgcgtcagcgcgacataaagcaggcgcaggcgttccgccatttcttcatcggcgtattgtttctgttcgtcttccgacagttgcgcctttgccaacagttcggttcggtttgcgccttggtggaggatttgccagtcggacggtccggtatcttgcgcgtcccacgcaaacgggcagtacaccagcggatactgcaaacctttcgaggcgtgcatggtaacgattttgaccaaatcttcgtcgctttccagacggatggcgcggttgtcgccgctgttgttttcggcaaggctgatttggtcgcccagccatttgtgcagcgcggcggggttgcggttttgcgcgtcttcggcggcaagcagttcgagcagttggaaataattggtcagactgcgcccgttgttccggcttaagaggcgcgtttcgatgccgtgtgtttgggaaaattgctgcatagcggcgaaaatgccgtatttattccagttgtcgagtgcggttcgggcagattccgcccaatgcaaaatctcgctttcgttttggttgaagtcgtgcaattgctgcgcgtcataaccgaatatgctgcttgtcaggacaaaacgcagcgttccggcgcggcgcggttcgagccagaagccgatgagtgcggacagggcggcggcttcgggcgaggcgaacacagattcgcgcgaaagcaggacgctttgcacctgccgttttttcagggcggcggaaaccatcaccgcctcgttgtgcgtgcgtaccagcacggcaatatcgcccgactgcaacgggcagcctttgaaattcagacggcctctggcggcttcgttgagcgcgtgggcgatttcgtcggcgcaatagtcggcggcacggcggcgcaaaacgtctttgttggctttttcattgtcgttttcgtgcagccaacgaacctgtacggcaggacgttcgggggacagcctgctttcggcacgcgccgcaccgacttccgaatagccgatgttttccaaaacgaacgggcgttctttgaggcggaacagcgcgcctatgctgccgataagcgcggcgtggctgcggtagttggtggcgagcgtgtagcggtgccgcgcgtcttccgccgcctgaaggtaggcgtaaatgtccgctccgcgaaagctgtaaatcgcctgtttgggatcgccgacgaggaacagcggtcggttttgggcgatgaaaatcttttggaagatttcgtattgcagcgggtcggtgtcttggaactcgtcgatcagcgcggtttcccagttttcggcaacggcgcgggcgagagtgtcggcgtgcggattgtcggtcagcgcggtgtggacatcgagcagcaggtcgtcgaaaccgcgttcgcggcgcgattttttcatctcggcaaggctgcggttgaggtattcgattaaatccagttgcagccggatcattgttgcttcttccgcttcttcgagtgcgttcaaatcgcgcccgaagtctgccagtttctgcaattcggcaaatactgccgcatcgggcgttttgccttttttcagtccggcttcgagtttgtcggatgcaagtttcaagagtctgtcgtgtgtgtctttgtccagaaagggcagttgtccggcggcggatttttgtgccagttctttaaaaaggttgccgaagctgtttttgcggtaactgttgccgttgaggtcgggatgaatgcgccaaaagccggcttccagttctggcagcaggcggcagatggtttgccatgaggtttcggcgttgcgctgcgcctgtttcaaatccgcctgcggacggcggaaattcaggtacgggcgggaaagatagcgcgaaatttgggcaaggacggtttgcggcacagctttgcgtttaagcgccaatgcggcaagcaccggatcattgctgacgcgttcccgccaaaaatcttgcgccgggataagcaggcggtcgccgtcttcttcggtcatttcgacatcgaacggtgcttggcacaggaaggcgtagtcgcgcaggatgcgctggcagaagccgtggatggtatagatggcggcgttgtcgaattgcccgatggcggccttgaggcggacaatcagacgcgtccggccctctttttgcaaagcctgttttaagagttcgggcaggaaggtgtcgccttcgtggtgttcggcgcagtaggcggcaatgccgtctgaaagcgtgtcgtctccaagtttggcaattcctttgctttctaaaacttgtaacacatcgtccaaacgcccgcgcaggcgtgttttcagctcggcggtggcggctttggtgaaggttacgaccaatacgcgttcgacgtttttttgttctaatacgatcaggcgtgtaaacagggcggcaatgccgtaggttttgccggtgccggcagaggcctcaatcaggttggtgccggaaatggggacggttagcgggtcgaatgcttggatgcttgcagacatagtgcgcgctcggaaaacggttggacggtaaaacgggaaaatgccgtctgaaaaatggtttcagacggcatcgtccggcttagaggttttgcaggcgttcgacagacggcgcgtagtagtatccgcccgaaacggcggcggagagatgtcggagcagcaggtcggttttgccgtccgtatcgccgaacatactcaataattgcgcttcgatattgtgcagcgtgcggcagtatgcggtaaacatcaaaccgtgttcgccgctgattttgccgaagggcaggctgcggcggacgattttcaggccgactccgttttctttcaggttgacgcggccgaggtgcgaatcgggcaggcggacatcgcggccgaattcgtcgtcggtttccttgccgcgtccgaccgaggcctcctgttcggcgacggggacggcatcccattttttcaaatcgtgcaggtatttttgcagcaggacatagctgccgcccgcatcgggttttccttcggggatgatggcgacttcgcggacattttcatcgccctgcgggttttccgtgccgtcgacgaaaccgtccagcccgcgatcctgatacaggcgcaaaccgtgttcttcggacgcgacgcatatgctgtcgccgaacgcgcccaaaacggattgggcaagcgcgtaggcggcgttttggcggaaggattggatgtggatggacatatcgtgctgcgtggacggcgcaagcccgttgcccatttcggagaagggtttgatttcactgccttcgtccgtatgtccgaatgttgcccaggctttgctgccgaaggcgatggtcagacccaaaatatcgtccggaaagcgggctttcaaggcagttaacgcgtcgagcgaagcgcggcaggcggctttaatatcgttgaggcgattggcggcgaagtcggcttcgataaagatgccggcttgggcgtggtcgggaatgatggcggattggggcgtgttcatgagatgttcctttttggtgtcatctgtttcggatagattatagcaccgaatcggcaggcggatttttgccggaacggcgtgcgtgaatccgccgtttacatacctgatgccgcttttcggtttcgtgccgcccgccgcctttcccgccccctttatttccgcttccggcggcttcggcatatcttttccattccgatttggaataaccatataaaaaaagtattctttgtgtttgccgcaatttcacttagaatgccgcacttgcacactttttacaggagaggatgatgttgaaaaaattcgtactcggcggtattgccgcattggttttggcggcctgcggcggttcggaaggcgtgcagcggagcg

SEQ ID NO: 53 - DNA, 11658 bp, Neisseria meningitidis
  misc_feature (2829)..(2829): N is any nucleotide
cggaaagaagatctcatattttcctcaacaataaacagtcagacaattaggaaatatactagcatttttttcaggcggcataaacattaaaaaagtgtaaatttgatataccgtctgaagatttcaattggatatttatagtggattaacaaaaaccagtacagcgttgtctcgctttagctcaaagagaacgattctctaaggtgctgaagcaccaagtgaatcggttccgtactgtttgtactgtctgtggctcgccgccttgtcctgatttttattaatccgctataaagaccgtcgggcatctgcagccgtcattcccgcgcaggcgggaatctagtcggttcggtttcagttatttccgataaatgcctgttgcttttcatttctagattcccactttcgtgggaatgacggttcagttgctacggttactgtcaagtttcggttatgttggaatttcgggaaacttatgaatcgtcattcccgcgcaggcgggaatctagtctgttcggtacggaaacttatcggataaaacggtttcttcagattttacgttctggattcccactttcgtgggaatgacgggatgtaggttcgtaggaatgacgtggtgcaggtttccgtgcggatggattcgtcattcccgcgcaggcgggaatctagaccttagaacaacagcaatattcaaagattatctgaaagtccgagattctagattcccgcctgcgcgggaatgacgaaaagtggcgggaatgacggttcgggcattccttaaatcacccgtgtatcgctgtaaatcttagagatggcggaatatagcggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactataaaattccggattcccacttttgtggaaatgatgagataaacgtgattatggtttaaacggggcgtatgcccattccccgggttttaaatccaaatcaaacagtttcagcctgccgcttgccactctgatcagacgcaggcagggatagcccgccttggcggtcattcgcctgacttggcggtttttgccctcagaaatggtaatttcaatccaaaaatcgggaacggttttgcggacgcgtatcggcgggatgcgctcccataacgaatctgcttctccgtgtttcaagatgcggatgcttgccggacgggtaacgaaaccgcctaagtctatcccttttcttaggctttccaatcggctttcgtcgggtacgccctccagttgcgcccagtaggttttagggtgtttgaatttggggtcggtaatttgtgcctgaagcctgccgtcgtcggtcagcagcagcagcccctcgctgtcggtgtcgagccgtccggcggggtagaagccgggaagattgataaagtctttgaggcttttgtgtttttcgtgcggtgaaaattggcagataacgccatagggtttgttgaaggcgatgaggtttttcatagcttttgggtttgggttgaaatgggcggcggtatcgggaaaatttgtttattgcgaagggacatccgataaatggtgcttccaaagtgaaaaggtttgaatgcagattaaattttaaggtgcatgaaatggattttcaattctttgtcgaaacaatccgccgacaggaaaagaaactgaagcatggcgtgtaccggctgtttgagatttacagttggttggaagatggaaaagcaacaaaggcgcgtatccggtattttgtcaaaattgaggtcgataaacagatattgcgaaggattcatcgtggtatagcggattaacaaaaaccagtacggcgttgtctcgccttagctcaaagagaacgattctctaaggtgctgaagcaccaagtgagtcggtttcgtactatttgtactgtctgcggcttcgtcgccttgtcctgatttttgttaatccactatattataaaaattccgtctgaagcggcgttcagacggaatttgtttcaagcaggcttaacagcagcgtccgccgtttgcgccgcagcggcgtttgcggcaatagtcttgaaactgcagcttggtcatcacgggggcgttgggattatgtttgcgctgctgtgcaacgtagttttcataatcgggcacgcctgccatcaagtttgccgtcagcttgatggttttccaccaagacgcgagcttatgcttcactttgtgcctccggctgtttgccgtcgcggtacaccgccgggatttctttggcggtcggccagccgactttgcgtgctttgagggcggtacgcaaaccgtacgcggcgacaatcacgacaaccgacaagaagaggatggtcagaccggcattaatcttgtcgttgaagatgatttgcgccatttcgccgatgtctttggcaggcgcaaggatttcgtttttagccaatgcgtcgctgtatttgccggcgtgggcaaggaagctgatgcgcgggtcgctgtggaacagtttttgcaggccggcgtagcaggttacgaacagtacgccgacggcgggaacgagtaccacccagacataacggtcgcgtttcatcttaatcagcaccacggcgcacataatcaaggctacgcctgccagcatttggttggcgatgccgaacaaaggccagagcgagttgatgccgcccaacgggtcggtcacgcccgtgtagaggaagtagccccacaatgccacggcgaagaaggtcgcaatcaggttggcggngatggagtcggtgttgccgaaaggtttgtagaagatgctgcccaagtcttgaatcataaaacgtgcgacgcgcgtaccggcatcgacggcggtcaggatgaacaaggcttcaaacaacagggcgaagtgataccagaacgccatcatcgcctcgcccggaatcaggcggctcataatgtgcgccataccgactgcgagggtgggcgcaccgccggcacgggaaaggatggtgttttcgccgacttctttagcagtgtgcaacagggttgcggcatcgacagggaattgcagcttggtggtaatcacttcggcggcggtattggcatccgtaccgatcagggcggctgggctgttcatggcgaagtacacgccgggatcaagcgatgcggcagcggcaagtgccataatggctacgaaactttccatcaacataccgccgtaaccgatcatgcggacgtgggtttcgttttccagcattttcggcgtagtgccggaagaaatcagcgcgtggaagcccgaaaccgcaccgcaggcgatggtaatgaacaagaatgggaacaatgcgcctgagaataccggacccgaaccgtcgataaagtgggttacggcaggcatttgcaaagcgggattgacgatgacgatacccaaagccaaggccgcaatcgtaccgattttcaggaaggtggagagatagtcgcgcggagtgagcagcaaccatacgggcaatacggaggcgacaaagccgtaaatcataatcgcccaagtgagctggatgccgtcaaggtcgaaccaatgcccgatggaacttttagccacatcttcgccgtaaattaccgccagcatcagcaaaataaagccgacgatggaaatctcgccgattttgcccggacggatataacgcgtgtaaatacccataaacagcgcaatcggcatagttgctgcaatggtgaacgtaccccaagggctgtgaaccaatgcttttacgacaatcaacgccaacaccgccataatgatgaccataatcatcaaaataccgatggaggcaatcacgccggggacagtgccgagttcctgtttcacaatatcgcccaaagacttaccgtcgcggcgcatagagacgaacaagaccatcatatcctgtaccgcgccggcaaataccacgccgaagataatccacaaagtaccgggcagataacccatttgcgccgccaaaaccggaccaaccaaagggcccgcgccggcaattgcggcaaagtggtgtccgaacaatacgcctttgtgcgtcggaacgtagtccaagccgtcgttgtggcgttctgccggagtcaggcggtcaggatcgagccgcattacgcggttggcgatgtagaggctgtaaaaacggtaggcgatgcagtaaacggatatggcggcggtgaccatccataccgcgctgacctgttcgcctcggctgagggccagagtggtaaaggatgctaagccgaccagtaccactatgccccaaatgaggaaggttttgagtgatttcatcgaataaatccttatctcacactgtcggaatatgcctgaacggcgggaaacggccgaaccatctgccggcacgggcacaaaccggagtctgaatgattgacgaagtatgaaacagtgcgcttgtcgggatttgtgccttatgcccgcatcaaacagtgcagggatgcgggcgcacaaaacgttaaacgccgaataggattttaacgcaaattagcacaccgatagcggtttttacttggaatttggaaaaaatttacattcctccgggcgggcaggcaggttcagacggcatcgtcaggcaaaaggcggcatcggaagaggggtaaagaaggggcgcgcaatccggattattgattcatcgcaggtaaattccggttatcgggcttgtgtgtttgcgcgtccgtttatagtatggcgttgccgcagcttggaatcagggcggttgtttcatatcttatttttattggggagcttttatgaatatcaggtttttcgcgctgaccgtaccggttttgtctttggcggcctgtgccgtgccggaggcgtatgatgacggcggacgcgggcatatgccgcccgttcaaaaccaagccggcacggacgattttcgggcgttttcctgcgagaacggtttgtctgtgcgcgtccgccatttggacagcggcaaagtcgcgttgcggctggacggcaggcgtgccgtcctctcttccgacgttgccgcatccggcgaacgctataccgccgaacacggtttgttcggaaacgcaaccgagtggcaccagaaaggcggcgaagcctttttcggctttaccgatgcctacggcaattcggtcgaaacttcctgccgcgcccgttaaacggggcagcctgtttgaaccgccgtccagatttttcgggcggttttttgtgtcggacggacggttttttgtgtcggatttgttttgcagttcggcctccggcagggttcgggctgcctgataccgtccgtaacttcgggtattgccgagttcgtcggcaacggccgctgcggcttgggcggcgttttgccgaacgcctgcgttacttccctttgtaggtcgatctctttggcaaccgcgtctttgtcaaagctgtttttcagacggccttttgtcaaatattatcggcagtggctcaatgccaactttaaacctgctccgatttcttcagggctgttatccaatgataaaatgacatcgtctgcatcaatggcattccacgcttccagcttgacatggcggctcgggctgattttcaggcagccgttgtgcagccaaatatccacgctcatcatgtttttaaatagggcgcgtctggttttatagcccaagttcccgcatagcttggcaacccaatcctcatagcgttgccgaattttttcggtatcaaaaaaatcttggtcttctggactgtcataaacgaaagtcctgctgtttgccaacgcttgcaagactgtcgtgcctaaagtttcattgtcggtatccaatggcaggatatgggggggatataggtggtctattgccgttaaccccaaacctgaacatgtttgaacaatcagagtttctttattagcatcaaaaactgcccaataattttgattctgtttaaaaatcattatttgatctccgtaattttgactgtatagtggatttaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataatgttcggatttttgccatactctaccacacgttgcaactgcaatctttgctccttatatattgcaccccatcaaagggctgcattacttttctttctaaagattactatcgtataaaaaatatttttcttaaacgacagggattgcgcccgcgccatattcagacaccgcccggatgttgcgctgcccgatcggatgcttcagacggcatcggaagggtttgcagttttggaatatgaagatgataatgtccgcgagattgacggcatttgaaagcggttattccgcataccggaggatacgaaatgaacgaatattcccaattaatcaagcatcccgatatttcccttcccccggtttcagacggcatcaaagtcgataatccggcaacgggcgagactttggcgtttgtccgcaagacggattcggacaagctgaaaaacctgattcaaaaagcagctgcagcacaaaaattatgggcggcaaaaactgcgttggaacgcgccgatgtgttgtggcgttggtattttcagattaaagaaaacaaagaagcattagcgcgcctgatgacgatggagcagggcaaaagcctgaccgaggcgcgtggcgaaatcgattatgcggcttcgtttgtgcgctggtttgccgaagaggcgcggcggattgacggcgatgtgctgacgagtgtgaaagcgtcgcaaaaactggtcgtgttgaaacagcccgtcggcgttaccgctgcgattacgccgtggaactttccgtccgcgatgattgcgcgcaaggccgcgcctgctttggcggtgggttgcgcgatgatcgtcaaacccgcatcgctcacgcctttgagtgcgtatgccttggcttcgttggcttacgaagcgggcataccgcaggatttgttgcctgttgtcagcggcagtgcttcggaaatcggccatgaatttgctacgaacccgattatccgcaaaatcagcttcaccggctcgaccgaagtcggcgcaaaaatttttgccgacagcgcggcggacattaaaaaactcagtttggagctgggcggcaacgcgccgtttatcgtgtttgacgatgccgatttggacaaagccgtcgaaggcgcgctcgccagcaagttccgtaacagcggtcagacctgcgtctgcaccaaccgcgtttacgctcaatccgccatttacgacgaattttgccgcaaattgagtgaaaaagcagccgcgctcaaattgggcaacggcttggaggatggtgtgaaccaagggccgctgattgaggaaaaagcggtggagaaagtcgagcagcacatcgccgacgcgcttgctaaaggtgcaagctgcctgaccggcggcaaacgcagcgcgttgggcggaacgtttttcgaaccgactgttttaagcggcgtaacggcgcaaatggcggtggcacgcgaagaaaccttcgggccgttgtgtccggtattccgttttgaaaccgaagccgaggtcatcgaggctgcgaacaatacggaatacggtttggcagcttaccttttcaccgccgacaccgcccgccaatggcgcgtcggcgaagccttggaatacggtatggtcggcatcaatacgggcttaatcagcaatgaagcggcaccgttcggcggcgtgaaacgtagcggtttgggacgtgaaggcagcaaatacggtgcggacgaatatctagaattgaaatatctgtgtatggatgtcgggtgacggatgccgtctgaacggcaggatttcagacggcgccgcattttaagcagtctctatctgttgtacaatgcgccctgtttttacggttatttttgatttgaacaagatatgatggaaaacggaaaaacagtcccgagatggcgttttgccttgaaaagtgcgggctggcacctcttaatcagcctgtcggttgcagggctggcggcattgctggtttttaaggtttggtatccttatccttatgccgagctgacgggagggctgtcgctttatcagctggtggtggctgtcgatattgtatgtggtccgctgctgactttaattttggcaagcccgaagaaaaagacaaaggcacgcatggtcgatttttccatggtcggcatcatccagctggcggctttggtgtacggtctgcacagcgtttcgctggcgcgtcctgtggtggaagcgtttgaacaggatcgtatgaccattgttacggcggcggaagtcgtggtcgaagatttgcacaaagcccccgaagggctgcaaagcctgtcgtggttcggcatccgccgcattgcattgaaagaacctgaggatgcggatgagaagaacaagacgctggatttgtccctgaaaggtatcgagccgagtatgcgtcccgaccagtggctgccgtattccgacaaggaagcagaagaaatccgcaaacatctgaaaccgctgaaagtcttggcggatgcgagaaaaacgacggttgcggacattctgaaacaggcaggtctcgccgaaggggaggagctgtattacctgccgtttaccagcagcaggcagaaagagtggatagtcattaccgataaagagggcaacaccaaaggctacgcgccgatagacggcttcatcatcaccccttaagcgttgggactccgtccgcactcgaacatccgttcttcgcggcggtagaatcagactgtatttgagaggggcgcaacccctcaatcagggcaacacataggggaaggctttatgtgccgtccgtgtgttgaaacatttcaaaataagctcatgccgtccgaacatcctttcagacggtatggcgttttgccattgccccgataagctgttaaactatttaaattatttcgaccgaaggtacacgcacatgcaagaccccgagcagagcagcaagcccgcccgccgttttttgtgcgtaccgtctgttcaggcagcttgagcgcttcaggctgccttttcgcgtttgaacttgaggaatacgaaaatcatggatttcagttggttggcagaaccgcatacctggataggttttgccacgcttttggtgttggaagtcgtattggggatagacaatcttgtctttgtggcgattttggcaaacaaggtccagcccgcacggcgcgaccgcgcacggattatcgggctggggctggcagtcgtcatccgcatcattatgcttgcttttatggcgcacatcatcacgctgaccgagccgctgttccaaatcggcggcctcgccgtttccggcaaggacatgattatgctcgcgggcggtattttcctgctttacaaagccaccaccgaactgcatgaacgcctcgaagggcacaaccgttttaccgttgccgacagccaaaaaaaacacgcgccgttttggggcgtggtcgcgcaaatcctgatactggatgccgtgttttccatcgattcggtcattactgcggtggcgatggtcgatcatatcgtcgtggcgatgggtgcggtcgtcgtcgcgatggctgtaatgatttctgccagcaaactcttgaccgaatttgtcgacagacaccctaccgtcgtgatgctctgccttggttttttgttgatgatcggtttcagcctgattgccgaagccttccatttccacattcccaaaggctacctctacgccgccatcggcttctcgattttaatcgaattgtttaaccagatttcgcagcgcaacagccgcaaaaacgactacatcggcagctcgtggcgcaagcgcaccgccgaaaacgtcttgggtatgatgggtatacgcgaaagcgtgcttgccgacgcgggcggcgaatccggggacgacgcgcattttgaagaaaacgaaaaatcgatgatacgcagcgtgctgacgcttgccgaacgcccgattatgggggtgatgatcccacgccgcgacatcgaacggctggacatttcccaaagccgcgaagaacagtgtgcccaactgcaaaacacgccttacagccgcctgctcgttgtcggtaaggcgggcgtggacgaacctttgggctacatcaacaaaaaagacctgctgtcccaactgctggaaacaggcggtctcgacattcagacggcattgcgccagccgctcgtcctgcccgacagcaccaccgcgctgggcgcaatcgaactcttccgccaaagcagcgcggattatgctttggtggtggacgagttcggcgcggtattgggcatggtaaccatgaaagacctgctcgaaaccatcgcaggcgagttccccgaagaatttgagcgcgaagaagaaccagccgttcaggggaatcccgatgaaagcctgacggtggaaggcgcgttggaatatgtggaactcgcaccgcaactcaacctgccgcagcaggaggaagatgccgatttccatacggttgccgggctgattatggaagaattgcaaaccatccccgatgtcggcgattttgccgatttccacggctggcggtttgaagtggtcgaaaaagaagggcagcgcatcgagcgggtcaaaatcaccaaattgcccgaagaataagcattcaggatagaaaatgaacgttttgatttccaacgacgacggctacctctccgaaggcattgccgttttggcgcgcgttacggcggaatttgccaacgtcagggtggtcgcgcccgaacgcgacaggagcggggtcagcaattcgctgacgctggaacgccctttgcagttgaaacaggcgcaaaacgggttctactatgtcaacggcacgccgaccgactgcatccacatcgggcagtctgtattttcggattttcaggccgattttgtcttttcgggcatcaaccggggcgcgaatatgggggacgacacgctttattcggggacggttgcggcggcaaccgaagcctaccttatgggcatacccgccgtggcgttttccttaaacgacgcttccggacgctattgggcgaccgcagaacaggcactgtggacattgttggcgcattttttcaaaaaccccccgcagtcccctattttgtggaacatcaatatccccgccgttgcgccggaagatgtgcggggcattaaaatcgcccgtttgggcaggaggcatcacggtcagaacgtcattcccgcgcgcaatccgcgcggcgaacagatttattggataggaccggtcggcgaagtttccgatcgggaagagggaacggatttcggtgaatgcggcgcaggtttcattaccgtaacgccgctgcaaatcgacctgaccgcctatccggacatggcggaaacagcggcgttctggcatgcggactgaccgtttcatcaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatcc

SEQ ID NO: 54 - DNA, 19211 bp, Neisseria meningitidis
ccgacatggaaaccatcaccatccctaaagaaaatttcgacgctttgctaaatctcgcaagaaccgccgtcgccctgaacgaaaattttattccaaaaataaattacggagcatccaccataccagcagccggctttgccgcacttaacgagtttggaatagcccgctccaccgtggaatctttggaaattctcaaaattaaataacctcctcggtattgtcatcccgtgataccggcaacctaactaacctctctttaaaggaaaatcaaaaatggaaacccaagaaaagaaatttgttcctgcctccaagcaaataccgaccgtaaatagcggctggttagaccgtgaattaggcgaagccatgagtgaagcggtgcgtgcctgccttgctcacggtaaacagtcagaaattactgtcaagctcaaaatccaaccccaaaacatccaaagcggaacggtaaaaatcagccacgatgtagcaaccaaactgcccaaagaaaaacgcgaaggcggcatcgtctttgctacacctgacggcaacatccaagccgacgatccggcacaaggaaaattgaaactcaaacaagtttccaatacgtcaagcacgttgaaaatggtcagatccaactaactcaaacacaaaaggaaatctaaaatggaaacccaagaaaacatgattaaaaccgccttacaagcagctcaaaaacctttttttgagtttgcaccgaacaatactccgcttgtattcacaccagaccaagacggtggctggagatacaaatcacaccccgaattgatgcaaaacccgtaccgcaagtgcggcaaattcctcatgcacgataccgccagtcttattaagtttgtacaaaaacacaaacaggacggcacacaaatctacattgatgccgatttcaaatcagggcgtattgatgtcaccgccgtcatcaatggccatacgcaacaagctccgggctggctcgatttttatgccgtatacaccccgcaacacactacatcggcatccaactggctgaacaacaatgcgcaccgcatgaatcagatggagttttcccatttcctgaccaacaatgcccgcaacatcgtatccaaaaatcccggtaacgaaaattccgtttacccgaccgccgccgaagtattggatttcgcgctcaatctcgagtacaccgaaaaaaccaccttcaaacaaggctatcgtgaacaggacggcagaatcaactttaccttccaatccgaagactcagggcaaacagagaaaaacctcaaaatgtttgaacgtttcggcatcgagttcaccccgcatcaaggcggtgcatcctactttgttgaagccctgttgaaattccgcatcgacaaaaacagcggcgcactcgtcctgtggtacgaattgcagcaaatcgatgctgtaatcgaacaagcggcaaaagacatttccgaagccgtacaaaaagccttccctgaaatcgacatctatttcggcgtaatcgcctaaaaaaaagtcgtctgaaatcgtgaaccttcagacgacctccacaaaaacccaaatccgaaagaccccaaaatgaccatcacagaagaatactccatcgacatccgagtaacctcagaacaggggaaaaacgactacggctaccccaccgaacgctacggatgcgacatcatcaacacagacggggagctacttgtcggcatagagccagagtacaaaaccccctttgccgccgtcagaaaggcgctcatctgtctgacaaaagacaacctcaaaaacgctgcctgatattaagccgttaccccaataatgaggaatcaaaatgaaatacttgatccgcaccgccttactcgcagtcgcagccgccggcatctacgcctgccaaccgcaatccgaagccgcagtgcaagtcaaggctgaaaacagcctgaccgctatgcgcttagccgtcgccgacaaacaggcagagattgacgggttgaacgcccaaatcgacgccgaaatcagacaacgcgaagccgaagaattgaaagactaccgatggatacacggcgacgcggaagtgccggagctggaaaaatgaactttcaggaagaaaacgagaacatcaagaatgacatagagattaatctcttgcattccgctgaagccgacagcgtggaggcaatgatggacttggcggtttacgggctggcggcgatggttgccaaacacaacaaaacgcgcggcgagcagcttgtgttacaggcgattgccggtcatatgcggaagcttttggccgcgcttcccgaaaccgagtcattggtgcagaccgggaaggtttaccgccgacttgaagatttgatttttaaaacgtatttgccggagcagtaaagatgaacacgaatcaagatacgattccatttggcggcaaccttgtgatttgctgttcgacgggaaacggcggggacgggcggttttcttgtctgattaccgatcagataccggatttaaatcttgtcagaagcgggcaggcgttcccgatgttcatttatgagtacgaaactagagaaaaaaggaaagcctgatggacaccctattaaaaatcatcatcgcgctgtcattttccggcgctgaggcattggcggtatggcttttcatcacggccgccgatgccgtattacgccgcttccagaaaccgagtcattacaggagagtaaaaaaatgaacatcaacgaactgggcgcaaggatagaccgcccgaccatccgcgaactgattgcctacgcaacctgccgcaaccgccccatttcaaactcgacactgctgcgtatggaaaaagacggacggataccgtgccgtctgaaaaccccactcacatcccccgtatgggacacccgcgaagttttggaagccctggggttacagcaataaaaaaacgcccgattagggcgttttcacattcagacggcttttgtattccctactgcatcaaaccgacgacaggttgcggatttcgggcagcatcgggcggatttttgccgcgtgttccgcgtcggcgtgtgcgtttaaggcttcgagggcgtttgcggcggctttgaggcggctgcgtgtttccgcccagaccgtccacatcgttaccgcctgtttgcagccgagctgcttcagcggcagggaaacgtctctgcccatttggatggcccacgcgccgtatctgacggcaacggcgaggtcgtacagggcgttgccgctgatgggcagggcaggttgcggtgcgggcaatggttcgcggtcgaggacttcgccgtacagcacgccgttttcaactgccacgcggcccatcacgcttaaaacttcggggaactgttcggcaggtacttctttgtagctgcatccgaacttgcttttgacggcagaccaaagggtaatggcgatacgcgcctgcgcttctttgggtgcggatttggtcagggcgttgtgcagttttttgacggcttcgatttgttcgccggtcaagccgtccggaagggcgcgggtgggtttgggggtaactgtttttatgccgtctgaaattttgccgttaagtaaaatttcaatctgctcatcgcaccaaaccgcaaatttcggattaagccaacgggcaaagtgaatagcgagtttgggatgcagccatgtgccttgctcactgccaccacgcttcacgataactatttgatttgcttccgttaggatttttctcctaacgcttaaattctcagcaagtgcagagatatattgttgagtttgttcactttttaggtagtctttaggtaacttgccaaagtgagatgcaatggcggttgcatttaaaaaaccgtcttgacggaaagatacaggggtgttaccaaaattgagaacagatacgttcatgatagtttcctagtttagtttcgaaagacccaaatgggtggtcgggaggttcgaaaacctactagaaaaggccggcgttattccccttgcgggtattgtattccgcaccctcccgaccataggaaactagttcggatatatcgaaacaaacaaccaaacaagaaaacttatggacgtaaaaaattcacgctgacggggtaaatgccgttctagtagaggttttcgacgcctcgtgtttcgtaatatatccaatctttctattttctgcaagcataaaaaagccgccatgtggcggatagggtcgcggtcttcaacagcatgtaggatttaggaatgcccaaattgggcgcaggggtgttgaaaacacgcaaacaggcgcgccgccagccttacgggtaggcgcacccccacataggagtaaatcgatttgatacgtatagacgtaaaaaattccactctatcgtgttggatatacgctgtttgtcaggtgttttcaagcaccgtgggaaatattatatagagttatggaaatgtgtcaagagaattagcccaaatgggcggacacgcggttaagaacccacataggagggcggacttattcccctttcgggtcttgtattcgtcgcccacgcggtcatagaaacttcctgctatcgaaacaaacaacaaggaaagaaaactatagacatgaaaaaatcacattgacggagtgattgccgctgtagtgtggtttctgacgccacgaacaggaatataaaacaaaaccccctgcacatgcaaggggtttcccaaaaaaccgtaggcggcaaactgaaaggccgtctgaatttcagacggcctatgttgcggcggatgttaagctattaagctatttggttttcagaggctttttcttccattttcgggctacggcttcaaattcttgaaaggccgtcggtgcgctcctgatacggcgtatttcaaaaataaagctgcttaggttgtcccagtcacgtaacagcatggagtattcgaaatctttatacattttctcgtgcagtgctccgcctaatacgcccgcacagacaaattcgcgctggtttaaaactgtcagtatggcttcacggtctttcttcttgtccggggtatccgatgtataggtggcgagtatgcatccgtctgtttttgccagcccgtttactatggttatggcttcttgaagggcggcattgttacgttcggccatgatcagcgcgctttttggcgttttctgtattcctcatgatgccgtaagcggcaacaaaaacgccgataacagtcaatatcggcgttgctatctgtattaggttgtcagtcattgccgtcccagccgtctgaaaggcggaaatcacggctttccgaataaatatgtcccattgtcatccccttaagctgatgttgaaaataaatccttgcgtcggaatatacggcattgcttgactattttcaagattctgtacctcgtgaaccggactatacaaaaaaaccgccttcgtgtaaagcggttcttaaatcgcccgttaaggcggacacaacgatagccaaactggaacaggaggcggcaaaggcgggtttgtccaaaacagccttgattgaaaggctgattggggatttgtaggcgtttgcagatacgacaaggggcgcattccgcgccccatcacacgcacggacggcttgtcatcgcctgtcgcccgtgcgcggctgcccatatttcagaacagtcttgcaagcccctttaagggaacggttttattctagtacagtttgaatgccttggcaacggctgttttaatcgcctgaaaatcctcttcactgattattggaatgcagcggtcgcgccctttgggtttgtatcggtctaatcgtgccaatccgactgttgccgtcatgtcgcattttgcccaacattggatgtgcggcttgtccggtaaggggtttccactcattttgtggtggtagtccgccaaagggacaggttctgtgctgcttaagggtacgaccgttaccagtttgccgttgtgcctgtttcgcgctatgacgacgacagggcgtttcttgaccatttccggttcttcataaccgcgaaagtcgcacatgataaccgaacgttcccttggttggaattttaaaggcattagccgctcctgacgatgacgggctgctattatagcagttcttacacaaaaaaccgcctttgtgtaaagcggttgcaaaaaagccttccaataaaaatgcggaaacggttttttatttgcgtttccgcataatactatccaccttcagaacctcgcgcaaataagtacgcgcaagcgagcgcaaaccgtgcgccgtcgtatccagccccgcccgctgcatcgccacgcgcggactttccttattgatatgcccttgaaaattcacactttcaaacacaaaccgcccgttcacattcaacgcccgcgcctgatccaacacccactgcatcgcccgcgacagcggcacatcatgcccccgccgctcctttttccgttcggcggggatacgccaaacctccccgtccaactccgaccactccatcaacgccgcctcctgaatccgcgtcattgtcaacagcagccaatagatacaaagccgcgttacaggatggatacgcaccctgcccgcataaaccgcaaattcattgcgctgctccaaaaaatcaatcaggcgcggcaattcagacggactcaacgctgccatattccccgttttcgcccgttcaaacacacccgaaccgatttgcgcgacagggttgatttccatcattcccgaaccgaccgcaaacgcaaacaccatcttcagactgtttttcgttttgcgcaacgtatcaacgataccgcgcgcctccatcacacgcagacagccgaccacatccgccgtcctgatttgacgaatatcaagattgccgatagccggaaaaacccaccgctcaaaattccgcataacctgtccggcatacttttcagaccgccccttcgaccaacgcacaaaccaatcacgcgccaccttctcaaaagcaaaatccgcccgcaccttcttattgacgacattttccccgtgcgcccgttttcggcgcacctcctcccgccattcccgcgcatcggccagcgaaaaatcaggataccgccccagcgaaattgtctgctgccttccatcctgcacaaacgacagcttccaactccgcccgcccgtcgggtagacccacaaagccagcccgccccgtctgacaacttatacagcttatcgcgcggcttcgcatttttaacctgatttgccgacagcggcgtaatgattttcgccattatggtaatttcccatttatccaaaaattaccatacacattaccataaaaaaatgcaataagaagatgccgcaagattgcaaatgatttgctttgatgcgttatgatagggcaaaccgatgatttttatatggtaattgatacaacttgaacaaaaaagaaccgccccgaatcagggcggttttgttttgtggcggaaacggtgggattcgaacccacggaggatttgcaccctcagcggatttcgagtccgctgcattcagcctctctgccacgtttccgataatgcagtaaaaccaaataaaaatacaatatttgcggctattgcattcttatttggttttacgctcaaaaattggcggaagcggtgagattcgaactcacggagggctatcaaccctcgacggttttcaagaccgttgcattaaaccactctgccacgcttccgtcttcttgaagattaggaataataatgaaatttatacattttgccaagcacttttttcggaaaatacttaatttattgttttcactttatttgttccgaacgcataaaaacccattcgctttcatttgaagccgcgtcattgaatgcgtagccttcgtaattaaaatttttcagcatttcagggtcggtaatatgatgttctgccgcatagcgcaccattaatccacgcgcgcgcttggcatagaaactgatgattttatatttaccgtttttttcgtctttaaatattggggtaatcagccgcgcccgaagttttttcgtgttgacggacttgaaatattcctgtgaggcaaggttgacaagcgtattgctgcctgcttgggcaagcgtatcatttaaaaggttggtaatgatgtcgccccaaaactcatacaaattcttgccgcgcaaattggcaaatgccgtccccatttccaaacgatagggctgtatcaggtctaacgggcgaagaagaccgtacagaccggacagcaggcggacatggttttgcagatagcgtatctgtccaatatccaatgtgtttgcatccataccttcgtaaacatcgccgttgaacataaagaccgcctgtttggcgttttccggcgtaaacggcgtgttccattctgcattgcgctgcgcgtttaagagggcaattttgtcggaaacgtgcatcagttcggcaatctgttgcggcgcaagctcgcgcaactgctgcattagaatgtcggactctgccagcaggtcgggttgggtaaactcgctgacaggggcagggtctttttcattaaggttcttcgcaggggaaaggacaaaaaacataatctgctcggtattgtgtcaaacacggggattttaagtttaaacgtgtttgcgggcaagccgattaaaagtgaagtatagtggattaaatttaaaccagtacagcgttgcctcgccttgccgtactatctgtactgtcttcggcttcgtcgccttgtcctgatttttgttaatccactataaataccgttatagcaaattcaaccgtaaaatattgaaaaatgccgtctgaacaaaagttcagacggcatttttttattctttaccgatatagggaaacaatggtttccgcagctttgacacaagttgcgacatcggcaaccaaagcgatacgcacataaccttccccgggattgccctgttcggtatcccgcgccaaaaaacgtccgggcaatacttggatagccgctttttgccataaattgcgtgcaagtgccaaatcgtcgccatcagggactttcaaccagatgtaaaacgaggcatccggtaatttaacgtcaaatacctgttgcaaaatgggaataacgcgctcaaatttttcctgatacatacggcggttgtcgataacgtgctgttcatcatcccaagcggcaatgcttgcgcgctgcacgggaatactcattgcactgccgtgataggttctgtaaagcagaaagtttttaagcagttcggcatcgccggcgacaaaaccggaacgcaggcccggaacgttggaacgcttggacaaactggtgaacataagcagtttttgcctgcttcgacccaactgtgcagcggcttgcaggcagcccaaaggtttgttgccgtcgaaatagatttcggaatagcattcatccgaggcaataatgaaaccatatttatcctgtaaatcaaaaacttctttccagccgtccaaatccagcacgctgccgctggggttgttgggcgagcagacgaacaccagtttggtgcgtttccaaacctcttcggaaatactgcgccaatcggggttgaaagacggcgcggggcaattggcaaaatggatttcaccgccgcccaaaagtgtcgcaccttcgtaaatctgataaaagggattcgggctgacaattgcgggtttgatgccgtctgaaacagggttcaacacggtttgaacaaaagaaaacaacgcctccctactgcctaaaaccggcagaatttcattatccgcatccactgtcaagccatcgtaacggcgttttaaccagtttgcacacgcctgacgcagttcaggcagaccggccgtcagcggatatttttccaactcgtgcaatgaggcggtcagcgcatccgtaatgactttcggtgtcggatgtttcggttcgccaatgtgcagggggacggcttccagaccttcgggcgcggaaatgccctgcatcgcttcacgcagtcgggcaaagggatatggtttgagttggttgagtaaggtattcatgattttctccggttgtcggtatatcggaagatatgccgtctgaacctgacgtgtctttcagacggcattctatatttttagtgagaacccgtactgccgaagccgccctcaccccggctgcttccgacaaactcctcgacacgtttgaagcccgcctgcacgattggcacgacaaccatctgcgcgatacgctcaaacggtttgacagtaaacggttcgctgcttctgttccataacgacaccttcaattccccttgataatcggagtcaatcaaaccgaccaaattgcccaaaacaatgccgtgtttatgccccaagccggaacggggcagcaaaacggcggcatatgcgggattcgccaaataaattgccaaacccgtcggcacaagaaacgtttcacccggctgcaaaacgacttcctcatccaaacaggcgcgcaaatctaaacctgcagaaccctccgttgcatagacagggacaacatccgccatccgttcgtccaatactttcatttctacttcaatattcatcgtcttgctcctgcatacggccggtttcaaagatgggagattatacacaagccgtgtttacgctgaaacacggcaaatcggttttgttttgaaatccgttgccagtgtataattcccgcccttccggttatgaagacgaacattatgcacaccttccccgcataacgaatttatacgcggcatcaaagaaagttcgcctatgctgattgggctgctgccttgggcattaatactcggtatgcagggcggacaaaaaggcatgagctggctggaaatgttgttgatgaccagtatgaacttcgccggcggctccgagtttgccacggtcaacctgtgggcggaacctctgccgatactgcttatcgccaccgtaacctttatgattaattctcggcatatcctgatgggggcggcgcttgccccgcacctgaaaggaataccgctgaaaaaagccgtgcccgcactgttttttatgtgtgatgaaagctgggcgatggcattctccgaaatccaaaaacggaaagcagccggtttgcccgcattcaatatgcctttttatagtggattaacaaaaaccagtacagcgttgcctcgccttagctcaaagaaaacgattctctaaggtgctgaagcaccaagtgaatcgattccgtactatctgtactgtctgcagcttcgccgccttgtcctgatttttgttaatccactatatgaatcgtcattcccgcgcaggcgggaatctagacattcaatgctaaggcaatttatcgggaatgactgaaactcaaaaaactagattcccactttcgtgggaatgacggcggagcggtttctgctttttccaataaatgccccccaaactaaaatccgtcattcccgcgcaggcgggaatctagacattcaatgctaaggcaatttattgaaaatgactgaaactcaaaaaactggattcccactttcgtgggaatgacgtggtgcaggtttccgtatggatggattcgtcattcccgcgcaggcgggaatctagacattcaatactaaggcaatttattgaaaatgactgaaactcaaaaaactggattcccactttcgtgggaatgacgcggtgcaggtttccgtacggataggttcgtcattcccgcgcaggcgggaatctagacattcaatgctaaggcaatttatcgggaatgactgaaactcaaaaaactggattcccactttcgtgggaatgacggcggagcggtttctgctttttccaataaatgaccccaacctaaaatccgtcattcccgcgcaggcgggaatctagtccgttcggtttcggtttttttggctagtgccgcaacattaaatttctagattcccactttcctgggaatgacggcggagcggtttctgcttttcccaataaatgaccccaacctaaaatccgtcattcccgcgcaggcgggaatctagacattcaatgctaaggcaatttatcggaaatgactgaaactcaaaaaactagattcccactttcgtgggaatgacgggatgcaggttcgtgggaatgacgtgatgcaggtttccgtatggatggattcgtcattcccgcgcaggcgggaatctagtccgttcggtttcggtttttttggctagtgccgcaacattaaatttctagattcccactttcgtgggaatgacggcggagcggtttctgcttttcccaataaatgaccccaacctaaaatccgtcattcccgcgcaggcgggaatctagacattcaatgctaaggcaatttatcggaaatgactgaaactcaaaaaactagattcccactttcgtgggaatgacgggatgcaggtttccgtacggataggttcgtcattcccgcgcaggcgggaatctagacattcaatgctaaggcaatttatcggaaatgactgaaactcaaaaaactagattcccactttcgtgggaatgacgggatgcaggttcgtgggaatgacgtggtgcaggtttccgtacggatggattcgtcattcccgcgcaggcgggaatctagacctgtcggtttcggtttttttggctagtgccgcaacattaaatttctagattcccactttcgtgggaatgacgggatgtatagtggattaacaaaaaccagtacggcgttgcctcgccttagctcaaagagaacgattctctaaggtgctgaagcaccaagtgaatcggttccgtactatctgtactgtctgcggcttcgtcgccttgtcccgatttttgttaatccactatacccataaaaataccgtctgaacattgattttcagacggtattggcaaaacaaccttattttttacgattagagaaggcttcacagccgacatctgaggacaaggtctccaaatgggcttgggcagaagcggcatcacggcatttgtatccgtcgcccacgctgttcatccataccgacaaagtataacccgtccccgccttcggaacgccgaccaacctgtatgcccttgatttttccttatcgacaaactttaccgaaacactatattttttggcaattttcggattcatcttatagcctgagacaaatatttccagtttgttctcgatggtctgattatcgtccaggggatttttcaaaataaactgtttggaaatattgttgataccgaccatctccgtataaagctgggactgatagcctttttcaatataactttgataagaaggtatggcaatgacgctgataatgccgagtatcgcgacgactatcatcatctcaatcaatgtaaaccctttttgttccattttattactcatcattattgcttacataagattgaaggacgaccacggtattggcattcttaccccaagccttggcagtaacccgataaacattttctccgttcttcacgcccaaatattcgataatataacgtggcattttgctgacgcttctcgtgcctttcttatattccatccctttcttgtcaatgcacaggtcggtagaatttgcagggcaagaacgcttcaccgcctcaacggtgggcttgccttgcaccacgatattgtcaaaagcctcttcattatcattatttgtccgcacattcactgcggcacacagaccttttccacagttttcgctaaatgtaaccttactgtccgtatcatattccaaatccaaaacctgaagttcgccttcccgcaaagccgcctcggccaaagacaaagccaatttcctgtctgattcgttggcactgatccgctgctcggtattgtaagactgcgcggcagttacaaccaaaaaagccacgacgatcatcaccatcagcacgataaacagtgcaaaccccctctgtccgtcagaagtcgggattcccgtcaaagtgttctgtttgcgcatacatttcccccgcgtattgtcgcatcgatacggtaagcataaatatgattgtctgaagaagcggcaatcttggtatcagtaccgctactcaataaaacctccaccccggcgggcgtaacagcattttgggcgctgtcgaatttatccgtatatttgaatgtttcctctttgccggcatcgtcatcttcaggacagccggaaacatagatataccgcactttcatatgtctaacctttttcacgagcaactgaggattaccccacttgcccttatcatccaattggaagcggaacaaaccttcctcatcggcaatcctgccgaccgcataggcattgaccacatgcctttgacgcgctatattgccattttgctccttatcctgatccggaatcttcaattctttttttgcatcttctaaagtagggatttgcttgcccggtttcgatattgcggcacagctgctgacgacggtagtcgcggtgcttgcattaacatcatcgattccgtattgaaaaatcaatgcgctaccaacctggaaaaaattctgataattgatatttgaagattccgctatgggaataagtttatctataccgttcctttttaaggaaaaaggagaattttgttgcgtcgtatcgggaataacatcagttgcaggatgctcggacatattgaaacaaccgaagccgcctgccattctcgcatcgcggacaatcaatgttgccgcattccgcaaatcctgttgcgcggcaagacgctcgtttgccgcatcatttaatttccgggatgtgaagtaactcgatccgaccgccatcaggacaatcatactgagcaggcccgcaaccaaaaattcaataatggtaaaacctttcataccatcataactgccttttggtacgtttagcattttacgtctcattcccgacctccgacccttgcctgataagtatatacgatattgtcgccgctcacctcaagattcgtacgggaaatatccgaatcccctgccgaatcatttacccacaatactttaattaaagtatccccgtttgccttattgtcgcaatttgaagaaaaagcattgccggacaatgtcggcgcgttacccgacgaatccttgcagacggcgtaatggatggctgccgcatccggcaaggcatttttcagctcataactaaatctcttcaattgtgcctctgccaattgccccttagttttcatggcatcaatcgcaaaatcgccatccacagctgatagtgtatggtttcccatgtaaagattatagtttttcttgttgctgtccgaatcaatggtcggattcatcaacattccctccatcaggttttgcgtgatttggctgacgatggtttgtgtctccgcctccctgacggaagcgactgtccgcaactgtacagacaatagtgccaaaataccgatggtcagaacgagcatagcaaccaagacttctatcagcgccataccggactgggaatctttcaggcggaagcaatcattattcttcatattcatttttaaaactgaaactgttatttatactggcacatagtacgccgatcacccctagggcaaacttcgaccctgccgctgctgttaatcaaaaccaccgccgaacggaatttcttttcatcggcagaaaccgccttcgcatctgtcaacacgatttggatataaccgtcagaataaaaaaagctggattgttttgtaagatgctggtctttcgtataaccgaacgtcccgttttgattgaatgtccaaactacacggtcggtggtcggctgagtctgaccgaaagcgatatggttgaaggcataattaatccgcttatcattgatatcatcattcaataccacactgcggagaagaacatcctccgtatcattgtcatatcccttattgccgtttttgtcgccgaaagccaacattccctgccccttcttgccggagtcacatttattgttgggcgtaccgtcttttttaacttgaacaggacagatatagacagggagattgagccggacggcttcgcccctggagaaacgcaaaaggttggcaatccgctccgcgtgactggcaatgcggcgggatgcaatccattggctcatattggggagggctatcatcgccataatggctgcaatgaccatcacgatgagcagctctgttagcgtgaaaccttgttgttttcgtgtacacataagcaatagaacgttaactggtaatgtatcgtggattaaattcaaaccagtacggcgttgcctcgccttagctcaaagagaacgattctctaaggtgctcaagcaccaagtgaatcggttccgtactatttgtacggtctgcggcttcgttgccttgtcctgatttttgttaatccactatattttcaattatatgcgggctgaatgcaaaaatgcctcaagaccgcgttttattttttagggcaatctctcagcatgattttaaacgattttgcctgatttcgcctaataaatttttatatagccatttaatcctctatctttgcctcctcgggaatataggcagcattgtcgaatttggtgaattgtcccgtccatgtgaggaagattttaccgacgggaccgttgcggtgtttgccgatgatacattcggcaaggcctttcatgggtgagtcctggttgtagtattcgtcgcggtacatgaacataatcaggtcggcatcctgctcgattgcgccggactcgcgaaggtcggacatcatggggcgtttgtcggtacgcgattcgaccgtgcggctcaattgcgacagggcgatgatggggacttgcaattctttcgccaacgctttgagcgaacgtgaaatctctcccagctccgaagctcggttgtcggaacggccggatcctgccatcagttgcaggtagtcgatgacaatcaatccaagcttattgttaaattgacgggcgagacggcgggcacgggcgcgcagttcgagcgcggtcagacccggggtctcgtcgatgtacacgggcgcgtcggagagtttgacgactgcttcgttcaggcgaccccagtgttcgtcttcgagcctgccggttttcaaaacgctttgatccaaccgtccgaccgagccgagcatacgcatgaccagttgcgccccgcccatttccatcgagaaaacagcaacgggcagcctgccttctacggcaacgtgttcggcgatattgatagaaaaggcggtcttacccatagacggacgaccggcaacgataatcaggtcgccgggttgcagacccgaggtttttttgtcgaggtcgatgaaccccgtcggcacgccggtaacttcatcgggattgtcgcgcgagtagagcatatcgatgcgctgtacgacttctttcagcaaatcgggcatctccaaaaagccctgcttggatttggcggtgctttcggcgatttggaatactttgttttccgcctcgtccaaaagctgccccgcgtccctgccttgcggattgtatgcgctgcgggcgatttccgtccccacttcggcgagttggcgcataatggaacgctcgcgcacgatttcggcgtagcggcggatgttggcggcagacggggtgttttgcgccagcgtaatcagatattcgaatccgcctgccgcttccaattcttcgttccgctgcaaatcttcctgaaccgtaatcacatcggcgggacggctctcattaatcaatttggcaatggatcggaaaatcaggcggtgttcatgccggtagaagtcttcaccggaaaccacatcggcaatcctgtcccatgccggattttccagcatcaacccacccaaaacggattgttccgcctccattgagtgtgggggcagagacaatgcgccgacctcacggtcttcagacggcatggctgcgtaatcgttcatggtacatcctatctgtcgtgccgaaattgcaatcttctattatagcgtaaagcaggtttaattggtttccgcaccgcaaaacaggtagaatacacgggctgccgagttatttgcagcaacactgccaaaatacaacatttaaaacaatattcaggagtacaaaatggaacataagctgccgcaactgccttatgaactggacgcattgtccccgcatctgagcaaagagactttggagttccactacggcaaacaccatcaaacctacatcaccaacctgaacaatcaaatcaaaggcaccgaatttgaaaacctgcctttggaagagattgtgaaaaaatcttcaggcggcgtgttcaacaacgcggcacaaacttggaaccacaccttctactggctgggtttcacgtccaaaggtcaaggcaaacctgccggcgaactggccgccgccatcgacgcgaaatggggcagcttcgagaaattccaagaagcgttcaatgcctgcgcggccggtactttcggctccggttgggcgtggctggtaaaaacccctgccggcggattggatttggtttctacttccaacgccgctacgccgctgaccactgaaaacacgccgctgctgacctgcgacgtgtgggaacacgcctattacatcgactaccgcaacagccgtcccaactacctgaaaggtttttgggaaatcgtcaactgggacgaagtcgccaaacgttttgccgccttgtcctgatttttgttaatccgctatatcatttcgggtagatttttgcggtattgaatttcagttatttccgataaatgcctgttgctttttatttctagattcccactttcgtgggaatgacggttcagttgctacggttactgtcaggtttcgattatgttggaatttcgggaaacttatgaatcgtcattcccgcgcaggcgggaatctagaccttagaacaacagcaatattcaaagattatctgaaagtccgagattctagattcccgctttcgcgggaatgacggaaagtggcgggaatgacgggatgtaggttttcttaaccctgcgtcctagattcccgcttttgcgggaatgacggaaagtggcgggaatgacggttcgggcattccttaaattacccgtgtatcgctgtaaatcttagagatggcggaatatagcggattaacaaaaaccagtacggcaaggcgaggcaacgccgtactggtttttgttaatccgctataattgatgaaacgggttaaaaaagtgttgccatcgcctgttcttcttgtcggatacgcttaaataagaccagcaaataaatgggcaggccaatcaa

SEQ ID NO: 55 - DNA, 546 bp, Neisseria meningitidis
  misc_feature (343)..(343): N is any nucleotide
  misc_feature (476)..(476): N is any nucleotide
  misc_feature (521)..(521): N is any nucleotide
tgacccggcattcccttcctgcctgcgttcgtggacgcttttttcaaattccgattccgccgtttcgtttttcgggaacacgatttcgccgcgaagatgagaaaacaaacgtttcacaaggttttcgtccacggcgaacaattcggtatcgcctatcctgcttttgctgaaaatttcatggagcaggttttctttttctttgtaattgtcggttttgacggcgaggatgcgttccaatccggcaacgttcgcataaccgttgttttccaaatggcgcattctgccttcaaaattgcttacatccgaaatgccgattttatacacgcccttgatgacggttttnatcagatagacaatgcctgacttttccatatcgatgtttttcaagtgttttcgagccttcagacggcatcggattatttctatgccgtctgaaaccgtttaagtatcaaatattatcgacactctggcctgtnagcgcgcgttggatgttgcggttcatgcgtttggcggcgaaattntcggtgatgctgccgagtttggcgg

SEQ ID NO: 56 - DNA, 662 bp, Neisseria meningitidis
ccgcactgatttcgcaaatcggtacatatatcatcagcgcgggcggcaaacgcctgcgtccgattatgacgattttggcgggtaaggcggtcggttatgatgacgagaaactgtattcgctggcggcgatggtcgagtttatccacacttccaccctcctgcacgacgatgtcgtcgatgaaagcgatttgcgccgtgggcgggcaacggcaaacaatctgttcggcaatgcggcggctgtgttggttggcgactttttatacacgcgcgcctttcaactgatggttgcctcgggcagtatgcgcgttttggaagtgatggcggatgcaaccaacattattgccgagggcgaagtcatgcagctgatgaacatcggcaatacggacattaccgaacgaacaatatatccaagtcatccaatataaaacggcaaaattgtttgaagctgccgctcaagtcggcgcaattttgggcaaggcttcccccgaacacgaacgggcgttgaaagactacggtatgtatgtccgtacggcattccaaattattgacgatgtgctggactattctggcgaaaccgacgaaacggcaaaaactcagcgacgatttggcggaaggaaaacgactttgcctttgatttatctgatgcgtcagggttccgaaca

SEQ ID NO: 57 - DNA, 7959 bp, Neisseria meningitidis
ggctgctgcgaggaagatgtcgggggcgggtttggaatgtgcgacggcggcagggtcggcaatggcgtcgaagaagtgggtcagccccatgcgttccagcaggaacgggccgtttttactggcggacgcaagggcgatttttttgccgtttgccctcaatgcttccagcaggggcaaaatgccgggatacacgtcttcgggtttgactgcctgaatcatctcgacgtagttgtcgtttttacggcgggtcagttcggcgaactcggcttcgctgacggttttgccgccgtgcgcgaggatgcgtttgagcgaatcgtcgcgcgacacgcctttgagctgctcgttaaacttgcggtcaatgctgatgcccagttcttcggcgagctttttccatgcgcggtagtggtattcggcggtgtcggtgatgacgccgtcgaggtcaaataggactgcagtgaaagtcattttgcgccctccttatttttccaacgcaacggtgtggctgccgtcgagcgtgatgtctttgccgtacacctgcaaatcgagcgactcgcctttgagcagagtgaagacgacgttttctttgccgacggcgactttaatcagacggccgcggtagttgatgtggaaggcgtagcctgtccacgcactcggcaggaacggtgcgaagctgagtttgccgccccaggttttcatttgggcgaaaccttggacgatggcgagccacgagccggtcatggaggtgatgtgcaggccgtcttcggtgtcgttgttgtagttgtccaagtccaggcgggcggtgcgctggtacatttccacggctttttcttctttgcccagttcggcggcgagaatagagtgaatacagggcgacagcgagctttcatgcacggtcatcggttcgtagaagtcgaagttgcggcgtttttcgtcgatattgaaacggtcgctgaagaagtagatgccttgcaatacgtccgcctgtttgataaagggcgaacgcaggattttgtcccacgaccatttttggttgagcggcaaatcgtcgggcgaaagcgcggacacggggcggatgtctttgtcgaggaagccgtcgtgctgcacgaatacgccgagttcttcgtcatgcggacggtacatattcgcgctgatgtccgcccatttttccaactcgtcggcacgcacgttcaaatccggacgcgggtatttcgccaaggcttcgcgggtgtagtccaatacccatgcggcgagggtgttggtgtaccagttgttgttgatgttgttttcgtattcgttcggaccggttacgccgtgaatcatgtatttgccgttgcgtttggagaagtggacgcggtccgcccagaagcgggacacttcgaccaaaacttccaagccttctttggcaagatagccctcgtcgccggtgtagttggtgtagttgtagatggcgtaaggaatcgcgccgttgcggtggatttcctcgaaggtgatttcccattcgttgtggcactcgatgcccgtaaacgttaccatcggatagagtgcgcccgccaagccctgttcgcgcgcgttgtgctgcgcctgcggcagttggttgcggcggtattgcagcaggttgcgggtaacttcgggttcggccagtgcgaggtagagcggtacggcgtaggcttcggtgtcccaataggtcgcgccgccgtatttttcgccggtaaagcctttcgggccgatgttcagtcgcgcgtcttcgccgtagtaggtggagaacagttggaacaggttgaagcggatgccctgctgcgcttcgtcgctgccttcgatgaccacgtcggcgatttcccaacggtgcagccagcctgctttgtgcgcgtccagcaaggtttcaaacgcaacgcctgcaattttttccgacaaggcgcggcctgcggctttcactgcttccaagctctgataatcgcggctggtggtaacaatcacgcgtttttcaaaggtttcgggtgtgctgccgacttcggattcaaaagaattggagacctgccagtcggtttggctgccgccgagggctttgaagctgccggcaaaggtttgctcggcgttgacgatgaattgttccacgccgaagggattggcgacggtttgggcggcaatgtaggagagactgtctgaaacgcctttgtccaatacctgccagaatttttcttcgtagttggagtcttcgtttttcacgtcggcatcgatgatggaatcgatgcggacttggtgggttttaccgtcaacggatacggcttcccagcggatgaccgccagctctttttgtgcgacagacaggaatttgcacacattgaaacgcacaccgaatacggtgaacgagcggcgcaacacgccgtgctgcatatcgagttcgacggagaagccagcaacgtcgtttttcgccaagtccacttcctgcccgtcgacaaagattttgactttgctgaaattgaacgcgttgatggctttgccgaaatatttgggatagccgtttttccaccagccgacgcgggttttgtcggggaaccacacgccggcgatgtaggtgcctaagtggctgtcggcggaataggtttcctcaaagctgccgcgcatacccatatagccgttgcccaagctggtcaggctctcttgcagccgtttgtgttctttttccagttttgccgaacgcagcgtccaagggctgatttccatgattcttgtgtacatttatgaagctcctgtttggattgatttgagggaatggtgaaatcttatagtggattaacaaaaatcaggacaaggcgacgaagccgcagacagtacaaatagtacggaaccgattcacttggtgcttcagcaccttagagaatcgttctctttgagctaagccgaggcaacgccgtaccggtttttgttaatccactataaaaaggtcgtctgcaaccggtgttaggaagctcctaagaaagggattcgatgccgtaagcaatcgtcgcctccctggtatcacccttgttcagacgaatattgccgaactcgggccaattcaggctgtcgggcagcgtctgcgcctcggtcgccagcgcgtcgtaaacgcccgcatcgtgccgcgcgaaatcctgcggggcggcggtaaagatgaccaagccattgcggtcgctgtatatgctgatacgacggcggcgtccggcttgcaacacagcggcgggacggcctatatcggacggcacgcggtaagcgtcgtcaaaaccggcccgacccgtttcgcggcgcagggcggcaacggcggcatccagcggcttgggccggctgaaatcaaatacttcgaggtcgtctgaaaccgttgagacgggcagtttttcggcatcggccggcatatgtccgccctgcggaatatgcagaaccgcatcgtgcaggcccgcgtccagccgccagtaaatgtgcagcgtcgggtcgaacaccgtgtcgccgagcgcggtggcgcgatagctaacggtaagccggtcgtcctcgtccaagcggtaggaaatatccaaatccaaatcgttgggataaccgtcggccgactgttgcaggcggctgcgcagcaccaccgaacggccgtctgccgccaccgcgttgaaacgggtaacggccagcccgtgcgaaccgccgtgcagcgcgttcctgccttcgttggcctccacgcggtaagtcctgccgttgatgtcgaacgccgcaccgcggatgcgtccggccacgcgccctatctgtttgttaatctgaaacggattgtccgcataggaagccgcatcatcgaacgacaccacgaggttttcgcgcacgccgtctgccaaaacggaaaattcctgcacaatcccgcccaagtccagcacgcagacacgcgtaccacgccggttggacagcacatagccggttacggcacgcccgtcgatcagaccgaaatcgcgggtagcgggggtatcgctcatcgctcaaaccccgccgtgtgtttctttaatcaggaacacggaaaacgcgcccagcagcaggacgacgccccctaccaagaacatagtggcctgcaagccgcccagcatagggaaaagcacgaaactcaacagcgaagcgacgatttgaggcatacagatagagccgttaaacaagcccaagtaagtgcccatatgcttgcccgacaaggcgttggtcacaatcgtcagcggataagtgataatgcccgcccaagcgatgccgattaaggtataagacaacaccagcgcgtattggttgccgatgaagaaaacggagaaaaagccgagcgcgcccaaagccaaacagccgaaataacccgccttatggtatttattcggcactttcgccaatacaaacgaacaaatcaccgccgcaaccgactgcaccgccgccaaaacgccgtaccagttacccgcctcctgataacctacggaagacgcatcggtggtgtgccagacgttttccgcaatcgcgcctgccgagtaagtccacatatattggaaggcgaaccagcagaagaattgcaccaaagtaaccgtccaaaacgccttaggcgcggttttcaagagttcgatccagttggctttttcctgattcgcggcgacatcgatgccgtggtaacgggcgtaggtttccggatcgtattccttcactttgaaaatcgtgaacgcgctggtaatcaccagcaacgccgcacccacataaaacgccacgaccacggtctgcggcacaacgcctttctcggcggtgttcgccaaaccgatatacgcaaacacaaacggcagaatcgccgccacgaccgcgcccgtatttgctaagaaactttgaatcccgtaggcgtagcctttctgctcctcgttgaccatgtcgccgaccatcatcttaaacggctgcatcgccatatttgacgacacgtctaacagcgcaatcatcagcgcgccgaacgacaaagccgccagcgacgcatagccgaaaccgaagctgcccgagttcggcatcaaaatcatcacaataaccgcaatcagcgtgccataaagcagatacggcagacggcggccgcccaaacgcggcttccaagtgcggtcggagtaatggccgacaatcggctgcaccagcatccccgccagcggcggcaggatgaaaaaccagcccaaattgtgcgggtctgcgcctagcgtttgaaaaatgcggctcatttgcgagctttgcagggtaaaggccgtctgaacgccgagaaagccgaaactgagcatccaaatcgtgctttttgccagcgcgggcaaaccttgttttgctgtttgaggcgtatattccgacataaggtaaatccttttttgatttgaaaagtatagtagattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatatttgctttggaaaatccgaaatggttgccggggcggcgatcccctatcattattatttttttgtctatataatttcaaagggataagcggattttatgaatcctgcccgattttggcaataccggttcgcggataaactggcttaaatcaaattatcggttaaaatggccgtctgaaatttgtttgatgaaaacgagaaaaccatgtcccaacaatacgtctattctatgctgcgcgtgagcaaggttgtgccgccgcagaaaaccatcattaaagatatttccctttctttcttccccggcgcgaaaatcggcctgctcggtttgaacggcgcgggcaagtccaccgtgctgcggattatggcgggcgtggataaggaatttgagggcgaagccgtgccgatgggcggcatcaaaatcggctacctgccgcaagagcctgagcttgatccggaaaaaaccgtgcgcgaggaagtggaaagcggtttgggcgaagtggctgccgcgcagaaacgtttggaagaagtgtatgccgagtacgccaatcctgatgcggattttgacgcgttggcagaagagcagggccgcttggaagcgattattgcggcaggttcgtccacgggcggcggtgcggaacacgaattggaaatcgccgccgacgcgctgcgcctgccggaatgggatgccaaaatcgataatttgtccggcggtgaaaaacgccgcgttgccttgtgcaaactcttgttgagcaagcccgatatgcttttgctggacgagccgaccaaccacttggatgcggaatcggtcgagtggctggagcaatttctcgtgcgcttccccggcacagtcgttgcggtaacgcacgaccgctacttcctcgacaacgccgccgaatggattttggaactcgaccgcggccatggtattccgtggaaaggcaattactcgtcttggctggagcagaaagaaaaacgcttggaaaacgaggcaaaatccgaagccgcgcgcgtgaaggcgatgaagcaggaattggaatgggtgcgccaaaatgccaaaggccgccaagccaagtccaaagcgcgtttggctcgttttgaagaaatgagcaactacgaataccaaaaacgcaatgaaacgcaggaaatctttattcccgttgccgagcgtttgggtaacgaagtgattgaatttgtaaatgtttccaaatcgttcggcgataaagtgctgattgacgatttgagcttcaaagtgcctgcgggcgcgattgtcggcatcatcggcccgaacggcgcgggtaaatctacgctgttcaaaatgatttcgggcaaagagcagcctgattccggcgaggtgaaaatcggacaaaccgtgaaaatgagcttgattgaccaaagccgcgaaggtttgcaaaacgacaaaaccgtgttcgacaacattgccgaaggccgcgacattttgcaggttggtcagtttgaaattcccgcccgccaatatttggggcgtttcaacttcaaaggcagcgaccaaagcaaaattgcaggtcaattgtctggcggcgaacgcggtcgtctgcacttggcaaaaaccttgttgagcggcggcaatgtattgctgctggatgaaccgtctaacgaccttgacgtggaaaccctgcgcgcgttggaagacgcattgttggaatttgccggcagcgtgatggtgatttcgcacgaccgttggttcctcgaccgcatcgccacgcatatcttggcgtgtgaaggcgactctaaatgggtgttcttcgacggcaactatcaggaatacgaagccgacaagaaacgccgtttgggcgaagaaggcgcgaaaccgaaacgcatcaaatacaaaccggtaacgcgttaacctccgaaacaatgccgtctgaaaggctttcaggcggcatttttacaaggcagcaccgtttaaaacagcattgcaatcctcaagacaatcaaagtcatcaccgcagccgccatatcgtccgccataatgcccaaaccgccgtgcagattcttgtcaaaccaaccgacgggagacggtttgagcgcgtcaaacagacggaataggacaaatgccgccagccaccacgtccacctgaacggcacaaacgccagcacaaacagcatggcgacaatctcgtcccaaacaatcccaccgtggtcgctgacacccgtttcacgttccgcataagcgcaaatgcgtatgccccacataaacagcacgatacacaaaaaagccagcagtagcccgtctatgccgagcaaaatcagcacaaacgccaaaggcagtgccgccaaagtgccgaatgtgcccggcgcgaacggagccagcccgctgccgaaaccgaaagccaaaaaacacaacggccgtttcaacagccacgcaaagtcaggtttaaaatcagccaaaatgatcgaatc

SEQ ID NO: 58 - DNA, 567 bp, Neisseria meningitidis
  misc_feature (20)..(20): N is any nucleotide
  misc_feature (437)..(437): N is any nucleotide
  misc_feature (508)..(508): N is any nucleotide
  misc_feature (545)..(545): N is any nucleotide
cggtcttggcgcacgcgcgntctttcggcatacatcacgcccaaattgttttgggcttgggctaccccctgcgctgccgcctgccgaaaccatctgaccgcttcgacatcgtcttggcgcactccacgtccttcggcatatatcacgcccaaattgtattgggcttggacaaccccctgcgctgccgcctgccgataccatctgaccgcttcggtatcatcttggcgcacgcgcgcccgttggcatacatccagcccaaattgtattgggcttgggctaacccctgttccgccggctgccgataccatctgaccgcttcagcatcatcccggcgcacgcgcgtcctttgtaatacattgcgcccaaattgtattgggctgctgcatttccctgtgctgccgctgcaagttttcccgaaaatccgatacgtcatccgnccacaccggtcggttcaagcccaaggcaatcagggcggcggcaagcatttgactgtctgtttcatggtttnacttctgttttagtataaggcgggtttcagccaccgntaacgatagggctgggcggatt

SEQ ID NO: 59 - DNA, 8093 bp, Neisseria meningitidis
gtaccctgctcaagcagtacaatcccgagtattcgggcatttcatcattttttaagacaggaagggactgattgtgaacaagtctgaattgatcgaagcgattgctcaagaagccgasatttccaaagccgccgcacaaaaagctttggatgccactaccaatgcagtaaccaccgccctgaaacaaggcgacaccgttactttggtcggtttcggtactttctacgtgggcgaacgtgcggaacgccaaggccgcaaccccaaaaccggcgagcctctgaccattgccgccgccaaaacgcctaaattccgcgccggcaaagctttgaaagacgcactgtaagccgttttttatgaaaaaagccgattctttaaagaatcggcttttttatcggtccacattattctgatttcaaatcggcaacacactgcttgtcacgtgcttcaaaggcatttgcgccgccgagcaggtcaagctgttcttgtgcgccgagtttgccgaaggatctaatctgtttctcgctcaatctgtccaaaggctgctcccacatacatttgcagtagtcgacggcgaggcgggtattgtttgaatctaaaccgcgggcccgcaaatcgttttgccatttttcggcaaacggaatattcttcacgcaagactcgacaattttctgttttgcctgcggtttggacatcgcgcattgggagagcagggcggttaaagcgagcaacgccaaaatgacccacgcccaaatgcggatggtgcggattttggcttttgcttttttgcgcgcggcaacctgctctttcgtcagcatttcgtgtttcggctcagtcatgcaggctttccatgcggatcatggtaatcggtttttccacgcaatccagtgcttcgatggctgcgattgccgacttgatgtgtttttcgaccgtgctgtgggtcagaatcacgatttcggcagtggtctgatcaatcacgcctttttgaatcagtgcttcgatggacacgttttcttgtgccaacagcgcggcgatttgccccagcgtgcccggttcgtctttggcttggacgcgcaggtagtagctgctggtaatttcgtccataggcaggatggtttgcgcttggacttgcgcgggttggaacgccagatgcggtacgcggtgggcggtatcggcttcaaccaggcgggcgatgtcgatgatatcggcaaccacggcggaagcggtcggcaatgcgcccgcgcccgcgccgtaatataaggtttcgccaaccatatcggcgttgacgcgcacggcgttcatcacgccgttgacgtttgccaagaggcggctttcgggaatcagggtagggtggacgcgcagctcgatgcctttgccggttttgcgggtaatgcccaacagtttgatgcgatagccaagttcttcggcgtatttgatgtcgcggctgtcgagtttgctgatgccttcgaggtagcaggcggaaaagttcatcggcgtgccgaatgccagtgcgctcatgatggtgattttatggcccgcatcgttgccttcgatgtcgaaggtcggatcggcttcggcataacccaatgcctgcgcttctttcagtacatcggcaaacgcgctgcctttttcgcgcatttcggagaggatgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgcggacgggcaggtttgtcgggctttttcttcactcaaatcgcacacggcagaaatacggatttcgcgccccaagcgacgggaaatttcctccgcgttgtcccgcaacacggcagccgtaccgccgccgaccgtacccaaacctaaaagaccgatgtttactggcttcattgtgtctccttgtaagccgactgaaatgtaaatattgaaagacgaaaatatccgctgccgatataattgtgccgcactttgaatcaaatgccgtctgaaatcggcaggcgggtcagatgaaatctgccaatcctacatgaatttgtctgattttgcatccctttcggtgtagatgatgcggcaacggggtaaaaaaatgttgtttgaagaaaatccgatagacggacagtttgcggaatatgaatgcggtgcgggcggaatccggctggcggggcaaagtttccataaacccgtgcttgtacataaggattcggtctgcctgtcgcaatgccgaaccttgtccgatctgactccggaaaacctgttgtccgacgtcaaacctgttgactatccggaaatattgattatcgggacgggcgcggctcaggagtttatccatcccaaaatcatggcggatttttcccgaatcggaatcagcgtggaatgcatgaataccgattcggcattcaggacattggttttcctgcactcggaagggcgcagggcttgggcttggcttcagccgtaaatttcccgtttcagacggcatcggcactgactttcaggtaaaatacgggcttttcccgcccgacgatgtttccgttatgattgaaatcaaaaacctcaccctgcaacgcggtttgaaagtcctgctcgacaaagccaacgctaccgtcaatcccggtcagcgcgtcggtttgatcggcaaaaacggaacgggcaaatcgagcctgtttgccttaatcaagggtgaaatcactcaggacggcggcgatgtctcgattccgaaaaactggcggctcgcttccgtttcccaagaaacgcccgatttggatatttccgctttggattacgttttgcagggcgatgccgagttgcaggcttttcagacggcattgaggcaggcagaagcgcaaaatgacggcatgaagcaggcggaatatcatgctaaattggaagaaatcgacgcttataccgcgccggcgcgtgcggcaaaattgttgaacgggctgggtttttcgcaagaagaacacagccgccccgtcaaatccttttccggcggctggcgtatgcgcctgaatcttgcgcaagccctgatttgccgcgccgatttgctcttgcttgacgaaccgaccaaccacttggatttggaaaccgtcttgtggctggaaaaccaccttgcttctttaccctgcacgcaaatcatcatttcccatgaccgcgattttctcaacgcggaaactacccaaaccattgaattatcgcagcaaaaactcacgcaatacggcggcaattacgatttttaccaaaacgaacgtgcgcagcgtctcgcgcaacaacaagctgcctatgtcaaacagcaggcgcaaatcaaacatttgcaatcctttatcgaccgcttcaaagccaaagccaccaaagccgttcaagcgcaaagccgcatgaaggctttggcgaagctcgaacgcatcgctcccgcgcatctggacagcgagttttcctttgagttttaccatcccgaccatctgcccaatcctttgttaaagctagaacacgcagatttgggttacgaaggcaaaactgttttgcacgacattaccctgtcgctggaaagcggcgcgcgctatggtttattgggtgtcaacggcagcggtaaatctacctttatcaaagctttggcaggcacaatcgatttactctccggcagcatcgtccgttccgaaaaactcaatatcggctattttgcccaacaccaactcgataccatccgctccgaccaaaaccctgtttggcatattcagcagctttctcccgaagtacgcgaacaagaaatccgaaatttcctcggaggcttcaattttgtcggcgatatggcgttgcagaaaaccgaaccattttccggcggagaaaaagcccgactcgctcttgccatgattatctggcaaaagccgaacctgctgctgcttgacgagccgaccaaccatttggatttggatatgcgccacgccttgacgctcgctctgcaaagtttccaaggcgccttaatcgtcgtatcgcacgatcgcagcctgcttgaagccacgaccgacagcttcctcctgatcgataaaggccgtctgaagaacttcgacggcgatttgaacgactaccgccaatggcgtttggcacaggaaaacgccgccgtcgcgcccgcagcatccgcacaaagccaaagccgcaaagacaccaagcgcatcgaagcgcaaatccgtcaggaaaaagcccgacgcggcaagccgatacagcagaaaatagaccgtgccgaaaaagaaatggcgcagctttccgaaattcagacggcatgtgaagcatttttagcacaagaagaagcttacttcgaggaaaacaaagaaaaattgcaggacaccttatccgagctggcaaaagtcaaaacacaacttgcccaaatcgaagaggtttggctggcttgccaagaagaattggaacagattgaaactgaaatcgagaaacagtttgccgagcgataaagaagcgcgggcagggtgcttatctttgcctgccaataacggtataattcgggcgttatcaccgccttttaccggtataaacatcagactttttgccgccttgggtctcctgtccctttccggcgcggcggcgcaagcctccgtataccattgcaactcaaatggcaaaagcgtatatacatcagccccagcaggattgtgcgccgatgcggatttacctaaaatcagcagccatcagggaggcggataccgcctgaaaattaaaaaactcagttaagaagccaaaatacacatagaaagtaaaaagaaaaacaaaaaacctgccgggaaaaagaacaagcaggctgccaaagccccgaaagaaaatcaaaagcaaccaaccgaaaagaaaagcccgtaaaacgccaagaaagcattacaaaaaataccaaaaaatcaaatgattatccgaaaatcaagcacattatgaaatcaaaactcctcttaatcctaatcaacttttccctgatttcaagcccattgggtgcgaatgcggccaaaatctacacctgcacaatcaacggagaaaccgtttacaccaccaagccgtccaaaagctgccactcaaccgatttgcccccaatcggcaactacagcagcgaacgctatatcccgccccaaacgcccgaaccggtatcatcaccgtcaaacggcggacaggttgtcaaatataaagccccggtcaaaacagtatccaagccggcaaaatccaatacgccgccgccgcaacaagcaccctcaaacaacagcagacgctccattctcgaaacagaattgagcaacgaacgcaaagcattggttgaagcccaaaaaatgttatcacaagcacgtctggcaaagggcggcaacatcaaccatcaagaaataaatgcattacaaagcaatgtattggacaggcagcaaaatattcaagccctgcaaagggaactggggcgtatgtaaagccgtgttttcaaatcgaccgttccaaggatttgacagaagaaatgatgaaaaagcagcggcatatcctgtgtgtcggctgcctgtatattatattgaaggtcaacgtatttcccaataccggctggatggaagcgtcgaaagggatgcagggcatgtcgttcagtaccttcggatacgcggatgctccgggctatacattcagccgcattggccatactttaattttcctacttggaaagaccacagggacacgtacaactgtttccgatagttcgcataatgtatattatgttaaattatatatttgtgcaaataactccaaggcattaagctgttgtttgatgctttgccagtttgggagaaagttgtccatatgcgccataaaacgggcgttgcgatggcgttcgagcaaatgggtcagttcgtggacgacgacgtattaagcggtgcggacacccgaaccgcgatcccctaaatgtcttggtgggaatttaggggattttggggaattttgcaaaggtctcaaaacccgctcgccttatagcctgtctgtgctgccatttcagcctccaaaacccatattttcaaggtgggcattgactttgctttgccacttttccacttctcgggcaagctcggccatcgggctgcggtagcggtcttccagcgtgttcaagcggctgataagctgctgaatactgttttccaagcgattttcgattcggctttgtaaatcggcaagccatttgtcttgaacggcaagctgcttgatttcggcttcggaaagtcggccaaattgtttgaatacggcaaggttcagggcttcgatttgggttttgactgcgtctttcgcggctttttcctgcgtcatcagtgtttgggtggtttgtaaaacagcccgttcgccttcttctatgccgctttcttccaatgcggttttcagaagtttggcggaaagtttgccttttgcatccaatacgtcgttcagcgcaccctcttcgccgccgtgttcttctatgtggttttccaattcttggcttaggcgttccagctcgctttgtttttcttccagcttggcgatgccgtctgaaaagtagcggcgggcaaccagctcgggggcgatgacttcgctgcggtattttttgctgatgcgcttggttttggctttgccttttttgtcggtttcggtttcctcaaagacgacggtcaggttcgcggcttcatcgctttctttggtgatttcggccaggtttttaaccgccttccagccatcttgggcgatgagataaacatcgtcttgcagggtttccgcccagtagtccgtcaggatttggtagaaatcgtattcttcaatcaggctgccgggtttgaacgcgtccagcaggctttcgctccatttccggataagcctgcccggttggatggcggcaaggtcgttttgagtgtgccacgcggcaaactttgctaggtgtccggctttgaaggcggcgtaatcggggtgcgccaatatatgggctttgatttggctgctttcgattttatagtggattaaatttggggctgtactagattagccctaaattccacaccaatcccgcaggattttaagctgttgagagtgggaaagatttgcaatcgattccgttgtatagtggtaaagtggccatcgtgttcggcaaacaactcgtttttcatacggcctaaaacttgccaataggcttccaatgcgtccatatcgtgcgcaggtatgccgccataaagatagataggcggcgagattttgcaggtcttcgacttctccgctgtcgatatagcgaggcagattaaggttgtaatcttgtgctgcgatttcgcttaaatgcaccatacggctgtaacgaggtttgtgaaagtgtcgatgattttgtgaatgtcttgctcacgcagacggtttttgttgccgtctttaatgaagccgcgcgatgcgtcaatcataaacacgctgccgccgctgataacttggtttgttccctcttcggcaaattgggcggtttgggcgtgttctttgtcgatgacgatgatgcaggcaggaatgcccgtgccgtaaaacaggttggcaggcagcccgataatgcctttaataaggtcaaggttaagcaattccgtgcgaatacgcgcttcggcattgccgcgaaacagcacaccgtgcggaagaataatcgcacctttgccgcttggtttcaggcttttgagcagatgcagcaaaaaggcgtaatcgccgtttttttcgggcgggataaggcggattggcaacggcaaaatcgaaggtcttaagcccgtcgttttcatcacggaaagacgaatcggacaagtgttcccgtgttgatttcggcggtttcgttgttgtgcaaaatcatattcatacgg

SEQ ID NO: 60 - DNA, 532 bp, Neisseria meningitidis
  misc_feature (27)..(27): N is any nucleotide
  misc_feature (56)..(56): N is any nucleotide
  misc_feature (143)..(143): N is any nucleotide
ctgagcgcggaaatggctttcagacgncatttgcgctcaataataatatcccgcgntcagaatacacggtttggatgcgccggttgctttgtgcggactaccgggaatgcgattaatccaacacgccgccaaccacgcaaatncggcggcttccacccattgcggatcgaggttcaggtcggcggtgctgtgcagggaaacgcgtgtgccgaaacattctgccaaatccgccattaaaacaggattgcggatgccgccgtcgcaaatgtacatttgacgggcatctgccgctgcgtgtgagacggcgtcgcaaacggtttgcgcggtaaaacgggaaagcgtccgcaatacgtcgtatcggttttcgccgccgtcaaggtaggtttcgagccaatttatggcaaacagttcgcgccccgtgcttttagggtggcgttgtgcgaaatacgggtgggcgagcagcctgtcgagcagttgcggcaatatgttgccttgtgccgactttgcaccgtttttgtcgtaaggaagctgc

SEQ ID NO: 61 - DNA, 33303 bp, Neisseria meningitidis
cccgtatcggatgatttttgggggaatggttgcgctcatgttttttgataacgggaaacccgtttttctctgtagaaaggtaagcgtttactttaagtaattgactgttgcgggtcaagtctaattttaaaaaataatccggtttttcttacaaactgcccccataacgcttactgtaccttaatctgatggttttcgataataattatcattacaatgcaatgccggttcgtttgcttgtgaacattcaagatgccgactctgacggcattcagacagcatctgaaaacaataacggcacaaggatggggtacaatcgccctatggaaaaaaacaccctatccgcccgcgcaccatccccttggctgccgcttctgctggcaattgccatttttatgcagatgttggatgcgaccattttaaataccgcactgcctgaaattgccgccgacctgaatgagtcgcctctggatatgcaactggcagttatttcctacacgctgacggttgccctgctgattcctttgagcggttatttggcggacaggttcggaacgaaaaaagtctttttcggttcgattgccgtttttatgctcggatcggcattgtgcgccgcatcgggttcgctgtttgaattgacgctttcccgtgtcgttcagggcatcggcggttcgatgctggttccgataccgcgtctgaccatcttgcgtgtgtacgacaagtccaagctgctcaatgccatcaattatgcggttatgcccgcattaatcgggccggttttagggcctttggcgggcggttatttggtcgaatacgcttcgtggcactggattttcctgctcaacctgcccatcggtctgctgggtttcatattgggacgcaacatcatgcccgatattaaaggcagtaatatctctttagacttcaaaggttatctgattttttctgccgccgcgtgcctcttgttactttcggcagaaagcctgtcgcacgcgctgcctccgtattttgcactgttgccgctgtgcggcggactgctgtttgcacgccgttatttccgacatatgaaaaccgcgtccaaaccgatttattccgccgacctgtttctgatacgcactttccgtctgggactggcgggcaatctgttcagccgtctcggcatcagctcgattccttttctgatgcccctgatgtttcaaatcgctttcggcttcggcgcaagcctgtcgggttggctggtcgcacccgtcgccctgtcttcgctgctggtcaaaccgctgattgcaccgctcatgaaacgtttcggctaccgcacggtactgctttggaacaccaagctgcttgccgccttcatcatgctgctcgccctgcctgacggaaactcgccgctgtggatttgggttttcctctcgctggcgatcggcgcgtgcaactccctacagttttctgccatgaacacactgaccctcgccgatttgcgcccgcaacaaacaggcagcggcaacagcctgatggcggtcaaccaacagcttgccatcagcatgggcattgttgccggcgcattaatccttaaaaactggacatttctgataccggcttcttcaggtctgcattccgccttccgtatgaccctgctcagcatcggcggcatcacccttgcatcatcgctggttttcaaacggctgcacgtttcagacggcaccaacctgacacggaacacaccgtcctgaagcggtccacacgcaaaacttttacccgtttcaacgtttggattatgataccgcacttccatgcgcgccaaccccaaaacacaggcaatgccgtctgaaaccatatccctgatgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggcaggctgctgttcaacctcgtgtaccttgccgcagaacgcggtgtgcgcgtacgcctgctgttggacgacaacaacacgcgcggattggacgacctcctgcttgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgatttggacatcctcgccaccggcagcgtcgtcggcgaagtatcgcacgacttcgaccgctactgggcaagccattccgcccacaacgccacgcgcatcatccgcagcggcgacatcggcaagggtcttcaagcactcggatacaacgacgaaacgtccagacacgcgctcctgcgctaccgcgaaaccgtcgaacagtcgcccctctaccaaaaaatacagacaggatgcatcgactggcagagcgtccgaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgttcccacaaaatccggcacagacgcactggcaaaactggtgcaggacggcatagacgttaccgttctgaccaactcgctgcaggcgaccgacgttgccgccgtccattccggctatgtcaaataccgaaaaccgctgctcaaagccggcatcaaactctacgagctgcaacccaaccatgccgtccccgccacaaaagacaaaggcctgaccggcagctccgtaaccagcctgcacgccaaaaccttcattgtggacggcaaacgcatcttcatcggttcgttcaacctcgacccccgttccgcgcgtctcaacaccgaaatgggcgttgttatcgaaagccccaaaatcgcagaacagatggagcgcacccttgccgataccacacccgcctacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaggtttattatagaaatatagcggattaacaaaaaccagtacgacgttgcctcgccttagctcaaagagaacgattctctaaggtgctgaagcaccaagtgaatcggtttcgtactgtttgtactgtctgcggcttcgtcgccttgtcctgatttttgttaatccactataccgtctgaaacaccttcagacggatatccgaacccgcaaaggaaaaaccatgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaaaacgccctcaacgtcaagctgccgcgcaccgcccgcgacatggcggcggcaagccgcaaaatccccgacagccgcctcaaggccggcgacctcgtattcttcaacaccggcggcgcacaccgctactcacacgtcggactctacatcggcaacggcgaattcatccatgcccccagcagcggcaaaaccatcaaaaccgaaaaactctccacaccgttttacgccaaaaactacctcggcgcacatactttttttacagaatgagccgcccgccgcgccgcgccggaatcgcggcaaaatgccgccttattccgctgtttcggtcagcgatgagaacacgtcgaaataagtcgggaaggttttgtgggtgcatttcggatcgttgatgacgacgggtacgcccaacagcgaaaccagcgagaaacacatcgccatgcggtggtcgtcgtacgtgtcgatgacggcgtcgggtgtcagcgtttcgggcggggtgatgtgaattgcttcggcttcttcgacgacttttgccccgagtttgcgcaactcgtttgccattgcggcgatgcggtcggtttctttgacgcgccacgaaccgatgttgcgcagcgtgcaggtttgccctgtagcaagcgcgacgatggcgagggtcatggcggcatcggggatatggttcgcatccaaatcaaaggattggacggcacgttccttcgggcgtgaaacttcgacgaagttttcgccccaaaccacgtccgccccgattttttccagctcgcgggcaaaggcgacatcgccctgtatgctgtttgcgccgataccggtaacgcggacgggcgtggcggcaatcaaaccggctgcgaggaagtaggacgcgctggaggcatcgccttcgacgtgcaagtgttcgggcgcgtggtagtgcgcatcggcgggaattttgaagacgcggtagccttcattgataacctgtacgccgaattgcgccatcagttttaaagtaatgtcgatatagggcttggaaatcaattcgccgaccatacggatttcaaacgcctgcccggtcagcggcaacgccattaaaagggcggtcagaaactggctggacacattgcctttaatcggaatcacgcgctcgccgttgtcttggcgttcgccgatatgaagcggcggatagtgttccttgccgagatattcgacatcggccccggcaatccgcaacgcatcgaccaaatcgccgataggacgttcgtgcatacgaggcacgccgtgcagatgataatcgccgcccaaaacggccagagcggcggttaacgggcggaacgccgtgcccgcgttgcccaaaaacaaatcggcagtgcggttggggaagcgtccgcctgtgccgtgcactttcagacggtcttcggcaagatattcgatttgaacgccgagtttatcgagtgcttcgagcatacggtcggtatcgtcggatttgagcagggaatggatttcgcaagcattgtcggacaaggcggcaagcagcagggtgcggttgctgatgcttttggagccgggcagggcgacggtggaaggtttgagacgggcgacggggaggcggacggattcggtcatggcaaaacgtcaatattattaaagataaaaacagcctgcattatactggtgcaaatgctgtatgaaaaatctcaggcttggcattttcggttttaaagtccgtaaatgtggttttttatgccgaaaattgattatttttaaattttttgtttctaaaatttctttgtcggcatattttcagcttttgttgcggacatggcgcgtttgccggcggcgcggcacgattgccaatttcatagaatttggtagaatagccgctgttcaacgacagacaagccgccgattttccgggcggcttgtatttttattttaatatccggacgcacaaaacaagacggtacgcggtatgcttgctgccgcaaaccggtgtgccggaatatggagaaaaaagaccgatgcaaaaaatccccctgaccgtacgcggtgcggaattgctgaaacaggaattgcagcagctcaaaagcgtggcgcgtcccgaagtgatcgaagcgattgccgaagcccgttcgcacggcgatttgtccgaaaacgccgaatacgaagccgccaaagaacgccaaggctttatcgagggccgcatttccgagctggaacacaaactttccgttgcccacatcatcaatccgaccgaaatccacgccgaaggcaaaatcgtgttcggtacgacggttacgctggaagatttggaaacggaagaacacgttatctatcaaattgtcggcgaagacgaagccgacatcaaacagggcaaaatctatgtcggctcacccatcgcccgcgccttaatcggcaaggaagagggggatacggcggaagtccaagccccgggcggcgtgcgcgaatacgacattatcgaagtccgatatatttgattcggcttgatttcgatacacccgacacacgcaggaaattatagtggattaataaaaatcaggacaaggcgacgaagccgaagacagtacagatagtacgaaaccgattcacttggtgcttcagcaccttagagaatcgttctctttgagctaaggcgagacaaccccgtactggtttttgttcatccgctataacagcaaccctgtcgccgtcattcccgcaaaagcgggaatctaggacgcagggttaagaaaacctgcatcccgtcattccctcaaaaacagaaaaccaaaatcagaaacctaaaattcgtcattcccgcgcaggcgggaatccagtccgttcaatttcggtcatttccgataaattcctgctgcttttcatttctagattcccactttcgtgggaatgacggcggaagggttttggttttttccgataaattcttgaggcattgaaattccagattcccgtctgcgcgggaatgacgattcataagtttcccgaaattccaacataaccgaaacctgacagtaaccgtagcaactgaaccgtcattcccaccacttttcgtcattcccgcgaaagcgggaatccagaatctcggactttcagataatctttgaatattgctgttgttctaaggtctggattcccgcctgcgcgggaatgacgaatccatccgcacggaaacctgcaccacgtcattcccacgaacccacatcccgtcattcccgcaaaagcgggaatctaggacgcagggttaagaaaacctacatcccgtcattccctcaaaaacagaaaaccaaaatcagaaacctaaaatcccgtcattcccgcaaaagcgggaatccagtccgttcagtttcggtcatttccgataaattcctgttgcttttcatttctagattcccactttcgtgggaatgacggcggaagggttttggttttttccgataaattcttgaggcattgaaattccagattcccgcctgcgcgggaatgacgattcataagtttcccgaaattccaacataaccgaaacctgacagtaaccgtagcaactgaaccgtcattcccaccacttttcgtcattcccgcgaaagcgggaatctagaatctcggactttcagataatctttgaatattgctgttgttctaaggtctagattcccgcctgcgcgggaatgacgaatccatccgcacggaaacctgcaccacgtcattcccacgaacccacatcccgtcattaccacgaaagtgggaatctaggacgcagggttaagaaaacctacatcccgtcattcctcaaaaacagaaaaccaaaatcagaaacctaaaatcccgtcattcccgcgcaggcgggaatccagtccgttcagtttcggtcgtttccgataaattcctgctgcttttcatttctagattcccactttcgtgggaatgacggcggaagggttttggttttttccgataaattcttgaggcattgaaattctagattcccgcctgcgcgggaatgacgaatccatccgtacggaaacctgcaccacgtcattcctaagaacctacatcccgtcattccctcaaaaacagaaaaccaaaatcagaaacctaaaatcccgtcattcccgcgcaggcgggaatccagtccgttcagtttcggtcatttccgataaattcctgctgcttttcatttctagattcccactttcgtgggaatgacggcggaagggttttggttttttccgataaattcttgaggcattgaaattctagattcccgcctgcgcgggaatgacggctgtagatgcccgatggtctttatagcggattaacaaaaatcaggacaaggcgacgaagccgcagacagtacagatagtacggaaccgattcacttggtgcttcagcaccttagagaatcgttctctttgagctaaggcgaggcaacgccgtacttgtttttgttaatccactataaagtgccgcgtgtgtttttttatggcgttttaaaaagccgagactgcatccgggcagcagcgcatcggctcgcacgaggtctgcgcttgaattgtgttgtagaaacacaacgtttttgaaaaaataagctattgttttatatcaaaatataatcatttttaaaataaaggttgcggcatttatcagatatttgttctgaaaaatggttttttgcgggggggggggtataattgaagacgtatcgggtgtttgcccgatgtttttaggtttttatcaaatttacaaaaggaagccgatatgcgaaaaaaacttaccgccctcgtattgtccgcactgccgcttgcggccgttgccgatgtcagcctatacggcgaaatcaaagccggcgtggaaggcaggaactaccagctgcaattgactgaagcacaagccgctaacggtggagcgagcggtcaggtaaaagttactaaagttactaaggccaaaagccgcatcaggacgaaaatcagtgatttcggctcgtttatcggctttaaggggagtgaggatttgggcgacgggctgaaggctgtttggcagcttgagcaagacgtatccgttgccggcggcggcgcgacccagtggggcaacagggaatcctttatcggcttggcaggcgaattcggtacgctgcgcgccggtcgcgttgcgaatcagtttgacgatgccagccaagccattgatccttgggacagcaataatgatgtggcttcgcaattgggtattttcaaacgccacgacgacatgccggtttccgtacgctacgattcccccgaattttccggtttcagcggcagcgttcaattcgttccgatccaaaacagcaagtccgcctatacgccggcttattatactaagaatacaaacaataatcttactctcgttccggctgttgtcggcaagcccggatcggatgtgtattatgccggtctgaattacaaaaatggcggttttgccgggaactatgcctttaaatatgcgagacacgccaatgtcggacgtaatgcttttgagttgttcttgatcggcagcgggagtgatcaagccaaaggtaccgatcccttgaaaaaccatcaggtacaccgtctgacgggcggctatgaggaaggcggcttgaatctcgccttggcggctcagttggatttgtctgaaaatggcgacaaaaccaaaaacagtacgaccgaaattgccgccactgcttcctaccgcttcggtaatgcagttccacgcatcagctatgcccatggtttcgactttatcgaacgcggtaaaaaaggcgaaaataccagctacgatcaaatcatcgccggcgttgattatgatttttccaaacgcacttccgccatcgtgtctggcgcttggctgaaacgcaataccggcatcggcaactacactcaaattaatgccgcctccgtcggtttgcgccacaaattctaaatatcggggcggtgaagcggatagctttgtttttgacggctcgccttcattctttgattgcaatctgactgccaatctgcttcagccccaaacaaaaatccggatacggaagaaaaacggcaataaagacagcaaataccgtctgaaagattttcagacggtatttcgcatttttggcttggtttgcacatatagtgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcgaattgtcattcccacgcaggcgggaatctagtctgttcggtttcagttatttccgataaattcctgctgctttttatttctagattcccactttcgtgggaatgacgaaaagtggcgggaatgacggttcgggcattccttaaatcacccgtgtatcgctgtaaatcttagagatggcggaatatagcggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatttgcttgcggcaagatgaaaacggtgcgggatgttttgggaaaccaatgccgtctgaagggctttcagacggcattttttgcgccgtgctgtttaacgcgccagcggttcggtgcgtttgatcagccacgcttttgccgcgccttcggtcagcggctcgaggcggcggcggacttcggcgtggtagcggttgacccagtcgatttcgccgtcggtcatgagggcggtgtccatcaggcgggtgtcgatggggcagagggtcagggtttcaaaacagaggaagctgccgaattcggtttcttgaggggcggcgacggcttggttggcggcaaggttttcaatgcggatgccccattttcccgggcggtagagtccgggttcgatggaggtaaccatgccttttttcatggcggtttcgggcgtggcgggggcggcgaaggcgatgcgctgcgggccttcgtggacgttgaggaaatagcctacgccgtgtccggtgccgtggccgtagtcgcattgcgcctgccacaggggtttgcggcaaatcgcatcaatcagcggcsasgggatgttttcggggaacacggcttcggcaagcgcgatatgggctttgagaacgagggtgttgtcgcttttttgttcggcactcggcgtgccgacggggacgacgcgggtgatgtcggtcgtgccgcctttgtattgcgcgccggagtcgatgagcaaaagcccgttgccgctgatggtgctgtggctttcgggtgtcgcgctgtaatgcggcagtgcgccgttggcgttgaagcctgcgatggtgtcgaaactcaatgaaatgaagcctgggcgcacgctgcggtggcgataaagcatggtgtccacgtcgatttcggtcaggctgccgccgttgccgatgatgtcttcaaactcggcgaagaaaccgcacaacgccgcgccgtcgtgttccatcgcttcgcggatgcgggcgatgtcggcttcggatttgcaggatttgaacagcgtggatgggttgattccctcgataaggcgcacgctttcgggcaggcgcacaagcgtgctgacggcggttttgttcggctcgatgagcagcacgccgccgatttgcgcgagtttgtcggcaacttgggcgtaaggttcgaccgcgatgccggcggtttgcagcgcggcggcggcttcggcgttcagacggcatcggtcggtaaacaggacggcgttgtctttgccaatcagcaggaaggacacgaaaacgggattgaaaggcacgtcgctgccgcgcaggttggtcagccaggcgatgtcgtcaagcgaggaaaccaagtggtaatccgcgcctttttccgccatcacggcgcgcacgcgggcgagtttttcggcggcggtttcagaaacatagtcggggtcgtggatgaacaccgtttcggcggggagggcggggcggtttgtccacacttgattcagtaaattatccgggtgttcgatgcggatgtttttggcggcgagtgattgcgccaaagtgcgtttgccggtgagcgagaccatatcggaagggatgccgacggcggcgttttcgggcaggcttgccgcgagccattcgttgtacggcggcacttgcccgcttttttgcagcacaatgccgctgcccgcaagctgtttggcggcttgttcccaatagcggctgtccacccacacgcccgcttcatcggtggtcaggacaaacgtgccgaccgagccggtaaagcccgataattcgcggcgcgcctgccaatgctcgggcaggtattcggacaggtgggggtcggcggaagggatgacgagtgcatccaagccttgcgccttcatggcttcgcgtaatgcggacagataattcgatacggtattcataacagttcctccaatcgggttttgcggcttcagatggcatggacggaaatctgaaatgccgtctgaaaaacataaccatcttatcaaatcgccagcctgctgcaaaacggacgggctgatcggatggtgcgtgtttgcgcgaaaaaagcgatgtaaggttgtttgttgtaaaattttaggcataaaatgtcgttttatgcctttttttggaagtaatatggaaaatatagtcaagtttgagcatgaagttctaatagtgtgtgttggcaggtatttggattacgttacaatacgtgttttcatcaaaatttccctaccgggcggtatcctgtttttgaagacggtaggatttgggtttgtttgggggcaatcccgcccaaattggagcaatagatagggctgtgtccgaatatgcggctctgtgtgttgaaacacagttaaaaatacggaagactttatgtccgaacaacatatttcgacttggaaaagtaaaatcaacgcattgggtccggggatcatgatggcttcggcggcggtcggcggttcgcacctgattgcctcgacgcaggcgggcgcgctttacggctggcagatcgcgctcatcatcatcctgaccaacctcttcaaatacccgtttttccgcttcagcgcgcattacacgctggacacgggcaagagcctgattgaaggttatgccgagaaaagccgcgtttatttgtgggtattcctgattttgtgcatcctctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgatttcaacgtcggttatatcgccagtgcggttttggctttggttttccttgcactgggcgcgtttgtgcaatacggcaacggcgaagcagtgcagatggcgggcggcaaatatatcgggcaattgatcaatatgtacgccgttaccatcggcggctggtcgcgcccgctggtggcgtttatcgcgtttgcctgtatgtacggcacgacgattaccgtcgtggacggctatgcccgtgccattgccgaacccgtgcgcctgctgcgcggaaaagacaaaacgggcaacgccgaattctttgcctggaatatttgggtggcgggcagcggtttggcggtgattttctggtttgacggcgtaatggcgaatctgctcaaatttgcgatgattgccgcttttgtgtccgcccctgtgtttgcctggctgaattaccgtttggttaaaggtgatgaaaaacacaaactcacatcaggtatgaatgcccttgcattggcaggcttgatttatctgaccggttttaccgttttgttcttattgaatttggcgggaatgttcaaatgataacgatgccgtctgaaaccgcaaaccgctttcagacggcattgtcgcgtttatggaaaaaaatgccgacatcgcgtaaaatatgcgcaaattttgtgattcggtcaggtcgtctgaaacagattgcgcctgatttattttttcggaaaaccttatgagcgaacaaaaccatccgcaaaccgagccgcagttggacgaaaaccaaatcatcgccctgcgccgcgaaaaactgcacaacatccgccaacagcgcaacgcctatcccaacgacttcaaacgcgacagcttcgccgccgatttgcacgcccaatacggcgaaatcggcaaagaagaactcgatccgcaaggcattcccgtcaaagtggccggccgcatgatgctgaagcgtcaaatgggcaaggcgagttttgccaccattcaagacgtgtccgggcaaatccagctttatctgaacaacaaaggcgtgagccaagaagttttggacgacttcaaccattgggatttgggcgacatcgtcggcgcggaaggcactttgttcaaaaccaaccacggcgaactgaccgtacgcgtgtccggcatccgcctgctgtccaaatccctacgcccgctgcccgacaaacacaaaggtttgagcgatcaggaaaccaaataccgccaacgctatgttgatttgattgccaatgaagaatcgcgcaatacctttatcaaacgcagccaaatcatccaatccgtgcgtaattttatggtgggcgagcattatctcgaagtcgaaaccccgatgatgcacccgattcccggcggcgcgacggcaaaacccttcgttacccatcacaatgccttagatattccgctttacctgcgtatcgcgcctgagctgtatttgaaacgcctggttgtcggtggtttggaacgcgtgtttgaaatcaaccgcagcttccgcaacgaaggcatgtccgtgcgccacaaccccgaattcaccatgatcgaattctacgaagccttctccgactacgaacgcatgatgcagatggcggaagacatcatccgcaacgcatcgcgcacggtaaacggcacggcaaacatcacttacaacggcaaagaagtcgatttggaaagcccgtttgaacgcctgaccattctcgaagccatcaaaaaatacaatccgcactacaccgacgagcagttgaacgatgcggaatggctgaaaaaagaaatcgtcaaacacggcgaaagcctgccgccgtccccgggcatcggcagcctgcaactcgcgctgtttgaaggttgcgccgagggcaagctgtggaatccgaccttcatcgtcgattacccggtcgaagtttcaccgttggcgcgcgcttcggataccaaacaaggtctgaccgaacgtttcgaattgttcgttgtcggccgcgaactggcaaacggctattccgagttgaacgaccccgaagaccaagccgaacgcttcaaagcgcaagtggtgcaaaaagacgcgggcgacgacgaagccatgcactacgatgccgactacatccgcgcgatggaattcggtttgccgccgaccggcggttgcggcatcggtatcgaccgcttggtaatgctgctgaccgattcgcaaaccatccgcgatgtgattctgtttccgcagatgcgccccgagtaatcataaaaacagttgaaatggcaatgccgtctgaacccgattggattcagacggcattttgtatggcggtacggatttattcggtttccaactgaccgacccattcggacaaggcagtcaggcgttgttcggatttcgccacgaacgggttttcggtatcccacgcgtagcctgccaaaatcgaagaaagcatacggctgatttccgggctgcggtcgggcgcgtacacgacgttttggaagcggaaatcataccaaccgtccacacatcaggggcggtaatccgaatcaacacgccttcttgcctgtgcggcggacataaaccgttttttgactccagcaccacacctaaaatcgtgctgccttcgggcaggtcaaaggcttcagacggcctgcccgtctgataaatcagcatcctgcccgcaatatcgataacaaggtgcgcgacgaccagccgcttgtcggacagttcaatcagcgcgatgtcttcgtccgcagggcacatacgcggctcgaccaccagcaagtctcccttttcgataaccggcgacatggacgtgtcgggcatggcaacggcaaacgtgtactgcgagggggcgaccaccgaagcaaacaggtcgaaactgcccgtgagtttgcctgtacgggcgaaagccgccgcctgacggtctgacaacaaaggacggggtgtgagcctcatcgacagtgctttgccatcggcatcgctgtggttgtgcgtatgcgtatgatggttgttgatggtcgtatcgccttggacatcgttaaggactatgctgtttgaacctgccacggatttggtcatctcattgtaggcttgcgtcgtgatgcgctcttgcttggtcatacctgttacagcctgtttcagcatttctaacgctatgtgattcttcctaagggtcgctataccggcttttgcagcttgctcattaccacaagaggggcaaccccagctacttcctatgaacatattggagtacctcgaacaggtttggtttccatgtttagggcagttgattacacacggcttggctgtaccctcaaactcgaccaacttaatgccacgatgaccgaaacgttcctcaacctcagcagcagcttcttcaaatgtttttgaccttcttgccatattgacctccggattattgattattttggctatgctttaacgagggattggaatgaggtaaagctgttgccctctccccgcaatagttccattaggcgcggatgaatgaatagtttgtccctgccgatgacgatttcttgcagcacacctatgtctgaaagctctttcaggtacttagaggccgtctgccgtttggctatccctgccgcttctaggttggcaatgcgtgtatatggctgctcaaacagaagatttaccagttcgtgcgtgtagattccttgtgcgtgtgtccgtatgtgttgccgtgtctgctcgaacaggcggcgtatcgcatctattttcgataccgtccaatcggcggtgtcagctacgccgtctaagatgtagattatccagctttcccagtcctgccgttcggttacgcctaaaagcaggcggtaatagtccgccctgttttcgatgatgtagcggctcaaatacaaaataggcaaatccaaaagccctttttcaatcaatagcaggctgttcaatatgcgccccgtccgcccgttgccgtccgtaaacggatggatggcttcaaattggtaatgtgccgccgccatgatgataagcgggtctaaatcgccgctttcgtgaataaaccgctcccaatttgccagcttgccgcgtatggtttcttctccttcgggcggggtatagacaacatttccgctgttgcctccttttagggctgtgccgcctgttttgcggatggccatttcgtaggggtgcttgatggcgttgcagaccatgatggcggtttgtgtgcataaagggcggctcgtcagtgattcatagcctgcaaacagggcggtgcggtattgcagggcttctttcgtggcagggtcttgccgttccgtatccatttgcagggattgaaacagcttgtccgtggtggttacgatgttttcaatttccgaacttgcacgggcttccataacaggaagggtgttaatcagcatggcttgattcggtatcaattctgccgcctgctttaaacgggcaagggatgcacgggcggctatacaacgtttcaggatggttttgctttcaatatcctgttttggcggcaggggtggtaaatcgttatagggaatattgggtttccagttgctcatatttaaaatttcggaaaatttaaagatgtttccagtatatgtttacgccgtgtatatatcaaggatatatgtttaaaaatttggcttttgtaaatatatgggcggtaaaaccgcattattttatgctgttacctattttacaccttgtctgcacacgatttccaaacaacctaaaaagaaacctgccgaaagacaggtttaaagaggtcattttaaatgtgaactaaagcttacaccctcgtagggtatcgtgtatatcagacgtacttaatatacactattaatggattaaatttaaaccagtacggcgttgcctcgccttagctcaaagagaacgattctctaaggtgctgaagcaccaagtgaatcggttccgtactatttgtactgtctgcggctcgccgccttgtcctaatttttgttaatccactatattgtacaggcggcaaatgccgtctgaaactgtttgcggcagaaatttatccggtgcgggcggttgctcccgatgcgtcagtccggtttgaaaaatgccgtctgaaacgggaaatgttcagacggcatttgattttcagggctattttacgccgtaacgcggttggagcagggcgcacgtccggtgttcccggcggcttcggcggctgcgtccggcaatttttccgcaagccgcgcccgcatcgtttgccgcattttccggccgggtgtttttttcgcgttgcgctttggcggattcgtagcggttgcgttgtctcggttcgcgcatttcgggtttttccggttttgcgccgccctgttcccaccattgcggctcgaagccctcgatgcgctcgatgagcagcttgttgccggtcagctctttaatggattcaaacattttctgttcggattcgtccatcagggaaatcgccacgccgtccgcgcccgcgcgccccgtgcgcccgatgcggtggacgtagtcttcgggctgggcgggcatttcgtaattgatgacgaagggcagttcggcaatgtccagcccgcgcgcggcgatgtcggtggcgacgaggacgcgcaggttgccgtctttgaaggcgttgagtgtttcgagccggctttgttgggaacggtcgccgtgtatcgcctgtgcggacaggttgcggcgcaccagttcgcgcgttacgcggtcgacgctttgtttggttttgcagaacacgatgacctggttcatatgcaaatcgacaatcagccgttcgagcaggttgcgcttctgaatggtatcgacggcgatgatgtgctgctcgacgttggcgttggtggtgttttgcgcggcgacttcgacggtttcgggcgcgttcatgaagtcttgcgccagtttgcgtatcggggcggagaaggtggcggaaaagagcagggtttggcgttggcggggcagcatctgcatgattttgcggatgtcgtcgataaaacccatatccagcatacggtcggcttcgtccaaaacgacgatttcgactttgttcaaatggatgtttttctgtttcacgtggtcgagcagccgtccgacggtggcgacgacgatttcgcagccggcacgcaggtcggcggtctgtttgtccatattcataccgccgaacaagacggtgtggcgcagcggcaggtttttgatgtagccctgcacgttttggtcgatttggtcggcaagttcgcgcgtgggggtgaggacgagcatacgcacggggtgcatcgcgggcgaggtgctggcggtggcgtaacgtttgaggcgttccagactgggcagcataaaggcggcggttttgcctgtgccggtttgcgcggcggctagcaaatcatgaccggcgagtgctttgggaatggcggcggcttggatgggcgtcgggttttcgtaaccttgcgcggtcagtgcggaaacgagttccgtacccaaacctaaagaggaaaatggattactcataattgtagtctttctttcagaccttatgtcgtctgaaacgggaaaccgataggacggggaaatatagtggattaacaaaaatcaggacaaggcggcgagccgcagacagtacagatagtacggaaccgattcacttggtgcttcagcaccttagagaatcgttctctttgagctaaggcgaggcaacgccgtactggtttttgttaatccactataaactgcccgcctgtgagtggcggggcagggaatctgtgtgcggattatgccataaaacggtgtccgacccaatcgcgggcgcgtccggagattggaaatcctgcttaaaaaatgtacaatggcgtacttttttgaaacgcggatccattatgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaagccgtcgtccgtgcggcaggcgtacccgttaccctcaaaacccgtttgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaggccgtggttcttccgcgatttgaaacattatgccgaacacggtgttttgccgcctgccttgagtttggcagaatgcgccgccgctattttgaaccacatccgcgccatacacgcgttttacggcgacaccgccggtgtgcgcatcgcacgcaaacacataggctggtacatcgacgaaatgcccgacggcgaacagacacgtcgtgaaatcaaccgcttggacagtgcggcggcgcaatacgacatgcttgcaggttatcttgaaagacttgccgaaaaaaccgacagttgggcgtgcgcctaccgcccaaatgccttctgaacacttgattatcctttgaaagtgcaatcatgccccatacccttcccgatatttcccaatgcatcagacaaaatttagaacaatatttcaaagacctgaacggtaccgaaccttgcggcgtgtacgatatggtattgcatcaggtggaaaaaccgctgctggtgtgcgtgatggagcaatgcggcggcaaccagtccaaagcatccgtgatgctggggctgaaccgcaataccctgcgtaagaagctgattcaacacggtttgttgtgaatatggctgcaagcgtccgtatcttaggcatcgacccgggcagtcgcgtaacgggtttcggtgtcatcgatgtcagggggcgggatcatttttacgtcgcctccggctgcatcaaaacgcctgccgatgcgcctctggcagacaggattgccgtcatcgtccggcacatcggcgaagtcgttaccgtttacaagcctcaacaggcggcagtggaacaggtgttcgtcaacgtcaatccggcatcgacgctgatgctcggtcaggctaggggcgcggcattggcggcattggtcagccataagctgcccgtttcggaatacacggccttgcaggtcaaacaggcggtagtcggcaagggcaaggcggcaaaagaacaggtgcagcatatggtggtgcagatgttgggactttcgggaacgccccagccggatgcggcggacggtcttgccgtcgcgctgacccacgccttacgcaaccacgggcttgccgccaaactcaatccttcggggatgcaggtcaagcgcggcaggtttcaatagtttcagacggcatttgtattttgccgtctgaaaagaaaatgtgtatcgagatgaaatttatattttttgtactgtatgttttgcagtttctgccgtttgcgctgctgcacaagattgccgacctgacgggtttgcttgcctaccttctggtcaaaccgcgccgccgtatcggcgaaatcaatttggcaaaatgtttttccgaatggagtgaggaaaagcgtaaaaccgtgttgaaacagcatttcaaacacatggcgaaactgatgttggaatacggtttatattggtacgcgcctgccggacgtttgaaatcgctggtgcgctaccgcaataagcattatttggacgacgcgctggcggcgggggaaaaagtcatcatcctgtatccgcacttcaccgcgttcgagatggcggtgtacgcgcttaatcaggatatcccgctgatcagtatgtattcccatcaaaaaaacaagatattggacgaacagattttgaaaggccgcaaccgctatcacaacgtcttccttatcgggcgcaccgaagggctgcgcgccctcgtcaaacagttccgcaaaagcagcgcgccgtttctgtatctgcccgatcaggatttcggacgcaacgattcggtttttgtggattttttcggtattcagacggcaacgattaccggattgagccgcattgccgcgcttgcaaatgcaaaagtgatacccgccattcccgtccgcgaggcagacaatacggttacattgcatttctaccctgcttggaaatcctttccgggtgaagacgcgaaagccgacgcgcagcgcatgaaccgttttatcgaagacagggtgcgcgaacatccggaacaatatttttggctgcacaagcgttttaaaacccgtccggaaggcagccccgatttttactgactacgtaaaattacaaaacatatcaggcgtttcgagtcgaaactcctgattgtttttttaaatgcaaaatggcagattatatgaacagatttcatttgataatcgctgctatttaagtatctcaaaaacaatatttttaagacttggtcgggaaattcgaagcaggttttggaagaaataccgcaaacctatgaatatatgcagacaatctagttaatatattaaaattaattttctttaaaaacatagcgttataaataaatatttaatatatgcctttcatgtttactttaatatttgacattttatgcttaaatttaaatataaatcaaaattaaatttatatttattgaaatataaaaaataaaaatccatatatttaatattttcagcaattttataaaattaatgttttgacatttatattgtaaaaaatgcttggcaaagcgtagaaaatggcgtacatttcgctacatggaattacacgacaggcaggaaatgccgtctgaaaggattttccggtcagtcttgcgattggtcggggtttcatcggaaacggtgaaacgaaagtttgccggcgtagagttgagctacgcgggtaaagccgcaggcgaaagcctgtattgtttgtgaagcgtaaatctctgatttgaggtattggggcaatcctgtggggggttgcctctttttttatccgccttttaatgacacaataggtgcatccgttttaaatacaaggtgctgtcatgaccacgattttggctttcgatattgaaaccgtacccgatgtgcagggtatccgaacattgtacgagctgccgtcctcgctgcccgacgatsaagtggtgctgtttgcccagcamaaacgccgtgctcagacgggcggcgattttatgcagcatcatcttcatcaggttgtggcgatttcgtgctgcatgcgttgggggcaggataaagtacatgtcggcaccatcggcgagatggatgacggcgaggaagtggtcattgctaaatttttcgaattgattgaaaaacatacgccgcaactggtcagttggaacggcggcggtttcgatctgcccgtactgcattaccgctccctgatatacggcatcaacgccgcgcgctattgggatatgggcgacggcgatttcggcgacagccgcgatttcaagtggaacaactacatcagccgttatcaccaacgccactgcgatttgatggatttgctcgcgctttaccagccgagggcaaacgtgccgctggacgatatggcgaaactgtgcggttttccgggcaagctgggtatggacggcagcaaggtttgggaggcattccatacgggcaggctgaaggaaatccgcaattattgcgaaaccgacgcggcaaacacttatctgatgtacctgcgtttctgtctggtcagcggcaggctggatgcggacgaatacgaaatggaaatcaaacggatgcggaattacctgtccgcacaagccggggaaaagccgcattgggaagagtttgtccgcgcgtgggaataaagattgaattcaaaccggttgtccggcggcgcgcccgtgccgccgctgcggcttcagacggcatacgcgggatgcgcccgtgccgtctgaagccttttccagtcaaacaaaataacattgaaagaaaaaaatgagcaaaaccgtgcattatctcaaagactatcaaacgcccgcctaccatattctcaaaaccgatttacattttgatattaatgaaccgcaaaccgtcgtgaagtcgcgtttgacggttgagccgcagagggtaggggagccgctggtgttggacggttcggcgaaactcttgtccgtcaaaatcaacggggcggcggcggattatgtgttggaaggagagacgctgacgattgcgggcgtgccgtccgaacgcttcaccgtcgaagtggaaaccgaaatcctgccggcggaaaacaaatcgctgatggggctgtatgcttccggcggcaatttgtttacccagtgcgagccggagggcttccgcaaaatcacattttacatcgaccgtccggatgtgatgtccaagttcaccaccaccatcgtcgccgacaaaaaacgctatcccgttttgctttccaacggcaacaaaatcgacggcggcgagttttcagacggccgccattgggtgaaatgggaagacccgttttccaaaccgagctatctgtttgctttggtcgcgggcgatttggcggtaacggaagactatttcaccaccatgagcggcagaaacgtcaaaatcgagttttacaccaccgaagcggacaagcccaaggtcggctttgccgtggaatcgttgaaaaacgcgatgaaatgggacgaaacgcgcttcggtttggaatacgacttggatattttcatggtcgtcgccgtgggcgatttcaatatgggcgcgatggaaaacaagggtttgaacatctttaacaccaagttcgtccttgccgacagccgcaccgccaccgataccgatttcgaaggcatcgaatccgtggtcggacacgagtatttccacaactggacgggcaaccgcgtaacctgccgcgactggttccagctttcgctgaaggaagggctgaccgtgttccgcgaccaagaattttccggcgaccgcgccagccgcgccgtgcgccgcatcgaaaacatccgcctgctgcgccagcaccagttccccgaagacgcaggcccgaccgcccatccggtgcgccccgccagctatgaggagatgaacaatttctacaccatgaccgtttatgaaaaaggcgcggaagtagtgcggatgtatcacaccctgctcggcgaagagggcttccagaaaggcatgaagctctatttccaacgccacgacggacaggccgttacctgcgacgatttccgcgcggcgatggcggacgcgaacggcatcaatctcgaccagttcgccttgtggtacagccaggcgggcacgcccgttttggaagcggaaggtcgtctgaaaaacaatattttcgagttgaccgtcaaacaaaccgtgccgcccacgcccgatatgacggataaacagccgatgatgattcccgtcaaggtcgggctgctgaaccgcaacggcgaagcggtggcattcgactatcagggcaaacgcgcgaccgaagccgtgttgctgctgaccgaagccgaacagaccttcctgctcgaaggcgtaaccgaagccgtcgttccctcgctgctgcgcgggttcagcgcgccggtgcatctgaactatccgtacagcgacgacgacctgctgctcctgctcgcccatgacagcgacgccttcacgcgctgggaagccgcccaaacgctctaccgccgcgccgtcgccgccaaccttgccacgctttcagacggcgttgagctgccgaaacacgaaaaactgcttgccgccgtcgaaaaagtcatttcagacgacctcttagacaacgccttcaaagccctgcttttgggcgtgccatccgaagccgagctgtgggacggcgcagaaaacatcgacccgctgcgctaccatcaggcgcgcgaagccttgttggatacgcttgccgtccacttcctgccgaaatggcacgaattgaaccgtcaggcggcgaagcaggaaaaccaaagctacgaatacagccccgaagccgccggctggcgcacgctgcgcaacgtctgccgcgcctttgtcctgcgcgccgaccccgcgcacatcgaaaccgttgccgaaaaatacggcgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatattttgccctcgtcggctcaagccgccgcagcgacaccctgcaacaggttcgaaccgccttgcagcatccgaaattcagcctcgaaaaccccaacaaagcccgttcgctcatcggcagcttcagccgcaacgtcccgcatttccacgcagaagacggcagcggctaccgcttcatcgccgacaaagtcatcgaaatcgaccgcttcaacccgcaggtcgccgcccgcttagtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattgaggccgtcaaacagaaaaacaatgccgtctgatatagttacacacacgttttatcatcacttccccatcgttttattacgcaatggcaaaacggccgcaaagtcatattaattatagtggattaacaaaaatcaggacaaggcgacaaagccgcagacagtacagatagtacggtaaggcgaggcaacgctgtactggtttttgtgaatccactatattgctagaagtgcaccgattaaggttaattaaaatacgacccttatcccaatattaagaaaaacagcaatcaaaataaacttgattgctgtttttcagtttaagccatgaatgtgattaggctccttatgcagatggcgttaccaataacggctgctgtacggattgtatattggcatccacatttcctcctgtcgcagcagtattagaaccgaacacagacatagactgtaccaaattattgccagcattaatatacttggcaaaatctggattactgatagctgcatcatcaaagacaaatgtatctacacgatggttttcaccatagaaaaatccggaaatacgtacgttgtcttgttcagaagcgctaagcaccaaatcacttccggaacggataaaatgaacatctgctgctttaaatcctttaaagtgcatagtgtcagagtttttatccacatggtaattatagaccgtatcctgaccgaagccttcgccgaagacataagtatccgaaccgctgccgccctccaagtaatcattgcctgcaccgccgatcagagtgtcgttaccgtcttcgccgttcaaatgatcattgccttcgccaccattcagtgcatcgttaccattatagccgtacagggcgtcgttgccttctcctccatcgagcgtatcattgccattgccactgtagatactgtcgttgcctgcatcaccattcagcaggtcatccccgtcggcaccgtacagatagtcatcgcccaatccgccatttaaggtacttccggattggtaggcatacaatctgtccgaaccgtcggtggattgctgtaccagttctttgacagtggcaacatccagtactttgccgttatcgaaatgaatctcatcgatacggtaagcacctgagccatcgttctggaaataggactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgcatcctgaccgaagcctttgccgaagacataagtatccgaaccgctgccgccctccaagtaatcattgcctgcaccgccgattagagtgtcgttgccatcttcgccgttcaaatgatcattgccttcgccaccattcagtgcatcgttaccattatagccgtacagggcgtcgttgccttctcctccattgagcgtatcattgccattgccactgtagatactgtcgttgcctgcatcaccattcagcaggtcatccccgtcggcaccgtacagatagtcatcgcccaatccgccatttaaggtatttccggattggtaggcatacaatctgtccgaaccgtcggtggattgctgtaccagttctttgacagtggcaacatccagtactttgccgttatcgaaatgaatctcatcgatacggtaagcacctgagccatcgttctggaaataggactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgcatcctgaccgaagcctttgccgaagacataagtatccgaaccgctgccgccctccaagtaatcattgcctgcaccgccgattagagtgtcgttaccgtcttcgccgttcaaatgatcattgccttcgccaccattcagtgcatcgttaccattatagccgtacagggcgtcgttgccttctcctccatcgagcgtatcattgccattgccactgtagatactgtcgttgcctgcatcaccattcagcaggtcatccccgtcggcaccgtacagatagtcatcgcccaatccgccatttaaggtatttccggattggtaggcatacaatctgtccgaaccgtcggtggattgctgtaccagttctttgacagtggcaacatccagtactttgccgttatcgaaatgaatctcgtcgatacggtaagctcctgagccatcgttctggaaatagtactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgtatcctgaccgaagcctttgccgaagacataagtatccgaaccgctgccgccctccaagtaatcattaccggcaccgccgatcagagtgtcgttaccgtcttcgccgttcaaatgatcattgccttcgccaccattcagtgcatcgttaccattatagccgtacagggcgtcgttgccttctcctccatcgagcgtatcattgccattgccactgtagatactgtcgttgcctgcatcaccattcagcaggtcatccccgtcggcaccgtacagatagtcatcgcccaatccgccatttaaggtatttccggattggtaggcatacaatctgtccgaaccgtcggtggattgctgtaccagttctttgacagtggcaacatccagtactttgccgttatcgaaatgaatctcatcgatacggtaagcacctgagccatcgttctggaaataggactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgtatcctgaccgaagccttcgccgaagacataagtatccgaaccgctgccgccctccaaatagtcattaccggcgccgccgattagagtgtcgttgccgtcattaccatataaagaaacatttttattatgaccaaagcctacattttgcaggatatcatctgcttgcgtacccgatgttttagctaataatgcaacggtctcctgacccaacactttctggtaatcttcaaatttacctgctttttttgcctcctccacataatcggtcattagtcttcggccttcataccaagaacgaagttcgccatatgcaagcatctcggccaaatccacaaaagctttttgcggattagtttctttgacatggttaaatgcttgaacaagaccactaaaatccaaagtgaacgtatcattttccattttgaaactgatttgattcaaatatggctgcaaacgggtttggaacaacaggttttggtagatgtttttggcgagatggtcgtatgtatcgttggttactttgacgatattaagcgcatcttcctcgctcatgtaatagagtgtgttggaatcctgccccgtgtaggcatcaagcacggcaatgcggtcgcgggcggcgtcaatagctgctttagctttatcagaaagggaaactaaagcgttcttttttagttgtgctacttgggatggtgtcagtgcaataccttcattagccgtttgcgtccaatcggttgaaagtcgcattggcgattttttgccccagttcgaatcggtttccgcccatttgtgaatcaaattatctaacaatgccaactgtgcttctttagtttcggcggcagaataagctttcagcatattggccaaatcgccggacaatgcggcagcttcgcgcaaatcgcgcagacggccaatgcccgcaagattggcggcttttgcctgttcggcagtgagttccactttgtctttgaagcggctgtgcagattgtcggctgctaaaagtaaatcccccatttttgcggttgtaccgtctgttttggtatagctgccttgctgagccaaagtgttaccgttaccgagatttttatttacatctttataggcgagatccaaagattggatacccaattcttcaagggtacgcaattcattagcttgggaaatgccgtcctgattgagatcctgccatacacgcagggtttggaatgcggcgtctgccgcgttgatgatgttgtcgccgtttgaatccaattcggccaaagccgcgtagccgtgtttggcaaaagaaccgtctgccagtttggtgttgtcgccgaagagttccgcaccgttgtcgatgatgccgttgccgttcaaatcgcggacgagtaaaccgtcatcggcagaaacccaaccggtggcggtgcggataccgttgttggtgtgatcaaataagctgcctgcaaagcctttggtggcaacggtttctataccgtcgccatctaggtctagggcaagggggtcgtagacatgatatttgccattgcgttttttagtttctttaacccaaggagctaaacattggtgaccatcatcgatccagccttccggatttgggaacagatctctaaatttttcggccagatctttaaaactgggcaagcccttaaaaaattctcgagctgcttgagcagccttctcggctgtggatttggcattttcgtatgcttctttggcggcttgagccaaatcttccactacttgtttagctttctctgctgaaccgtcagccaaatcggaagcagcatttttcattttttcagacaattctttaatggctttgacacctttttctattccttgactagtattgtctactatgtcattatagattatttcggcagcctgagtgagattattccactgtgtatttaagtcatctccaaattccttgccagcagctttcatatcatgaaccaagctattgatttcatttttaaaagcttcatttccttgcttgatgttattattaacgatctcaaatattccagtccactctctttttacaacacttttatataaatcattgattatcccattaccccaacctccaattttttgccaaccatctattgtatattcaacacctaactttgttacatccatcatcacagattgtaaaaaagtaaaatgcttctctttaaaagatccatcaaatcctttatctaaagcagatattaactgctttctattatccctttcgctaccgttcggattatttactgcttgctcattgtggatacgttcggcttctatccccaaacctaatgcccaataaccatccgccatatccggaagtgaacgattaataactaaatcaatagctgcactggaagaaacgccattatcggtaacggctttatagtaacttctctcaatttcactagtattgggtaatctaccattattttgattaattagacgcgcatattgcctgaaatgttgcagtgcaacccgatcaaatttctctaaacgggtctttttaccgaccgtatcatcccataggttttccacaccttttttcatccataaattcaaaccatttaagtttgcatccttaccgacaattgcagcagcatcatccgcataacggtcacccaaattagccaaataacgccaaccgccataggtatcgccacgggaagcataaccacgcaaggtttggatttgttctggtgttaaaacaacttcaccctcattcatartaagatcctttaaattattttttacttgaattgttgacaaaactctgtaccaattgctctacttgttggtgttaac

SEQ ID NO: 62 - DNA, 16878 bp, Neisseria meningitidis
ggattaacaaaaatcaggacaaggcgacgaagccgcagacagtacagatagtacggaaccgattcactcggtgcttcagcaccttagagaatcgttctcttttttgttcatccgctatattgtgttgaaacatcgccacaaacctgatatagtccgctcctgcaacatcattgaaaattgttctttttaatcagttaaaaccgaatacggagtcgaaaatgaatccagcccccaaaaaaccttctcttctcttctcttctcttctcttctcttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgcaagcaaccggtgcaaacaacacaagcacggtaagcgattatttcagaaacatccgtgcgcattccatccacccccgggtgtcggtcggctatgatttcggcggctggagaatagcggcagattatgccagttacagaaaatggaaagaaagtaattcttctactaaaaaagttactgaagagataaacaacaactacaaagaaacccaaacaaaacatcagggaaacggcagcttccacgcctcttcttctctcggcttatccgccatttacgatttcaaactcaacgataaattcaaaccctatatcggcgcgcgcgtcgcctacggacacgttaaacatcaagttcattcggtggaaaccaaaaccacgattgttacctctaaaccaacgcaaggcgctgcacagggaggtcctattatacaaactgatcccagcaaacctccctatcacgaaagccacagcatcagcagcgtgggtcttggtgtcatcgccggtgtcggtttcgacatcacgcccaagctgaccttggacaccggataccgttaccacaactggggacgcttggaaaacacccgattcaaaacccacgaagtctcattgggcatgcgctaccgcttctgattccccgataccgatgccgtctgaaccttcagacggcattttttacacaattcccaccgtttcccatcattcccgatacaccgtaatctcgaaacccgtcattcccgcgcaggcgggaatccagacctgtccgcacagaaacttatcggataaaacggtttctttagattttacgtcctagattcccacttccgtgggaatgacggttcagttgcattcccgacaacaacgcaatctcgaaacccgtcattcccgcgcaggcgggaatccagacctccgacgcggcgggaatctatcggaaatgactgaaaccccgagattctagattcccacttccgtgggaatgacgtggtgcaggtttccgtatggatggattcgtcattcccgcgcaggcgggaatccagacccccgacgcggcgggaatctatcggaaatgactgaaaccccgcgttctagattcccacttccgtgggaatgacgtggtgcaggtttccgtatggatggattcgtcattcccgacaacaccgtaatctcgaaattcgtcattcccgcgcaggcgggaatccagccccctgacgcggcgggaatctatcggaaatgactgaaacccccgagattctagattcccacttccgtgggaatgacgtggtgcaggtttccgtatggatggattcgtcattcccgcgcaggcgggaatccagacccctgacgcggcgggaatctatcggaaatgactgaaaccccgcgttctagattcccacttccgtgggaatgacggttcagttgcgctccgacaacaccgtaatctcaaaacccgtccgacaacaccgcaatcttgaaattcgtcattcccgcacaggcgggaatccagacctgtccgcacagaaacttatcggataaaaacagttgcccaaaccccgcgttctagattcccactttcgtgggaatgacgtggtgcaggttccgtatggatggattcgtcattcccgcgcaggcgggaatccaaacccccgacgcggcgggaatctatcggaaatgactgaaaccccgagattctagattcccactttcgtgggaatgacggttcagttgcgttccgacaacaccgtaatcttgaaatccgtccgacaacaccgtaatcttaaaacccgtcattcccgcgcaggcgggaatccagacctccgacgcggcgggaatctatcggaaatgactgaaaccccgagattctagattcccacttccgtgggaatgacgtggtgcaggtttccgtatggatggattcgtcattcccgcgcaggcgggaatccagacccccgacgcggcgggaatctatcggaaatgactgaaaccccgcgttctagattcccactttcgtgggaatgacggttcagttgcttagggtaggatttggcgggattggcggactgaagcccactctacagccccgccctacaatacgccttgcgaatctgttccgcgcccgcccttgtatgtctcaaatgggttaaactacacacttcccgacttcccgtttcgggcaggggtgcaggttcgatttatatttcaataaaacaaggaaactttatgcagcacgaagaaggcaaccgccaacgccctcaaggcgaactgctcctgcgtaccgtcgctatgccgcgcgataccaatcccaaccaagacattttcggcggctggattatgtcgcagatggatttgggcggcggcatattggcggcggaaatcgcgcggggacgcatcgttaccgtcgccgttcaggaaatgaacttcatccgcccggtcaaggtcggcaacgtcgtctgctgctacgggcattgcgtccgcgtgggcaacacttccctccagcttaaagtcgacgtctgggtgaaaactttgatgaacgattgcgttaccgaagaccgctacctcgtaaccgaagccgtgttcacttatgttgccatcgatgcggaaggcaatccgcgcccgattccgaaagaaggcaaccccaaattggcgggcttattgcctactccgtaaaaatacccgtaaaaatgccgtctgaaactgtcttcagacggcattttgcatcatttgaaccaggacctgatgcgggaaaacagcgacatactctgtttttcaaagtcttcccgcacttcgggcacggctttttttatcactttcattcctgcaaaagtctgcgccacgggcataatttcaatcgtgttcacattcatatgcgccggccgctggtacagccacaatgcggtttccgcaatatcttcggggcggataaattccacaccctcatacacgcccgccgccctctcgtcatcgcctttgaagcgcacattggaaaactccgtattgccgcacaaacccggctcgatattggtaacgcggatgttcttatccgccaactccgcgcgcaaattcaggctgaactggcgcacaaacgccttggtcgccccgtaaacgttgctgccggcataagcataattgcctgcaatcgaacccaaattcatcacataaccgccgccgcgttccaccatttgcggcaaaattttgcgcgtcaggaacgtcaaacccaaaacattggtttgaatcatcgtttcccaatcttcaaaatccgccttgtccgccgtgtccagacccaaagccagcccggcattgttgatgaggcagtcgatgtcggaaaattcatcggggatgccgtttaaggcgttttccaccgactcgcgtcgcgacacgtccatttccaaagggtaaaacaaagcacccaattcatccgccaaggcctgaagcctgtccgcacggcgcgccgcaccgataacgcggtatcccgccccgacaaacgcacggcacatcgcttcgccgaatcctgccgaagcaccggtaattaaaacagccattgtttttcctttctttctcgtttcccaaacctgtttcaggtatcataacacccttcagacggcatcgcgccgactgaaaatgacaacaaccataccaccacgacaggacacattcaatatgaaaacccaaatcagccttgctgctgccgccatcacactgctcctttccgcctgcggaggcagcggaataccttcccaacccaaaggcgaaatttccgaaaaccgcaccgccgcgttcaaatccatgatgcccgaattcacacgcatgggcaaaatggtcaaagacgaagaaccttacgatgtcgaaaaattcaaacaggcggcagcgtcgtttgccgaaagcagcaagaaaccgttcacactttttgagtccgatccgcaaggcaacggccgcgcactgcccgccgtttggtcggatggtgcaaaatttgaagccgaaaaaacaaaattcgccgccgccgtcgaaaaactcaacgccgccgcccaaaccggcaaactggacgaaatcaaagccgcctacggcgaaaccggcgcaagctgcaaatcctgccacgacagtttccgcgcgcccgaataacatccaaaacaaaacaatgccgtctgaagacttcagacggcattttctttgccatttcagcacacgcaaagcaatcagaaattatcgtcaatccaaatgaaaaaacgctatccttatttttaccccacgcactccgccattttctattttgatttgctatgcgattaatttttatcgtcaaatgtcaaaatcgggatgccggattgggtaaacagggcatacaccggcttgagccaataatcttccggaagggaagccggtttcaatgcgtaaacgtgcacattgggaaaatccttcatcgtcaacgccgcgccgctgaaaaaggtataaatttcatacctcgtatgcgggtttttcttaatctcgcgcaaaatatagtcttcgatgacatagggcgaatttaatgtggttacgccggaaagcccgtaggtttggcggggatgcggcgcgacatattgtattttgaagttttttgccgccttttccgaaatttccttcatctctttgtcgggcgaacccaaaagtatccgcaccgtgccgcccgtttcgtcccccgtcttcagttcggacgcatcgaacagcggcaggtaagtcatcttgcggcggccgtcgtccataatgtttttcaaacccttgaatatcgtgtaatgctcgtcggaagcattgcgggttttggcgatgctccaatctccgatcatcatccgggcaaaattccgcttgatcgtcccgtttacagaaaactcatcgcccaaatagctgctgctttgaattaaattgcctgtcccgtcgtcaaaggttttgatttccgcatccgggtaagtgctcaaaaaggcggcaatgctgactttttccaaacttgccaaataaatccgcttgactttcggcagcagcatcgactttaccttcagctccgccatcgtcggaatgaaattaaacgatttgttcaaaccgtagggcaggtggaaaaagtacgcccgctccgccttatcctttatctgattgaaataataatcgtatttttcattcctgttttcagacatcagcaccacataaaaccgctcgcccggatgctgcgccataatcctttccgccaccttcatctgcaatatggtataacagaaaatcagattgaccggttccccctcttcattgaaaagtttctccttcagcagggaaaccgcattcctttccccctgatttacccggtcaaatgtataaaatatcccgaaacaaaaaacaatcaaacacaacacggtcaaacaagcctttttcaagcccatatccctaaaactccattccgacaaattgaacatacgccccgagtgtcccgggacggaaaaatgcggaattttagcagatattccgacagttaccgaatattatagtggtttaaatttaaatcaggacaaggcgacgaagccgcagacagtacaagcagtacgacaaggcgaggcaacgctgtactggtttaaatttaaaccactataaaatcaatttcaccgaaaatatgccgccgcacatcaggcacagcacctccgaccgccgccaaacgcgggaaaaccatttcccccttcctttcacgccgccgcgttcaaacacgccaagatcgaacaaagcgcgaacaaagccgccaaaatatgccataatagccacgcacattccccgcgcaatgtgttccaaaagaaaaaaccaacctacaagagaataatcctatgactcaaaaatccaccattgtttatacccataccgacgaagcacccgcgctggcgacccaatcgctgctgccgattgtgcaggcttttgcccgccacgccgatattgatgtcaaaaccagcgacatttctctctccggccgtattttggcggcgtttcccgaatacctgaccgaagcgcaacgcgtacctgatgcgcttgccgaattgggcgaactggtgaaacaacccgatgcaaacgtaatcaaactgccgaacatcagcgcgtccgtaccgcaactgactgccgcgattaaagaattgcaatctaaaggctttgccgttcccgactatcccgccgacccgcaaaccgatgaagaaaaagccgtacgcgaacgctacgaccgcatcaaaggcagcgcggtaaaccctgtcctgcgtgaaggcaactccgaccgtcgcgcccctaaagcagtgaaaaactttgcgaaaaaaaatccgcacagcatgggcgcatggaccaaagactccaaaacccacgttgccaccatgcaaagcggcgacttttttcataacgaacaatctgttatcgtacctgaagcgacttccgtatccatcgtattcaccgacaaacaaggcaacaaaaaagagctgcgcgagcccgtcgccctgaaagccggcgaaatcatcgacgcgaccgtgatgagtaaaaaagccctgctcgccttccttgccgaacaagtaaaagatgcgaaagcaaaaggcgtgttgttctcgctgcacatgaaagccactatgatgaaagtgtccgacccgattatcttcggacacgccgtcaaagtattcttcgcgcctgtttttgaaaaattcggcgacaaactggctgctgccggcgtcaacgttaacaacggcttcggcaacctgcttgccaatctggacaaactggatgcggacacccgcaccgccgtcgaagccgaaatcgccgccgtttacgctgccaaccccgatttggcgatggttgattccgacaaaggcatcaccaacctgcacgttcccagcgatgtcatcgtcgatgcctctatgcctgcgatgattcgcaattccggccgtatgtgggacaaaaacggcaaagcgcaagacaccaaagccgtgattcccgacagcagctatgccggcgtttaccaagcaaccatcgacttctgccgcgaacacggcgcatttgacccgacaaccatgggtactgtgcccaacgtcggactgatggcgcaagcggcggaagaatacggctcgcacaacaaaacctttgaaatcgaagccgacggccaagtccaagtcattgatgcggcaggaaaagtcctaatgcagcacgacgttgaagccggcgacatctggcgtatgtgccaaaccaaagacgctccggttaaagactgggtacaacttgccgtcaaccgcgcccgtctgagcaacacgcctgccgtgttctggctcgacgaaaaccgtccgcacgacaagagcctgctcgccaaggttaaagcctaccttgccgaactggataccaatggcctcgacatccgcgtcctcgctcctgaagaagccgccaagttcagcttgggtcgtctgaaaaacggcgaagacaccatctccgtaaccggtaatgtcttgcgcgactacctgaccgacttgttcccaattttggaactcggcacaagcgcgaaaatgctgtctatcgttccattgatgaacggcggcggtatgtttgaaaccggcgcgggcggttctgcaccgaaacatgttcaacaattcctcgaagaaaaccatttgcgctgggactcgctgggcgaattcctcgcactcgccgtatcgtttgaacatttggcgcaaaaaaccggcaatgccaaagcccaagtcctcgccgacactttggatgcagccaccgaaaaactgctgttgaacgacaaatcgcctaaacgtaaagccggcgaactcgacaaccgcggcagccatttctacctcaccctctactgggcgcaagaattggcggcgcaagacaaagatgccgaactgaaagccgcatttacgccattggcagccgctttgaccgccgacgaagcgaaaatcgttgccgagctttccgccgtacaaggcaaagcggccgacatcggcggctactacgccgccaatcctgaaaaagccgcacaagtgatgcgtccgagcgtaacctttaatcaggcactaaacgccttataagcacaaaggtaaaaatgccgtctgaacattcgtcgttcagacggcattagttatccctatctgcctgattatgattaaacgccgcacccattggatataaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactataaagaccgttgggcatctgcagccgtcattcccgcgcaggcgggaatctagtctgttcggtttcagttattttcgataaatgcctgttgcttttcatttctagattcacactttcgcgggaatgacgaattttaggtttctgattttggtyttctgtccttgtgggaatgacaggatgtaggttcgtaggaatgacgtggtgcaggtttccgtgcggatggattcgtcattcccgcgcaggcgggaatccagaccttaaggcagcggcaatattcaaagattatctgaaagtctgagattctagattcccactttcgtgggaatgacggttcagttgctacggttactgtcaggtttcggttatgttggaatttcgggaaacttatgaatcgtcattcccgcgcaggcgggaatctggaatttcaatgcctcaagaatttatcggaaaaaaccaaaacccttccgtcatcattcccgcaaaagcgggaatctagaaatgaaaagcaacaggaatttatcggaaatgaccgaaactgaacggactggattccctcttttgcgggaatgacggcgacagggttgctgttatagtggatgaacaaaaaccggtacggcgttgtctcgccttagttcgaagagaacgattctctaaggtgctgaagcaccaagtgaatcggttccgtactatctgtactttctgcggcttcgtcgtcttgtcctgatttttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgagacctttgcaaaattccccaaaatcccctaaattcccaccaagacatttaggggatttctcatgagcaccttctttcaacaaaccgcccaagccatgattgccaaacacatcgaccgcttcccgctattgaagttggaccaggtgattgattggcagccgatcgaacaatacctgaaccgtcaaaaaacccgttacctccgagaccaccgcggtcgtcccgcctgtcccctgttgtccatgttcaaagccgtcctgctcggacaatggcacaacctctccgatcccgaactcgaacacagcctcatcacccgcatcgacttcaacctgttttgccgttttgacgaactgagcatccccgattacagcaccttatgccgctaccgcaaccggctggcgcaagacgacaccctgtccgaactgttggaactgattaaccgccaactgaccgaaaaaggcttaaaagtagagaaagcatccgccgccgtcgttgacgccaccattattcagaccgtcggcagcaaacagcgccaggccatagaagtcgatgaagagggacaagtcagcggtcaaaccacactgagtaaggacaaaaatgcccgttggacaaagaaaaacagcctctacaaactcggttacaaacaacatacacgtaccgatgcggaaggctatatcgagaaactgcacattactcccgccaatgcccatgagtgcaaacacctgtcgccgttgttggaarggttacccgaaggtacgaccatctatgccgacaaaggctacgacagtgcggaaaaccggcaacatctggaagaacatcagttgcaggacggcattatgcgcaaagcctgccgcaaccgtccgctgacggaaacgcaaaccaaacgcaaccggtatttatctaagacccgttatgtggtcgaacaaagcttcggtacgctgcaccgtaaattccgctacgcccgggcggcctatttcggactgatttgcgcccgctgccgcctaaaaggcagcccggatgcctgattatcgggtatccggggaggattaagggggtatttgggtaaaattaggaggtatttggggcgaaaacagctgaaaacctgtgtttgggtttcggctgtcgggagggaaaggaattttgcaaaggtctcaacttgaacaaaaaagaaccgccccgaatcagggcggttttgctttgtggcggaaacggtgggattcgactaaattttatttcattgatttaaatatatttatttcttatgaaaatttaatttaccataaaaacagccatatacaaaaatcttggagtaactattgcattacactattagaagaatgccgtctgaagtgttttcggacggcatttcccaagctgccggaaaaaagctaaaatgcccgcaaacagacaaggagcagcgatgcaaaaccaaaatacacgccccgtcaaaatcgagcttaaaggcgaagcaggcaaacgcgtactgcttgccgccgcccgccgcattgccaaaacccatcaaaaagccgtcaaggcacttgccgacaaatgatagacggcgaactggtcgcgcttatccatcaaaccgtattggcggatgaagcgggtttgaaagggcgggcggatatggcgcgcttggacggcgcattgtcgcggattgccaactggcggcagtatgaaaaccttgaggacatctacgaaatcgccgccctctatgcacaagccatagccaaagcccacgcctttcccgacggcaacaagcgcaccgcgcttttaacaatgttgacctatctggatttgcagggcatcagcattgccgccgaccaagggcttgacgacttgattgtcagtttggcggcgggagaaaccgacttcaaacagctcgccgaaaccctgcgccggctggataaggaataggcatatccgacaacaatgccgtctgaaattcagacggcatttttattgaaaggcttttcttcaaccgctttacacaaaggcggtttttttatgccgtctgaaagcccttcagacggcattggtttacacggcaggagtccccccgcctttaagcaggagaggatgtcaaggatgcctgatttttaaatcaccccttgaaagaacgggcgcacggcattaatatacagatatcgacaagcaaggttaaaaccattaaggaaatacgatgaaatacaaaaatgagggttttaatggctggtaaggtgcggaaacaaataaaacaaggaggttggttgtcagtaattgccctaacctccttgtttgtatctgtattcactttattttacatattcaggcacagcgtacagtttaacctatgagggacggccgaatggctgatgttttggcaactgaccgttgtttcagtaaccgccgtcattgcactggggacaatattcatcaataagaaaacttcaaagcaaaaggcgacattagatgttattttgaatgattaccaagatgcacaatttgtagaagccgacaatcatatttcgccttatattcgcggcacggcagttgacgacaacaacgcgcggatcgacctgtatgaaatttatcaaaataagggcggacaatgggaaaaagagagagggcatttacttaccgtaatcaatcggcacgagttttatgcgtgcgcaatcaactcgggagtattggatgaggatttgtttaaacggctgcattgcaccaacttcataaaattgtggaatgcagtttcgcctcttgttatgaaaatacgcgaagaagaacgcaaagacacaatatttagagagttggaaattttggttgcattatggaaagcaaaccccctaaaggcatctgatttgtgaataaacagtcaaaactgttctgaaatatgggcagccacgcaatcgccgaaatacgccaaagcagccttataaagtgattttttgaacataattttctccttgcggagcattttccaatcaaacagttttagtttacttggttttgtatccctaaacaaccgaaatccgacatcaagcaattagaaagcttttgcatcttgaaaatggataacaaaatattgcctgaaggcgcaaatacagtacaaaagccgtccgaaacagttcggacggcttttggcgtattctgcacaagtatttgaacaactgaaattttatggtaatatgtatctactttgtagatacaataaaggtgaagattatgttgcgtgtccaaaaatgggggaactcggcggccgtccgactgcctgccgacatgctgaaacaattggattttaaaatcggcgacgctttggtagcggaagtacataacggcgaactccgtgtgcgtgctgcccgacgtttccgcttggcagacttgcttgccgaaatggaagaaaccccgccgcgcgtagaaggctgggaaatcttggatgatgccggcaacgaggtcgtctgaaatgtatattcccgacaaaggcgatattttccatttgaatttcgacccttccagcggcaaggaaatcaagggcgggcggtttgcgctggctctgtctccaaaagcattcaaccgcgcaacgggattggtttttgcctgccccatttcacaggggaatgcagcagctgcacgaagcagcggcatgatttcaaccttactcggtgcaggaacggaaacgcagggcaatgtccactgccaccagctcaaatctctagactggcaaatccgcaaggcttcttttaaagaaactgtacccgattatgtattggacgatgtgctggcgcgcatcggcgccgtcttattcgattaaatgctgaaaccgcccgaacctgtaatcttttcttacaggttcgggcggttgcttattcggcacgctgactgcttactgcatgaccatatgcctgccattcccttaaatcggctgcatgtccgtcggctgtttctgccagtcctgcatatttttcagcgcactgtccgaataatagccagccttgggaatctgacgcgccatcagatgcggtggcggcggtagcggttgcgggcaggtttctgttgcgattttgggcggcggcgtagtggcgcaggcggttaagctcaagacgcatagcggcaacagttttttcagcattttgtttttcctcttctaatttggtttgtcgttcggcaaacgcggcagcggccttctgctcggcagaacgcgcctgctttgcctgctcgatatagccgtctttcagacgattcgagatttcggcagcagcagcctcccgtcccatgcggtatttttcggcacggtcgaaatgccatgcggtaaaaatcaggacgattagcagcaatacacctaccggcttccagtatttcaataaaatatccatttcagacgacctcaaggatgcagcccgggcagatacacggttttgccgtttttcttggttgcggtcagtatctggttgcgttgcgggctgttgcgtcggaaaccgatgtgtacccatgcgccgtccccgcgctcaggaaattcgagtatcaactggtcgaatttcagcgcacggcggattcgcatttgaagtgcaactttccctaacagaaaaaggccagtatgcggtagcatacggcctttcctgcaagaaagattgccatgagccacacgcaactgacccaaggcgaacgataccacatccaatacctgtcccgccactgcaccgtcaccgaaatcgccaaacagcttaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttaggacattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagcaatattaaaaattatcgtcatcaatgcggcttccccagcccgcggcgagctttccacgacaggctttttttatttgggttggtcgtctggtttctttgagttcaaaaacaggtcgggatacttaagttttattcgtgcaggtatcccgcgcttcgtccaattgaaaacgcattgagggctattccctgttattcgaccaacttccgcgtaactgccgattgattgcaacaggcgtttgtcttcattgactcttttatccataaataaaccaaatgtttaaatctaatgctaatattaaacactatgtttagataaaaatcaagtcttgtgtaacaacattttgtttaaatatgggagaataattaagccaaccgcgaataagattaaaaatgacaatgcacgagacaactgacagactttttgagatagccaaagagcagggagttttaaagccggctgacatagcagagcgtctgatatcagccaacaggctttgaaaaactgggaaagtcgtggcatagcggcaaaggcgctgcctgaagtagcaaaagcattcggtgtatctgaaacatggctgagaacaggtgaaggcagccgaaccgcgcccgtccttattgaccccgacctaccccacgaagtcaaagacatccaccgcccgatgacgtggagcagcaacgacccgctgcccgacgatgattatgttttcgtcccctacctcaaagagagctgcttcaaaggcggagtaggcacgtatgaaatccccgattacaacggctaccgcctgccgttcggcaaatccacgcttaaacgcaaaggcatcaatcccgacaacgtgttttgctgcaccctgaccggcgacagtatggaggaaaaaatcgcagaagacgcggcaattgccgtagatacgggcgaaaccgccatacgcgacggcaaaatctacgccttcgcccaggacggtatgttccgcgtgaagtacctgatacggcagcctggcaacagcgttctgatacgcagccacaacagcggtttctatggcgacgaaaacgcccccttggacagcctgaccgttatcggcagggtattttggtggagcgtgctggattgaaaaatgttgctattacgacgagataatattgatagggctttcaagattgtcaaaaataggcgttttgattccccttggtggcctggtgagtacgatgccggtatgaatttccttggcgtacaaggagagttgaaggttcacgagctgcatcacagaacagcaaccctgtgctttgagtggcttggcgaagtatctgcgccgcgcagaaaagagaactacaaagacctcaagccaaatgtattgtatgactttgatggttccggtaagcattttgccaaccctgacgcaaggtatctattgcccgtcggttcaagcggcttaatcttaaaacatatccaaatcgatgacgaagacactctgttgcggctatggtgcgcacgaaatatcccaatgccacaccggctatctaaaatcccgatgcttcggcagtattatctaagcaaggcatggcacgaaatttatgctatcaaccaacacctaaggaaaacgaagctgatagttgatgtggcatacgaccccacagattaaacaacccgcccgcattatgcgggcttttttcatgccccgccgaacctgaaaacaacacaaaaccgacatagccgcgtacc

SEQ ID NO: 63 - DNA, 4169 bp, Neisseria meningitidis
ccgtcttttgtgctacccttgcccgaatcatccgatgtctaaaaattctgcctgatggcagccctacaaacccgaaggagtagaaatgaaactgtccgaactgttcaaccccgacgaatttgccgcgcggcatttgagttttggcgacgaagcggcgttgcttgccgctgtcggcgagaaaagtatggacgattttgtcggcaacaccgtgccgcaaagcatccgtatgccgtctgaactcgatttgcccgatgccctgaccgaagcggacgcgttggcaaaattgaaaggcattgcgtcgaaaaacatgatcaacaaatcctatatcggtttaggctattacccgacccgcgtgccgaacgtgattttgcgtaacgtattggaaaatccgggttggtacaccgcctacacgccgtatcaggcggaaatcgcgcaggtcgtttggaagctttgttgaacttccaacaagtgtgtatcgatttgaccggtttccctgtggcgggcgcgtctttgctggacgaagcgaccgccgccgccgaagcgatggcgatggcgcaccgcgtgggcaaggtaaaatccgagcgtttctttgtggacgagcgcgtgtatccgcaaactttggacgtgatgaaaacccgtgccaagtatttcggcttcgagctggtggtcggcgattttgcccaagccgacgaaggcgaatacttcggcgcgctgttccaatacgtcggcaaagacggcgacgtgcaagacttgcaggacgttatcggccgtctgaaagccaaaggcacgattgtcgccgtttccgccgacatcatgagcttggttttgctgaaaccgcctgccgaattgggtgcggatattgcgttgggcaacacacaacgcttcggcgtgccgatgggcttcggcgggccgcacgccgcttatttcgcgtttaaagacgagttcaaacgttccgccccgggccgcatcatcggcgtatccaaagacgcatcgggcaaacctgccttgcgcatggctttgtccacccgtgagcaacacatccgccgcgaaaaagctacatccaatatttgtaccgcgcaggcattgctggcgaatttggcgggtatgtatgccgtttaccacggccctgaaggcgtgaaacgcattgccaaccgcattcacgcgctggcttctgcctttgccgatgcgctggtttcagacggcctgaatgtggttcacaaagtctttttcgatactgttaccatcgattttggcagtaaagagaaagcagaccaagtgtttgccgctgctttggcgtcgggttacaacctgcgccgcgtcaacgatactcaagttgcggctgcattccatgaaacatcggcatacgaagatttggtcgatttgtaccgcgcgtttaccggcaaggatacgtttacatttgccgatgatgtcaaaggccgtctgaacgccgaattgctgcgtcaggacgacattctgcaacatcctgtgttcaacagttaccacaccgaacacgaaatgttgcgttatctgaaaaaactcgaagaccgcgacttggcgatgaaccgcagtatgatttcattgggcagctgtactatgaaactcaacgcgactgcggaaatgttgccgattacttgggccgagttcaccgacatccatccttacgctcccgaagcgcaaaccgccggctaccgcgaattgctcgccgatatggaaaacagcctgaaagccatcaccggctttgacgcgatttccctgcaaccaaattccggcgcacaaggcgaatacaccggtatgctcgccatccgccgctatcaggaatcccaaggcgaagcgcaccgcaacatctgtctgattccaaaatcagcccacggtaccaaccccgccaccgccgccatgctcggtttgaaagtcgtcgtcgtcgacaccgacgaacacggcaacgtcaacattgacgatttgaaagccaaagccgagcaacaccgcgacgctttgtctgccatcatgattacctatccgtccacccacggcgtgtacgaagaaggcatccgcgacatctgccgcattattcacgaaaacggcggacaggtttacatggacggtgcgaacctcaacgcccaaatcggcatcatgcagcctgccgaagtcggtgcggatgtgttgcacatgaacctgcacaaaaccttctgtatccctcacggcggcggcggcccgggcatgggtccgattggcttgaaagcccatttggctccgtttgccccgggccataccttgaccgacacccacaacgcggctgccgatcaaaccgccgtggctgccgcagcatatggttctgcatccatcctgccgattacttggatgtacctgaccatgatgggcaaacaaggcatggaacaggcaacgcgctgggcattgctcaacgccaactacgtcgccaaagccttgggcgaggattatccgattctctacaccggcaaaaacggccgcgtcgcgcacgaatgtatcgtcgacttgcgtccgctcaaagccgaaagcggcattaccgaaaccgacatcgccaaacgcctgatggactacggcttccacgccccgaccgtctccttccccgttgccggcacgctgatgatcgaaccgaccgaaagcgagagcaaagccgaactcgaccgcttcatcgccgccctgaaacaaatcaaacaggaagtgctgaaagtcgggcgcggcgaatggccgaaagacgacaacccactggtcaacgcgccgcacaccgccgcagatataaccggcaactgggcgcatccgtattcccgcgaagaagccgtcttcccgttgccgttcgtccgcgaacacaagttttggcccttcgtcaaccgcgtggacgacgtgtacggcgaccgcaatctcgtgtgcagctgcccaccgatggaaaattatgaagactgactgttgatatcttaaaaaatgccgtctgaaacattttcagacggcattttcatcaacggcaaaccagttgcaccaatacacgtatctcgactataactttaaaacaaatgagttaaaccagtatccatacatcagcttttttatcatcctactttttattcatccgatcgtgcaaacagatttcaaagatgaaaagcctattcacaccctttgatgtcatttccacacggacaaacaaatatagtggattaacaaaaaccagtacagcgttgcctcgccttagctcaaagagaacgattctctaaggtgctcaagcaccaagtgaatcggttccgtactatttgtactgtctacggcttcgtcgccttgtcctgatttttgttaattcactataaattcccataaaaaaacggagcagatacctgccccgtttttatttaatccgaaattttaatctaaatttagaattttgcaccggattggtttgccatatagtcaacagccgctttgacttcgtcatcgctcaaacctgcattgccgcctttggcaggcatcgcgttaaagccttcaagggcgtgtttgtgcaaggtttctttgccttttttgatacgcggtgcccaatcgtcttttttgcctatgccgggaataccgggaatcgaaccgccgtggcacacctgacaggttgcttcgaagacttttttaccgtcaacgccgaccgcaggggctgccgcacccttgtcttctgccttcgcttctgccggagctgcactatcggcaggagcagaagctgttcctgaagcggcattgtcggcaggcgcagcctcatcaggattcgggaaagaaccgccgcttttgttcgccatgtaagtaatcgcccgtttaagttcctgatcggtcaggtctgccgcaccgccttttgcaggcatggcgttaaagccgttcagcgcgtgttggaacaaggtatcgaagccttgcgcgatacgcggtgcccaatcgccgttgtgttccagtttcggagcgttcggcacattgctgtccgccgcgtggcattggatacagattttgccgaaaatctgttcgccttggcgttcgccgacggggatgccgtcgcccatcgtcaattgtccgacaggctggatacgggtctgcgttgctgcttccgtagtggcatcgacatcgccgaacgagccgctgcccgccagcttaatcaggaaataaaggactgcaataac

SEQ ID NO: 64 - DNA, 15896 bp, Neisseria meningitidis
  misc_feature (22)..(22): N is any nucleotide
tgtgttgtttgcaccggttgcntgcggataatcgtgggtaatgcgttcggcggcataagctaaatccgcctgcacataatacgggctgcggctgccgtcttcacttgccgcctgcgctgcggaagagaagagaagagaagagaagcggagaggaggggaggggaggggaggggaggggaggggaggggaggggaggggaggagaaggttttttgggggctggattcattttcgactccgtattcggttttaactgattaaaaagaacaattttcaatgatgttgcaggagcggactatatcaggtttgtggcgatgtttcaacacaatatagcggatgaacaaaaaagagaacgattctctaaggtgctgaagcaccgagtgaatcggttccgtactatctgtactgtctgcggcttcgtcgccttgtcctgatttttgttaatccactataaagaccgtcgggcatctgcagccgtcattcccgcgaaagtgggaatctagaaatgaaaagcagcaggaatttatcggaaacgaccgaaaccgaacggactggattcccgcctgcgcgggaatgacgggattttaggtttctgattttggttttctgtttttgagggaatgacgggatgtaggttcttaggaatgacgtggtgcaggtttccgtgcggatggattcgtcattcccgcgcaggcgggaatctagaccttagaacaacagcaatattcaaagattatctgaaagtctgagattctagattcccactttcgtgggaatgacggttcagttgctacggttactgtcaggtttcgtttatgttggaatttcgggaaacttatgaatcgtcattcccgcgcaggcgggaatctagaccttagaacaacagcaatattcaaagattatctgaaagtccgagattctagattcccacgaaagtgggaatccaggatgtaaaatctcaagaaaccgttttatccgataagttcctgcactgacagacctagattcccgcctgcgcgggaatgacgggattttaggtttctgattttggttttctgtttttgagggaatgacgggattttaggtttctgattttggttttctgtccttgtgggaatgacgggatgtaggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagtctgttcggtttcagttatttccgataaatgcctgttgcttttcatttctagattcccgcttttgcgggaatgacggcgacagggttgctgttatagtggattaacaaaaaccagtacggcgttgcctcgccttagctcaaagagaatgattctctaaggtgcttaagcacgagtgaatcggttccgtactatccgtactgtctgcggctcgccgccttgtcctgatttttgttaattcactatatcgcgatttttcggcatttgcctttcggggcggcttgtgtctcgtgcgtgatgttgcgtgtgggaatgttcggattgtcagaagcaatatgggagaagatgatgtatgagataaaacagccttttcatagcggatacttgcaggtgtctgaaattcatcaaatttattgggaggaatcgggcaatcccgacggtgtgccggttatttttttacatggcgggccgggcgcgggggcttcgcctgaatgtcggggttttttcaatcccgatgtgttccgcatcgtcatcatcgaccagcgcggttgcggacgttcgcgcccgtatgcttgtgcggaagacaatacgacttgggatttggtggcggatattgaaaaagtccgtgaaatgctgggtatcgggaaatggctggtgttcggcggttcgtggggcagcactttgtcgctggcttatgcccaaacccatcctgaacgggtaaagggattggtgttgcgcgggatatttttgtgcaggccgtctgaaacggtgtggctgaacgaggcgggcggtgtgagccggatttatccggaacaatggcaaaaatttgtcgcgccgattgctgaaaatcggcggaaccggctgattgaggcgtatcacggattgctgtttcatcaagatgaagaagtgtgcctgtctgccgcgaaggcttgggcggattgggaaagctatctgatccgtttcgagccggaggaagtggatgaagatgcttatgcctcgctggcaatcgcgcgtttggaaaaccattattttgtcaacggcggttggttgcagggcgatagggcgattttgaacaatatcggcaaaatacggcatatcccgactattatcgtacaggggcggtatgatttgtgtacgccgatgcagagtgcgtgggcgctgtcgaaagcctttcccgaagcggaattgagggtggttcaggcagggcatcgtgcgttcgatccgcctttggtggatgcgttggttcaggcagttgaggatattttgccccatttgttgtaaaaagttccgcataaaaaagcagcttctgtttggaagctgcttttgttttgaatggtttaacgcagttcggaatggagtttgcccaataatgcggatgcgtctttgccggcatatgcgctgccgtctttgttgagcaggacgatgcgcgagccgttggcgacaggttctgcatagacaatcagttccggctgttcggcaggtttctccgctttgcctttgcccagcaggcgtttgaacaggccgggtttttgttcggtaactgcattgctttcgttcggggctttttgaaccaggaaggcgtggcgttcggtgttttgaccgacgacggtcagcccgatgcggtcgagggcgagcacggtgcgccgccagtttctgccgtagtcgccaaagacaatcaggcttttgccttcgatacgcgccatttcgttggcggcgggaagggtaggtttttttgccgatgcgttttccgcctgctgtccgtcaacgcccaaatattgcataaagcgcgtcaggaaagcggcttcgaggttgggatcggacggggagggctgccatacggtcgtgtctttgtctttgccgccgtacacttctttcatggctttgtgggcgaagaagatgtcggaaacgccgtttttgccctgttcgatacggacgatgaatttgtcgcgctcgccggtggagtagatgccgcccaagccgactttgtcgaagaggcggcgcaagctgtcttgggggattttggcgcggttttccgcccactcggtttccatttgtccgatggcgggttcttcggatttgatgtcgaagccgttttcctgccaaaaggctttcaggagcggccagatttcggcaggagacttgccgtcgacaacgagccagcgttggctgccgtcgcgctcgaggcggacacctttgacgcttttcaatacttcggcatcggcaggctgttggacggcgggtgtgcggcgtttttccaaatcgctggcgcggacggcgcccgaaccggcaggcaggcggtagaggttgccttggtcggggttgttcaaatcaggtgggacttcaagtttgatcaggcggtgcgaccggctttggtagtcgagcttgggctgttcggttttgctgccggagcaggcggcaagcccgatgagtgcgagcgcggcaatgacgggtttgatatgggtcatcgtgtcatcctgtgtgatggatattaaagtgtttgttgcgttatgccgtccgaacggttcggacggcatggctatatttaaagttgtcctgaggctttcagggcggcgcggacttttgcttgtccgttttccgtcagcggaacgagcggcaggcggacgtgcggttcgcatctgcccagggcggataccgcccatttcggtgcggcggggctgggttcgcagaacatggtgtcgtaaatcggaatcagtcggtcgttgagttcgcgtgcaagggcgatatcgccttgaagcgcggcgcggcacatatcggcaaagagcttgggcgcggcgttggcggctacggtaatcacgccgtgtccgccgcagagcatgaacggcagggcggtgtggtcgtcgccggaaaggacgacgaagccttcgggcgcgcggttgatgagttcgatgttgctgccgatgttgccgctggcttctttcacgccgacgatgttggggatttcggcaaggcgcaggatagtgtcgttagtcatgctgacgacggtacggccgggcacgttgtagataatcatcggaatcgaagtggcttcggcgatggttttgaaatgttggtaaatgccttcttgggagggcttgttgtaataggggacgacggagagggtgtagtccgccccggctttttcggcggcttgggaaagggcgatggcttcgacggtgttgtttgcccctgtgccggcgatgacggggacgcgtttggcaacgtgtttgacgacggcttcgatgacggcggtgtgttcttcgacggagagggtggcggattcgcctgtcgtgccgacggcaacgatgccgtccgtgccgttttcaatgtgccagtcgattaagtcgcggagttgttcgtaatggatgctgccgtcttgattcatcggggtaatcagggcaaccaagctaccttgtaacatacagaaccttttatcagttgtggtgtaggggcggtaatgcttccgattgtagcctactttaccgcaggtgtgaaatccggcgggttgcagatgtggggcgtttgcgccgaaaggtatggtggaaattgatttttcctgtttgaaatcattttattatattcgccggtttatgccggtgccgtcggatttatagtggattaacaaaaaccagtacggtgttgcctcgccttagctcaaagagaacgattctctaaggtgctgaagcaccaagtgaatcggttccgtactatttgtactgtctgcggcttcgccgccttgtcctgatttttgttaatccactataaaatgtggtaaacgtgtggaccagacggatgccgtctgaaatgcaaattgaagccgtgcggcagattcgctacaatccgcgcttggatttttcaacctttaaaataaggaaatacaatgagcggtcagttgggcaaaggtgcggatgcgcctgatttggtgtacggtttggaagacaggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttttcgttcgttaccgtgatgattgcgctgggcgcggggatgaaagagggcggtttgactaaggatgcgatgatttcgacgctcttgggcgtatcgtttgtcggcgcgtttttggtgtgtttctcggcgtggcttctgccgtatttgaaaaaagtgattacgccgacggtcagcggcgtggtcgtgatgctcattggtttgagtttggtacacgtcggcattaccgatttcggcggcggcttcggcgcgaaggcggacggcacgttcggctcgatggaaaacttggggctggcatcgctggtgttgctgattgtgttggtgttcaactgcatgaaaaacccgctgttgcgcatgagcggcattgcggtcgggctgattgccggctatatcgtcgcgctgtttttgggcaaggtggatttttccgcgctgcaaaacctgccgctggttacgctgcccgtaccgtttaaatacggttttgctttcgactggcacgcgtttattgtggcgggcgcgattttcttgttgagcgtgtttgaggcggtcggcgatttaaccgcgacggcaatggtgtccgaccagccgattgaaggcgaggaatacaccaaacgcctgcgcggcggcgtgttggctgacggcttggtgtcggtgattgcgacggctttgggttcgctgccgctgacgacgtttgcgcaaaacaacggcgtgattcagatgaccggcgtggcttcgcgccatgtgggcaaatatattgccgtgattttggtgctgttgggtctgttccccgttgtcggtcgcgcgtttacgacgattccgagtccggtgttgggcggcgcgatggttttgatgttcggcttaattgcgattgcgggcgtgcggattttggtcagtcacggcatccgcaggcgcgaagcggtgattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactgattttgaaaatgaatgccgtctgaaacagaatccctgtttcagacggcattgtttttgaggcttatactttttcgttttttaatacgcgttgtcggcgtgtttcacttaataccattccggcagacacggagacgttcatgctttcgactgtgccgaacatgggtatagacaccagcatgtcgcaatgttcgcgcgtgaggcggcgcataccgtcgccttcgttgcccattacccacgccgcgctgtcgggcagattgcaatggtaaaggtcggactcgccgctcatatcggtgccgataatccaaatgccgtattctttcaattcgcgcagggtgcgggcgaggttggttacggtgatataggggacggtttccgccgcaccgcaggcgactttgctgacggtggcgttcagccccgcgcttttgtctttcggtgcgatgacggcgtgtacgcccattgcgtcggcggtacgcaggcacgcgccgaggttgtgcggatcggtgatgccgtcgagtatcagcagcagcggcggttcgctgaggttttccaatacgtcttcgaggtggacgtggtttttggaggcatcgataaatccgaccacgccctgatggcgcgcgcctttgctgatggcgttgaggcggtcggcatcggcaaaatatacgcggatgttttcgtttgccgccttttccaacacttcgcgcgtgcgtgcgtctgatttgccttcttggatgtagagttcgacgatggatttggggttttgccacaatcgggcgttgacggcgtggaagccgtagatgggtctttggtttgccatgatggtgctttgtaaaaagggttcagacagcattatagcaatttgccggtatgccgtctgaaagggttaaaacaggtaggcgatgtatttcaccaacaggataaacaagatggatacggcgcagccgattttgaacgccgtgccgacgacaagccccaacagcgtacccaagcccgctttacctgcctgaagcatattgcgccgttcgatcagttcgcctgccgccgcgccgataaagggaccgagtattagtccgggaagggagaaaaatatgccgatgatgctgccggccaatgcgccgcgaacggcgagcttgcccgctccggtatattttgtcccccatatgcctgccacatagtccgccagtatgccggcaaggctgatgagtccgaccgtccacaaaacgcccgcgccgtagatttggtagccgccggcataggcaagcagccatgttccggcaaacatcaatgccaatccgggcagggcggggtaaacgatgcccgccgtgccgacggctatcagggcgagggcgaggatgacggtcagtacggtcataggttcaaccttttcttttgttttgaaaaaaacggcttaacacggcgcggcattcttcttgcaggattccgccccgtatggcggtgtgcgtattgaggcgtttgtcggcaaacaggttgacgatgctgcctgccgcgccggttttgggttctgccgccccgtagatcacacgcctgattcgtgcctgtatcagtgcggacgcgcacatggcgcagggttcgagggtgatatatatgtcgcatccgtcaaggcggtagttttgtatttctctgcctgcctgtgccaaggcgttgatttcggcgtgtcggctgacattgcagtcggcaatgcaggtgttgtgtgccgatgcgatgattttgccgtctgaaacgatgactgccccgacgggtatttcgccgtcggcggaggattgttctgcttggcgcagtgcttcgcacatgaagtgttccatttcttcctgcggcggaaaggcggcgacgggcggatggttttttaactcggcaagcaggcgggctttatgcgcttgggacatttcttgcggcggcgtgccgtccagcagcgactcgagttgccacagtgtgcttttcgtgagggtcaaacccgatgctttgagcagcagaaaggctttgaccgaaccgttttgccgcagttcttcgagtgtacggataccgagcctgtgcagggcggcgacggttttgggggcgagcggcggtgtggtcagcatggtttatgcgccgaaaaaccgttttgccgcctcaatcaggcgtgtgcatgaagtgcagtctgaaaacgggtcggcaacgcagtctaaaggtgttttgcgcaaccaagtcagttggcgtttggcaagttggcgggtggcggcaatgcctttctcgacaaatgccgggaaatcggtttttccatccagatatttccatgcctgacggtagccgacgcagcggatggcgggggagtaggcggtcaggccgggatagcggcggcgcaggttttctacttcgccgataaagccctgttcaagcatcaggtggaaacgcagggcgatgttttcatgcaggcgggcacggttttcgggaatcagggcggcggtatgcaaatcaaaagggagcgtatgggaggtcaggctgccgagatgtgtgctcatcggtttgccggttaaataataaacttccaaagcgcgtccgatacgctggctgtcgttcggtttcagacggcatgcggtttcagggtcgactttttgcagggtgcggtagaggaaatccaagccgtacatctgtttttgttcgtccaagtcggcacgcaggcaggcgtcggcttcgggcaaatcgttcaaaccttgggtcagggcgcggaaatacatcatcgtgccgccgacaataagggcaaacctgccgcgtgaggaaatttccccgaccaagcgcgtgcagtcttcgacaaagcgggcggcgctgtatgattcggtaggcgggatgatgtcgataaggtggtgcgggacaaaggcgcgttcggaggcggacggtttcgccgtgccgatgtccatatcgcggtaaaccagcgcggaatcgaggctgatgatttcgacaggcagggtttcggcaattttgagggcgagcgcggttttgcctccggcggtcggcccgagcagggcaaaggctttcggggtcggcataacgtttcaggtttggaaaaatacggattatagcggaaagcgtgccgacgttatattttggtttgcggaagcacgccgacggcaagggggcgtgtttaccgtatgcctttatatagtggattaacaaaaaccagtacggtgttgcctcgccttagctcaaagagaacgattctctaaggtgctgaagcaccgagtgaatcggttccgtactatctgtactgtctgcggcttcgtcgccttgtcctgatttttgttaatccactataaaatttcaaaccgacgcgccgggttttcaatatgcccgcgcccgatgccgccttgtccgcaggcatcagcggcagtgtccgattttttggggaatgcccgtcccgggcgtatttaaaggttcggcggtgcggcgttttcctgcggcaaggcttcagacggcatctctggtgcgtccgttagacaaggcgtgcgcttggggcgataatggcgttttgcttttttgaaagccttgcaatgtcccgaaacctgcttgtccgctggcttgccgtctgcctcatcccgttggcgacgcttgccgttttcgccgccaatccgcccgaagacaaactccagcatctgatcaacggcatcatccttgcctgcgaagcgacgtttttgtttaaattcgtccttttcgacaccatcaagcatcatttgaaacaagagtttgatttgaaacgtcaaactatgttgctgtttattccgattattttgctgattgtgtatttgttccactattttggcgcgttttagcccgtttccgttatttctatgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcgcctgttcccgatgtcgtcatcgaaacttttgcctgcgacctgcccgaaaatgtgctgcacattatccgccgacacaagccgctttggctgaattgggaatatttgagcgcggaggaaagcaatgaaaggctgcatctgatgccttcgccgcaggagggtgttcaaaaatatttttggtttatgggtttcagcgaaaaaagcggcgggttgatacgcgaacgtgattactgcgaagccgtccgtttcgatactgaagccctgcgagagcggctgatgctgcccgaaaaaaacgcctccgaatggctgcttttcggctatcggagcgatgtttgggcaaagtggctggaaatgtggcgacaggcaggcagcccgatgacactgttgctggcggggacgcaaatcatcgacagcctcaaacaaagcggcgttattccgcaagatgccctgcaaaacgacggcgatgtttttcagacggcatccgtccgcctcgtcaaaatccctttcgtgccgcaacaggacttcgaccaactgctgcaccttgccgactgcgccgtcatccgcggcgaagacagtttcgtgcgcgcccagcttgcgggcaaacccttcttttggcacatctacccgcaagacgagaatgtccatctcgacaaactccacgccttttgggataaggcacacggtttctacacgcccgaaaccgtgtcggcacaccgccgtctttcggacgacctcaacggcggagaggctttatccgcaacacaacgcctcgaatgttggcaaaccctgcaacaacatcaaaacggctggcggcaaggcgcggaggattggagccgttatcttttcgggcagccgtcagctcctgaaaaactcgctgcctttgtttcaaagcatcaaaaaatacgctagaatagcgcgttttacgacaaccgatttgattggaaaatcacaatgaaaacagcacaagaactgcgcgccggcaatgtatttatggtcggcaacgatcctatggtcgttcaaaaaaccgaatacatcaaaggcggccgctcttccgccaaagtcagcatgaaactgaaaaacctgctgaccggcgcggcttccgaaaccatttacaaagccgacgacaaattcgacgtggtcatcctgtcccgcaaaaactgtacgtacagctactttgccgacccgatgtacgtctttatggacgaagaattcaaccaatacgaaatcgaagctgacaacatcggcgacgcgttgaaattcatcgttgacggtatggaagaccaatgcgaagtaaccttctacgaaggcaaccctatctccgtagaactgcccaccatcatcgtgcgcgaagtcgagtacaccgagcctgccgtcaaaggcgatacttccggcaaagtgatgaaaaccgcccgcctggtcggtggcaccgaaatccaagtgatgtcttacatcgaaaacggcgataaagtcgaaatcgacacccgcaccggcgaattccgcaaacgcgcctgatttgccgcattgaaaaatgccgtctgaaaacgtttcagacggcattttttttatattcgccccgtgtttggattgaagtagatgtttttttcgtaaacgacaatacgcgtgattttgccattttcgtcaaaatggatgtctaaaaacggtttgtcgggattgcgttcacggttggacagccggaagagtgattggttttcaagcatttctccgtgtattttcagatagccgggcaattggctgatgtattggaaattgccgccaagtccgttgttgtgccggctcgaataggcaggggttgccgaaacttcaaaataacgcgtgcgtttcggctcctcgccttgtccgcgggtttcttgactgccctgtatcagcaacagcgtcgcttctcggaggcggcgttcctgttccatcaaggcattttgtgcctgccggctgatcgtgcgctttccgtaacgcaagtcttcaattgccagtatgattttctgatggtagtcgggatcttcagggcggatgtcgggaaacagcagccgctgtatgttgtcatagccaccgtcgggtaagccgaaacgggtttccagttcgtgatgggaaagggcaaacagacagtccgagtcaatgtgttcggcgatttgctgcatgagatcgtcaatgccggtggcggggtgcaggctggtgcaatttgacggcggcgcgctttctgcctgcttgacgttatcaggggcggatgcggtcggttgcaaatcggtttgggaaggagctgatgacgcggaggacgaagcagcggatgcaccgacttctttggttttatcgtctttgctcggagaacacgcggtcagcatgattgcggtaagccataagagaagtgatgaggttttgtttttcattctattgtttccagtattaaagaggccgtctgaaaacctaccgtttcatttttcagacggcctgttgttaatagaaccgaagaacctgttaatgccgacaaggttctcaacctgtcttacccgacgcggtaaaacgccaggctgcccaaaaggttggggaaatgtttgacctgtctgttgcccgtcatcacggcgcgctcgaggatgcggatgttgtttttggcgcacaataaatcaaagtctttgagcgtgcaccaatggatattgggcgtgtcgtaccaatggtagggcatacgttcggaaaccggcatatgtccgccgagtgcgatttggacgcggttgcgccagtagccgaaattcgggaagctgacaatcgcctgtttggcaacgcgcatcaggcagcgcaggattttttcggtattctgcatcgcttggatggtttggctcaacacaatcacatcaaaactttgatcgttgaatgcggttaaaccttcttccaaatcggcttggataacatttacgccgcgcgacatcgcggcgatgacgctatttgtgtcgatttcgatgccgtagccgctgcattttttgtgttcgaccaatgcggcaagcagttcgccgtcgccgcagcccaagtccaagacgcggctgccttcgggtatccggtcgtaaatcagttgcaaatcatcgcgcaggttcattgctgacattccttataaacgttgttcatataggcggcgaccgcacgcatataggcttcgtcttccattaaaaaggcatcgtgcccgtgtgcggatttgacttcgatatactgcacggatttttgggcggcaatcagtgccttgaccagttcgtgcgaacgttcgggtgcgaaacgccagtcggtgctgaagctggcgacaaagaatttcgctttcacattttgcagggcgcgggtcaggctgtcgccgaaatctgccgccggatcgaaatagtccaaagccttggtcatgagcaggtaagtgttggcgtcgaaccgtccgacgaatttgtcgccctgatagcgaagataggattccacttcaaattcaacaccaaagccgtattgataaccgttggaacgcaaatcgcgtccgaattttttgcctaaaccgtcttcggcaagataagtgatgtgtcccatcatgcgggcaatccgcaagccccgtgcaggaacggtattgtggctgcggtaatgtccttcattgaaatcagggtcggtcaaaattgcctgacgcgccacatcgttaaacgcgatattttgcgtggacagtttcggcgcagacgcaatcactaaagcatggcgcacgcgctcgggataggaaatcgtccactgcaaggcctgcataccgcccaagctgccaccgacaatcgccgcccattgttcgataccgagatagtcggcaagcgcggcttgggattttacccagtccttcaccgtaaccaccggaaaatccgcgccgtattccctgcccgtttcaggattaatcgacaaaggcccgctgctgccgtcgcagccgcccagattattcaaaccgaccacgaaaaaacgttccgtatcaatcggtttgccaggtccgaccatattgtcccaccagcccgtatatttatcttccgccgaatgcctgcccgcaacatgatggttgcccgacagcgcgtggcagattaaaaccgcattgtttttttcagcattcagctcgccgtaggtttcaatcatcagatcgaaacgcggcaaagttttaccgttttccaaaaccagcggcatctcaaacggaattttttggggcattacaatgcccaccgaggcattttgactcatatcctgttccaacaaatgcggcgaaaagcgttattatatcgcaaacggcatgactttttgacacggtcggacaagcagccggacgcgtttgaccctcatccgccgcacacgaatcatactttttcagacgacctccaccgcttcccgacatgataggcagacttttccgtatttttttctttttcgcacttgccgcgttgattatcaaccgccttttcagccgcaggcaaaaacgcgccctgcgcgaagtcgccgaaatcagcgcatgggtactgctcggtgcagccgccgcgatgctgttttggtatctgtttatgctgtatttcaaacacattccggattcgtattgacggaaaaaatgccgtctgaaacgcatttttctgtttcagacggcatatttgatgaaaagggcttgcggtaggaggtgctttatagtggattaactttaaaccagtacggcgttgcctcgccttgccgtactatttgtactgtctgcggcttcgtcgccttgtcctgatttttgttaatccactatacaaccgaagcaggaagggcagggggtcagcgttggcgcgctttaaaacgcggattgcttttgcagatgacgtaaactttgcccctgcgcctgacgatttggcagtcgcggtggcgttgtttggcggttttgagtgaagacagaacctgcattatttgtcctttctaaacgatgacattacggattggaaacgttggttgaatttgctggcacggccttcggtgttgacgttgcgctgtttgccagtatagacgggatgggatgcggaagaagtatccagcgaaaacagcggatattctttgccgtctgtccaaaccatcgtttttccgtgtgtttcggcacaggagcggattaaccagccttcattggcgctgctatcgaaaaaattgacggttcggta

SEQ ID NO: 65 - DNA, 35133 bp, Neisseria meningitidis
gtgctgtaaattatagtttggtgtgttaaacgcagttaacaatattttgctggattatactgaattcacagggtctttccaatcgctatcattgaaaatatgaaaaaatttgccaacggtatctgtataaaacaaataatcctttgaaaataattgtttatcctcaagaaaactctccttatgccgccatacgccgcctgccggcgcaagataacctttgccaatttgcagaatttacgttaaccttgcgttttccgcacccatagctcagttggaagagtgtcagtttccgaagctggaggtcacaggttcgatccctgttgggtgcgccaattataaagagaccgtctgaaagataaatatttttcagacggtcttttgacttacttcaaactcttatttcaagacttccgcaaatgcgcgggcaacatagtcggtattcgacgtattcagtccggcgacgcacatcctgccggaatccagcaggtaaacggcaaattcgtcgcgcagcctgcggacttgttccacgctcaatcctgtgtagccgaacatgccgcgctgtttgatgaaataagtgaaatcgcgattggggatttgcgcagttaagacatcataaagtttctgccgcatcgcacggatgcggtcgcgcatcatataaacctcgttttgccacaaggcgtaaagttcggggctgttcatcacgtcggcggcgatatacgcgccgtgcgcgggcgggctggagtagatgcggcggacggtgaatttgagctgtccgaacaccaaatccgcttcttccttattcgggcaaaccacgcttaagccgccgacgcgctcgccgtagagcgacaggttttttgagaaggaattgctgacgaacaagggcaattccatttccaccgctttgcggacggcgtaggcatcgctgtccaaatcgccgccgaatccttggtaggcaatgtccataaacggaatcagtttgcgcgttttgatgatgtgcaacacttcgtcccattgccgttccgacatatccacgccggtcgggttgtggcagcagggatggaggatcaggacgctgttttcgggcagggtgttgaaaaacgcggtcatttcgtcgaatttcacgccgacagtggcagggtcgtaatatgggtaagtgccgacctcgaaacctgcgccttcaaaaatgccgcgatggttgtcccaagtcgggtcgctgacgtaggcgcgcgcttcgggaaaccagcggtgcaggaagtccgccccgactttgagcgcgcccgagccgcccaaggtttgtacggtaacgatgcgcccttgcgcaagcgcgggattgtctttgccgaacaataaatgctgcaccgcgctgcggtaagtgtccaagccttccatcggcaggtagggcgacggcgcaggcgcggcggcacgggcggtttcggctcggctcacggattccaacacgggcattttgccttcgtcgtcgaaataaatgcctatgctcaaattgactttttcggggcgcgggtcgtttttgaaggtttcgaccaaactcaaaatcgggtcgccaggatagtattcgatgtgtcggtacatagtccttacctcttgctttttcaaaggattttctttttcaacaatacaccactttcgatatggtgcgtaaacgggaattggtcgaacagggcggcacgttcgaccgcatgggtttccgccaaggtgtccaaattggcgcgcaacgtttcgggattgcaggaaatgtagatgatgttgtcaaactgcgacaccagcttcaaagtttcctcatcgataccggcacgcggcggatcgacgaaaatagtggaaaatgcgtaatccgtcaaagcaataccgccatccttaaggcgtttaaactcacgttttccggtataggcttcggtaaattcttcagcagacagacgggcgattttgatgttgccgatgcggttggcttcgatattccattgcgccgcgctgacggaggttttggagatttcggttgccaaaacctgtcggaaatatcgggacagcggcagggtgaaattgccgtttccgcaatacagttcgagcaggtcgctgcccaagccttccgccgtgcggcacgcccattcaagcattttctgacacacggcggcattcggttgggtaaaactgccttcaatttgccgataacggaaatcccggttgccgaccttcaaagtttccgttacatagtcctgttttaagactattttctgtcccctgctccgcccaataacggaaatatccaactgttgctgtaacgcttgcgccgcctgcatccactcagcatcaagccttttgtggtaaatcatggtaaccagcatttccccgctgagcgtggacagaaattcgacggcataccagcgttttttgagttcgggggattgcgcggcggcggcgatcagctcgggcatgaggcggttgacagcctcggaagctgcttcaaaacggtcgcagcgtatcatgcttgcgccgctggctttctgccctttttcaaacatggcataaaacatttccccgccttcgtgccaaatacggaactcggcacgcatacggtaatgtttgtccggagattcgtacacttcccactcaggaacatccaaacctgcaaaaagggttttaaggtagtcttttttaccttgaagctgctgcgtgtagtcattcatatcgctatcctgaaaaatcagaccggattataagccgatttgcctcgccgcacgcaaactctttgactgccgccccttcaatgacggacgggcttttgtgctaaaatccgccatctttccacactataccgataaagggaaaaatcatggcaggcaacactttcggacaactcttcaccgttaccaccttcggcgaaagccacggcgcgggtttgggctgtatcatcgacggctgcccgcccggcttggaattaagcgaagcggatatccaatttgacctcgaccgacgcaaacccggcaccagccgccacgttacccaacgccgcgaagccgaccaagtcgaaatcctctccggcgtattcgaaggcaaaaccaccggcacgcccatcgccctcttaatccgcaataccgaccagcgcagcaaagactacggcaacatcgccaccagcttccgccccggccacgccgactatacctattggcacaaatacggcacgcgcgactaccgcggcggcggcaggagctccgcccgtgaaaccgccgcccgcgttgctgccggagccgttgccaaaaaatggttgaaagaaaaattcggcacggaaatcaccgcctacgttacccaagtcggcgaaaaagaaatccggtttgaaggctgcgaacacatttcccaaaatcctttttttgccgccaaccatagccaaattgccgagctggaaaactatatggacagcgtgcgcaaatccttggattccgtcggcgcgaagctgcatatcgaagcagccaatgtccctgtcggcttgggcgaacctgtttttgaccgcctcgatgccgaaatcgcctacgcgatgatgggcatcaacgccgtcaaaggcgtggaaatcggcgcaggttttgacagcgtaacgcaacgcggcagcgaacacggcgacgaactgaccccgcaaggcttcctgtccaaccactcaggcggcatcctcggcggcatcagcaccgggcaagacatccgcgtcaatatcgccatcaaacccaccagctccatcgccaccccgcgccgcagtatcgacatcaacggcaaccccatcgaactcgccacgcacggcaggcacgacccctgcgtcggactgcgctccgcgccgatcgccgaagccatgctcgcgttagtcctcatcgaccacgccctgcgccatcgcgcgcaaaatgccgacgttcaggttaatacgcccgacattaccctttcaaacaaataaaaatttagccaaaacacagactttataatagaatatcgagcattgccgtgcagccttgacgcacgggtttgtttagaggaatacaaccgaaatgacacaagaaaccgctttgggcgcggcactaaaatccgccgtccaaactatgagcaaaaagaaacagaccgaaatgatcgccgaccacatctacggcaaatacgatgtattcaaacgcttcaaaccgttggcgctcggcatcgatcaggatttgattgccgctttgccgcaatacgatgccgcactgattgcacgcgtcctcgccaaccactgccgccgtccgcgctatctgaaagccttggcgcgcggaggcaaacgtttcgatttgaacaaccgtttcaaaggcgaagttacccccgaagaacaggcgatcgcgcaaaaccatccttttgtgcagcaggctttgcaacagcagtccgcccaagctgccgccgaaacgctgtctgttgaagccgaagcagccgaatcttccgcagcagaataaatccccaaacgaaatgccgtctgaaaaccgatttggtttcagacggcattttttcgtatgcggcaatcacggttcaaatatccaattccgccgtatcgccttcgcgttccatccaagcgcggcgggcggcggcttcgcctttgcccatcagtttgacgaagatgtcgcgcgtctcgtcatctgcaccttctgggatttgtacctgcaacaggcggcgggtgtcggggtgcatggtagtatctttgagctggtcggggttcatctcgcccaagcctttgaaacggctgatggaataggcggtttctttaacgccttctttttgcagccgctccaaaatgctgtcgagttcgttttggtcgagggcgtagaatttgcgggcaggtttgctcttaccttgtgcgttgacatcgacgcggaacagtggcggctgggcgacgtagatgtgtccgtcggcaaccagtttcgggaagtggcggtagaacagggtcagcagcaaaacttgaatatgcgagccgtccacgtcggcatcggacaggatggcgattttgccgtagcgcaggccgcttaaatcgggatggtcgttaataccgtgcggatcgacgccgatggcgacggaaatgtcgtggatttcggcgttgccgaagagttggtcggggtggacttcaaagctgttgagcactttgccgcgcagggcaggatggcttgggtggctttgtcgcgggcgagtttggctgagccgccggcggaatcgcgttcgacgaggaagagttcgttttcgcggatgtcttcgctttcgcagtcggtcagcttaccgggcaggacggcgacgcgctgccttttttcttttcaatctttttaaccgaacgcatccgcgcctgtgcttggcggatggcgagttcggcgatttttttgccgaagtccacgttttggttcagccacaattccaaagggtcgcccgatacggtggcgacgagtttcagcgcgtcgcggttggtcagcttgtctttggtttgaccttggaactgcgggtcgaggacgcgggcagagagaacgaaggcggtttttccgaacacgtcgtcgctttgcactttaacgccgcgcggcaagaggttgtgcagattgatgaagttgttgactgcgttgaacacggcttgtttcaagcctgcttcgtgcgtgccgcccagcggggtggggatgaggttgacgtagctttcgttggcgcacgagccttcttccagccaagtcagggcaaacgccgctccttcgccgatgctgaaatcgccgttgtgttcgtctgaaatgtagttttcgcaagagaacagcggtacggcttcctgcgcgtcggcaatcaggtcggtcagatagcttttcaggccgtcggggtaatgccaggtttgggtgtgcgcttcgtcttcgcctttgaccggacgggtcagggaaacgcgcacacccggcagcagcacggctttggcacgcagcaggcgttcgagttcgggaatgctgtaattcgggctttcaaaatatttgccgtccggccagacgcgcacttctgtaccgctgtctttgacggcgcatttgcccacttgtgccaacggttcgaccacgtcgccgccggcaaacacgatgcggtggattttgccttcgcgtttgaccgttacttcaaggcgggtggaaagggcgttggtgacggatacgcccacgccgtgcaggccgcctgaaaaggcatacgcgctgcctccgtcttttttgttgaacttgccgcctgcgtgcagacgggtgaatacgagttcgactacggatacgccttcttcgggatgcaggccgacgggaatgccgcgcccattgtcgtgcacggaaagcgaaccgtcttcatgaatttgcacgtcgattgcagtcgcgaaaccgcccaacgcttcatccgacgcgttgtcgatgacttcttggcagatatgggtcgggctgtcggtgcgggtgtacataccgggacgttctttgaccggctccaagcctttgaggacggtgatgctggattcgctgtattggttgtttttagccatgggaataatctgaaagtaagaaaaacaacgctttcagacggcctgaaagcgttgcgttccgttgttttagcggttgtcggaagattggcgggcggcaaagtcttcataactttccataccgcgcaggaagcgggaagagagttctttcaacgcccccaaataaacgtcgcgtttgaaatcaatcacttcgtcaacgggtgcccaatattgatgccaacgccagccgtcaaattcggggtggcgggtggcgcgcaggttgacatcgcaatctcggccggtcaggcgcaggagataccaaatctgcttctgtccgcgataagagccgcgccattcgcggcgtacccagttgttcggcacgtcataacgcagccagtcgcgcgtgcggccgataattttgacgtgttgcggcaaaagcccgacttcttcgtacaactcgcggtacatggcggtttcggggctttcgcccggcttgatgccgccttgcggaaactgccaagaatgttcgcgcacgcgcttaccccaaaagacttcgttgcggttgttgattaagatgataccgacattggggcgatagccttccctgtccaacacggtgtcgccctccgttaaattcaatcttgggattttcccacaaatcaggcggttttgacaaatcagacggcatggcggtacgcgtgccgaaacacggggggatttgggaaaatatcttaaatttggtttacaataatgtatttcaaattattcgggaatcagaccatgttagatatccaattgctccgcagcaacaccgccgccgttgccgaacggcttgcacggcgcggttatgactttgataccgcacgttttgacacactggaagaacgacgcaagtccgttcaggtgaaaaccgaagaattacaggcctcgcgcaacagcatttccaaacaaatcggcgcactgaaaggtcagggcaaacacgaagaagcgcaggcggccatgaatcaggttgcccaaatcaaaaccgatttggaacaggctgccgccgatttggatgccgttcaaaaagaattggacgcatggttgttgagcatacctaacctgccgcacgaaagcgtacctgccggtaaagacgaaaccgaaaacgtcgaagtccgcaaagtcggcaccccgcgcgaatttgactttgaaatcaaagaccatgtcgatttgggcgaacctttgggtttggattttgaaggcggtgcaaaactctccggcgcacgatttaccgtgatgcgcggacaaatcgcccgtctgcaccgcgccttggcacagttcatgctggatacgcacacgctgcaacacggctacaccgagcattacacgccttatatcgttgacgatacgacgctgcaaggtacgggccaactaccaaaatttgcggaagatctgttccacgttacccgtggcggcgacgaaaccaaaaccacccaatacctgattccgacagccgaagttaccctgaccaataccgttgccgacagcattatcccgtccgaacaactgccgctgaagctgaccgcgcattcgccctgtttccgcagcgaggcgggttcgtacggcaaagacacgcgcggtctgattcgccagcaccagttcgacaaagtggaaatggttcaaatcgttcatcccgaaaaatcatacgaaacgctggaagaaatggtcggccatgccgaaaacatcctgaaggctttggaactgccctaccgcgtgattaccctgtgtaccggcgacatgggcttcggcgcggcaaaaacgtatgacttggaagtttgggtgccggcgcaaaatacctaccgcgaaatctcaagctgctccaactgcgaagatttccaagcccgccgcctgaaggcgcgtttcaaagacgaaaacggcaaaaaccgcttggtacatactttgaacggctccggcttggctgtcggcagaacgctggtcgccgtattggaaaaccatcaaaacgccgacggcagcatcaacatccctgccgcactgcaaccgtatatgggcggtgttgccaagttggaagtcaaataagtttgcaggctgcctgaacgtcaaatgccgtctgaaacctgtttcagacggcatttcctttaaacttttaaaacacgtcagccgtcggcacgaaccgcattgccgcaatcgccggtctgtccgacctcgcggatattggacagcgtaacttccgaaatattacccaacgcctcttccgtcaaaaatgcctgatggccggtaaacagcacattatgacaagacgacaggcggcggaacacgtcgtcggtaatcacatcgttggatttgtcttcaaaaaacagctcgcgctcgttctcgtacacatccatgcccaatgcgccgattttccggcgtttcaacgcctcaatcgcggcggcactgtcaatcagcccgccccggctggtgttgataatcatcacgccgtctttcattttgtcgaacgccgcttcgttcagcatatagtggttttccggcgtggcggggcaatgcagcgtgatgatgtccgaccgggcatacagctcgtctaaatccacatatttgccgccgattttttccgcttcggggttgcaaaacggatcgtaagccagcaggttcatgccgaaaccctttaaaatccgcatggttgcaataccgattttccccgtgccgataacgcccgccgttttgccgtacatattgaaaccggtcagaccttccagcgaaaaattcgcatcgcgggtacgctgataggctttgtggatacggcggttcaacgtcagcatcagaccgaccgtatgttccgcaaccgattcgggcgaataggcaggcacgcgcacgactttcaagcccaactcttcagccgcctttaaatccacattattgaagccggcacaacgcaacgccacagttttcacgccaatttgcgccaatttttccaacacgggccggctgccgtcgtcgtttacaaaaatacagaccgcttccgcgccttccgccattttcgccgttttcgcatccagcataaaatcaaaaaactccagctcgaagccgaaatgccggttggcgcgggtaaaatgttcgcggtcatagcttttcgtaccgtaaatcgcaatcttcatcaatatgtccagttgtcgtctatggttgagaaacggcataatacactgaattcaaacaaatcagtagaatatggtggattaaaattgattgcatgcacggcatttccatttcaaaacacaaaactcaatcgcccattgccgccagaagctcggcctgatgctcggcaatcagggcattggtgatttcttccaagtcgccgtccatcacaaaatccagcttgtgcagggtaaggttgatgcggtggtcggttacgcggccttggggatagttgtaggtgcggatgcgttcgctgcggtcgccgctgccgatgagggatttgcgctcggcggcttctttggcttgggcttcgcgtttttgcgcgtcgttcaggcgggcggcgaggactttcattgcctgcgctttgttggcatgttggctgcggccgtcttggcattcgaccaccatgccggtgggcaggtgggtgatgcggacggcggagtcggttttgttgatgtgctgaccgcccgcgccggatgcgcggaaggtgtcgatgcgcaggtcggctgggttcagttcgatgtcttccagttcgtccgcttcgggcatgacggcaacggtgcaggcggaggtgtggatgcggccttggctttcggtggcggggacgcgctgcacgcggtgtccgcccgattcaaatttcaaacggctgtacgccccgagtccgacaatacgggcgatgacttctttatagccgcccaattcgctttcgttggcggacacgatttcaacctgccaacggttgcgctcggcgtagcggctgtacatacgcagcaaatcgccggcaaacagcgcggcttcgtcgccgcccgttccggcgcgtatttcgatgaagatgtttttgtcgtcgtcggcatctttgggcagcagcagtttttgcagttcggtatcgagttcgccgattttggctttggccgcttcgatttcttcggcggcaaagtctttcatttcggggtcggacaacatttcttcggcatccgccaagtcgctttgggcaagccgatagttttggaacacttcgacgacgggggtcagttcggcgtgttcgcgcgtgagcttgcggtagttgtccatgtcggacgtggcttcgggctgtccgagaaggtgggtaacttcttccagtcggtcgctgagttgttgtagtttttctaagatagacggcttcataattcttccataacaaacgccgcctgaatgttcagacggcatcaacactggattattataataggttttccggatattcaaaaagataatcttagatggataacctaccgtcccaacagggcatcggcattgcgctccgttacctttgcaatctcttctacacaggttccgcggatttccgcagcaatctttgcaatacccggaatattggcaggcgtattaatctcttttttcagcataaacgggctatccgtttccaatacgaaatccccgtcgttcaaggctttaagcgtatcgcgcactttacgcgcgttcggattgagcagcagcgaaccgatgccgattttgaaacccagtttcgtcaacacacgcgcttcttccgcgctgccggagaaggcgtgaacgatgccgccttgggcaaagcctgtctgtttgacggcggcggcgatgtcggcggtggctttgagattatggataatcacgcggcggcgcagggtttgcgcaatttcaagctggcggacgaaaacttgaatttgccgttcgcgctgctgcgacgtttgggttttatcgtaaaaatccaagccgatttcgccgacccatgcctgcggataatgtgccaacatcgtttccaggcggacgaaatcccgctcggcaatgccgtctgaaaaccaaggatgaatgcccagtgcaatacggatttgaccgtgttcggacggcatttccgccaaatccgccacgtcctgccaatcctgcgggcgcgtcgcgggaacgataaaccgcttcaccccaactttccgcgctgcggtcaggatgtgcggcaggttttcgcgcagggcgggatcagcgagatggcagtgggtgtcggtgaagttcatttcgatttcacactaactttagtcttaccaattctttgtaaacatcttccttaccccagccttgcgatacggcgagggtcatcagcgcggtggcggtttcgaggttgcatttgccgccgttgatgatgcccgagttgcggaacgcgttgccttgcgcgtaaacggcggcggttttgccttgtcggacttggctgatgttgagcagcagtttgccctgccgcgcgaagtctcggacggcgcggataaaaccttcgtctgcgggcgtgttgccgtgtccgtagctttgcaggataagagcttgggcgggaagctgtccgagtccgtccgcaagttcttggacggcaaagccggggataagcgtgcggacagcgatttttgcctgcgggtcgggataacggattttgaggccgtctgaaacggctgctgcgtcttgggacgggaggcgaagattgtgccaaccccgggtttcgtcccattcggcaagcgtgccgaaatgcggattgtcgaagcctgcagcagtttcggtgctgactttgctgctgccgacggcgggatacagtttgccgtcaaacgcgatgacggtttgtttgagcttgaggctgaaggcggcaacggcggtggagaggttgcgcggggcatcgctgttttcggcggcgtaaggccattgggaaccagtcaggacaatcggtttgcccaaaccttgcagagcgagcgcgaggagattggcggtgtacgccatgctgtccgtgccgtgcagtatcaggatgccgtcgcatgaagggagtttgtcggcaatgatgtccagccaatcgcgccagtgttgcagcgtaacggaggaggaatcaatcaagggattgcagacgtgccactcgaaatcgaggccgtctgaaaagggggaaagggcttggctaaccagtgcggtatcggggcgcaggccttcgctgctttgggtcatgcctatggtgccgcctgtgtagaggacgaagattttttgtttcatggacatcatcgggtcgtctgaaaataataatacggcttatttaactatatttcggacagactggcaatttggcggcgcggacggttttcagacggccttcaaatgaaaaagcacccgagggctgtcgatatttgattttccaagtagatttttattcacgaaataggagagccgcaacaagcttaaatcccttgtgaggttcccaacacggaagataccgctttgtggattaaaaaatacggaaactattgaatatcgacaacctatttaggtgcttgattttattgtttgctttgcgcggcttttttggctgccttggcggctttgcgttgcgcccgcttttctttcaatttgctgcggtaaaactggatacgttggcgttttttccaccaaatccaagcgacaacggtcgcacctatacccaagataacaaaaatacccgattgcaggctgtgcattttcgccatcagccaatcgatgttgtgcgcaccgtattcgcccagataaatccaaatagggacggaaatcagtgcggccagtccatccataatgataaaacgcaagtatgaaaccttgcggctgataccggctgtaacaaatacggccgttctcaaaccgggcaggaaacgggcgacaaataagacccagttaccgtatttgtcgaatttttcctgaacctgctcataacgtttcggcgtcatgatgcgcgcaataggtttgaaccttaggattttctgcccccaaattcgtccggcggcgaacatgatgccgtccccgaccaatacgccgagcataccgactgcaaacataatatgcggattggtataacccatacccgaaatcacgccgcctgttaccaaggtcaaatcctcgggaatcggcacgccgaaaccgcagatgaccaatacaaaaaaaacagccgcataaccgtattcgacaaaaaaggcttctaaaaaagcaaacatggcggatattccattgtcggagataaaaagtcagaacaaaccgaaacattttctacatgaagcaggcattctatcaaagattatgccgtctgaaagcggaaaaaaggcagattcgcgcatcctccgcatgttcagacggcatttaaacagaaaaccggccggttctaaaaacggttttgcctgattttgcctaaatgccgccgatggcggcggcaatgcgttccgccccttcgcgcgcccaatccgcctgccgcgcctccaccatcacgcgcacgacgggttcggttcccgaagcgcgcaacacgacacgccctttgccttcgagttctttttccacttccgccaacacgtctttcgaagcttcctgccattgctgacctttttggatgcgcacgttaatcatcgtttgcggatacggctgccaatcggcgcaaacggtggcgaggtcttggttcagcgtttgcagtgccgccaaaacttgcagcgcggaaataatgccgtcgccggtgttgtgtttgtccatacacaaaatatggccgctggcttcgccgccgatgagccagccgcgttggttcagctgttccaacacatagcggtcgccgactttggcgcggcagaaatccacgccctgctctttcagggcgatttccatcgccatattggtcatgaccgtgccgaccacgccgccgatgttgataccttctcgggcgcgggctttggcaatgacgtaaatcaggctgtcgccgtcgtaaacctgcccgtttttatcgaccatcatcaggcggtcgccgtcgccgtctaaggcgatgccgtagtcggcttcatgctgtaaaacggcggcctggagtgtcttggtataagtcgcaccgcatttttcgttgatgttgtagccgttgggttcgttgccgatgctgacgacctgtgcgcccagttcgtgaaacaccttgggggcgacaccgtaccccgcgccgttggcggtatcgacaaccaacttcaaaccccgaaggtcggaatggctgggaaaggtggatttgcaaaattcgatatagcggtcgtccgcaccgctgatgcggcgtgcgcgaccgagacgggcggacggttgggttttcatttcgccgtcgattttggcttcgatttccaactcgacttcatcggaaagtttcacgccgccttcggcgaagaatttgatgccgttgtcggaataggcgttgtgcgacgcggaaatcatcacgccggcggacaggcgcaacgcgcgggtcagataagccacgccgggcgtgggcagcggtccggtctgtaccacattcacacccgccgccgtaaaaccggccaccaaagcggcttccagcatatagccggaaatgcgcgtgtctttgccgatgaggacggtcggtttctggtcggtgtcgtgctgcaccaaaacctgccccgccgcatagccgagtttcaatacgaaatcgggcgtaatcggaaattgccccacttcgccgcgcacgccgtccgtgccgaaatatttttttgccatgtgttgctccgagaatgtgaaccgttgtccgagattatacagtcagtttgtgccttgctgtctgcaccgttgatgccgtctgaaaccgccccgtccttttcagacggcatgaagtatgtgaaccgctgtttacagattgatgcccaacgcttcccacaccttcaacgcatccgctgtcgccttcacatcatgcacccgcacgatttgcgcgccgcgcgctacggaagccaacgctgccgccacgctgccgtgtacgcgttccgccgcatttgcctcgccggtcagctcgcctatcgtgcttttgcgcgatacgccgatgagcagcggaaaacctgtttccgccatcaattcgggcaaatgccgcatcagcgcgatattgtgttgcaagggtttgccgaagccggagccgaagccggggtcgagtatgatgcgttgcggtgcgatgcctgccgcgatacattccgctgagcgcgctttcaaataccgcgctacttcaccgacaacatcttgatatttcggattaatctgcatggttttgggcaaaccctgcatgtgcatcaggcaaatgcccgtgtccgcctgacgcgccagcaattcgaccgcgccctcgtcattcaacgccgccacatcattaataatatcgatgccgccgagtgccaacgctttttccataatcaccgtgcggcgcgtgtccaaactgatgggaacgccccaccccgccacttccgccaaaacaggctcaacccgcgcccattcttcttcaggcgaaacataatccgcacccgaccgcgtcgattcgccgccgatgtcgagaatgtctgcgccttcttttagaagctgttcggcatgtgccaaggctgtttgggcgttttgcgaatacacgccgccgtcggaaaaagaatcgggtgtgagattcacgatgcccatgattttcggtttgtccaaaccgatttcaaaccgtcctgcctgccaaacgtgtcgtgccatctgaactcctcccaaaataaaaaacagattatatgccgtctgaaaccgtcttgtgcgcttcagacggcaccgctattcgggcggcagacggcatgttgtccgaatgtctgctccgcctttgaatctgccggtatgcctgctatccgcccgacttttcaaaacaggttccgacgattccgcacgcgcctgccgcctttgccaagccgtacaggatttcctgcggcatatcgcggttccataatcccgtaatattcgcaatcacgggcagatggctgatttggcggactttcacgatggattcgacatccaaacggtagggatggcctttggtatggttcaatacgcccgactcgcccagaatcaggtggcggttgccgcgcgagacgacatattctgcggcattcaaccaatcttcggcagaatggtgcttgtctttacacagcaccaagggaatgttcaggtttccggcttcattcaatacggcaagatcggacatcagcccgccgcccaaatacaggatgtccgcccccgcattcaaagccgcttcgacatggcggacgttgcggacgcgcaccaatacgggtttccctgcatcatgcgccgatgcggtctgttccgccaaccgtctgcaccgtccccgcccttcatccgcacttgaagtgtcgtataagtttgccgaagtgaaaaacggatccagaaacactgcatccgcattgcgccatactgacggttctgcggcgatacggacggtttccccgccgccgaaagccacgcctttggcggcaacgcggctgtcttccgcccgattttcccgactgacggttttccatgtatccaaaatgcggacggctttctcgacctccggcagcgtctgcacctccctgacgctcaaaaccctatcgtcgccgattgcgccgatgacagtacgctcgtcgccgtgagaaatgtgttctcgcagacctctgctgcggataaaggcgacaacgccggcaatgtccgcttcggcggcacgcctgctcatgacaataatcatatttcctcctgacacaagaaacggcctacccaaaataggatttttgcaagccgtgttatactgtggcgtgttttacagattgttcgggctatggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaaacatcctgcgtacaaaaatgccgtctgaaacacccccgcgcttcagacggcagaccgtaaaacctacaaccccaattcctcccaaatcccatcaatcttagccgtaaccgcagggtcttttttgatgacgcgtccccattcgcggtcggtttctcccggccatttgttggtcgcatccaaacccattttgccgccgagtccgctgacggggctggcgaagtcgagataatcgatgggcgtgttttctaccaaaacagtgtcgcgcacggggtccatgcgcgtggtgaccgcccagatgacttctttccagtcgcgcacgttcacatcgtcatccaccacgatgatgaatttggtatacataaactggcgcaggaacgaccagcagcccatcatcacgcgcttggcgtgtccggcgtactgttttttcatgctcaccaccgccatgcggtaggagcagccttcgggcggcaggtagaaatcggtgatttcggggaactgcttttgcaaaagcggtacgaacacttcgttcaacgccacgcccaaaacggcgggttcatcgggcggtttgcccgtgtaggtcgaatggtaaatcgggttttcgcgcatggtgatgcgttcgaccgtaaacacagggaaataatcctgctcgttgtaatagccggtgtggtcgccgtacgggccttccaacgcggtttcgttcggatggatgacgccttccaacacgatttctgcgcgggcaggcacttgcaaatcgttgccgatacatttcaccagctccgtccgcgaaccgcgcagcagtccggcaaactggtattcgctcaaggtatcgggaacaggcgttaccgcgcccaaaatggtggcggggtcgcagccgagtacgacggcgacgggatacggcgtatcgggattgagtttgcggaactcctgataatccaacgcgccgccgcgatgcgacagccaacgcataatcagcttgtttttgccgatgagttgttggcggtaaatgccgagattttggcgttttttgtgcggcccgcgcgtgacggtcaagccccacgttaccagcggcgcaacgtcttccggccagcaatgctgaatcggaagttgatacaaatcaacgtcttcgccttcccacacgatttcctgacacggcgcgtttttcaccacgttcggcgccatgctccaaatgtctttcagcagcggcagtttggaaaacgcatctttgatgcctttgggcggttcgggttctttcaaatacgccagcgtctgcccaatttcacgcagcttggacacgctgtccgcgcccatgcccatcgccacacgttcgggcgtgccgaacaggtttgccaacacgggataaccgtagcgcgtaccgtcgggcttaatcgggttttcaaacagcaacgccggcccttcggcacgcagcacgcggtcggcgatttcggtcatttccaaatacggggaaatggggtgtgcgacgcgcttgagtttgccctgctgctcgagcatggcgatgaagtcgcgcaggtctttgtatttcatattcatcctttttgtccttttatcctgaacaatccgattcggataccgcccctatccttgcctgtgcctcggcatattctatgccgtgataaaagtcgcgtaccagcggatgttcgccgccttgatggagttgcaacaaaggacgttgaccatcgggttgggtaacgacattgcagtgcagaccgaaggtgtcggtttcataagggggcagctggttgcagatcatgccgaaataaacagcgttttcaaggttgtcgtaaaagcggctttgatagtcgttaaaactcttttcgctgacggatacccacacgccatattccagcgtttcctcatgcccgataatcggaatcggcagcaccgcgcggataaagcggtcggtttggtcgggatagcggatgatgcagaaatcagaatcgcattctgcttgataagcaatgcgttcttcttcactgagttgattatagggatcgggtgcggtaaagccgattgcgggcatttcttcgtggttttcgccgcaggaagtgcaagtgtacataaggtttcagactttcaaaacgagtttgcggtaaagccattcgccggcaaacagcatccccatcaatacataggcaatcacgccggtataaaccgcccaccaatcatatcgccccaaccgtgccaacaaagcggcaagcgtcccgttgattataaaaaatacgcaccaaacctgcgttacccggcgggtatagcgcacggctttttcaggcaggtcgggctgttgcagccgcgcaagtttttcaatcaccgtctgcccggcaaacaggctgccgccgaacaccgccaacatcatcagattgacgaggacgggataccaatacatcgaatcatgccgcccgaacaccaatactgcggcaaaaaacagtgtaataaacaaagccgcataacgctgttggggcagtttggcagtcagggcgcgcagcagccacaacccgcacatcgccgccgccagccaaacaaaccagcccgcctccctgccgtatatagtggattaacaaaaaccagtacagcgttgcctcgccttgccgtactgtctgcggcttcgtcgccttgtcctgatttttgttaatccactataccacaaagcgggataggcaatgcttaatacggtcagaaaaatatgtccgaaaaaaccgggtttcattttgaatccgcacaaatgttttcagacggcatccgataaaaacatgccgtctgaaaaataattagaaatacccgattagcccgcctgaatcttcaataccgcctgtaccacgtcgttgacggtgcggacattgcggaaatcttcggcctgcagcttgcggccggtttcgcgcttgatgcggtcaatcaggtcgatggcatcgatgctgtcgatttccaaatcttcgtaaagattggtatcaggcgtaatccgttccggttcgatttcaaacaactcggtcagggtatcgcgcaacaaccggtagatttcttgttcggtcatatgtttcatccttatgcttggcggcttttgacaaaggcggcgagtgttttgacattggcaaaatgttcgcgcaagttctcctgctcgccgtccaatcggaaaccgaaatgtttttgcaccgccaagcccaattccagcgcatcgacggaatccagtcccagccctccgtcgccgaacagcgcgtcttcgctgccgatgtcggcggcggttatatcctccaaagccaaactgtcgataatcagttgtttgatttggttttccaagtcgttcatatggttttccttgtaaaatagtcctgcagatattcattcagccgccgcgccgcaatcggcaacggtttctcggcgagccagtcttgggggaggatgtcgtctccgacggtaatttcataccgtatccttttcggggggatgcggtaccacggctgcccctttttaaaattgggcggattcattttgatacatacgggcgtaatcacttcggcataccgcagtcccaaagaaaccgcgccccggtgcatttttacccgtccgtcccaccccgtcctcgttccttcggggaacaccagcaggctctgcccgctgtcaaaaaccgcctttaccgtttccagcattgcttccgactcttcgttcggaatatagcccgcacctttaatctggctgctcattgccggattgtgctgcaaatcttttttcacgatacagttcatttcgggcacatggccgacaagcagcaccacatccagcaaagacggatggtttgccaaaatcaactgtcccgggcggttgagtttttcaacacccttgaacgatacctccaacacgcccgaccatttcagataagcaacgaacaaacgccaagatgttccgataatccggcgcgccgccaattggcgggcgacagaccctgaagtgccgttcaaagtataaggcaacaaaaccaatttcatcataatgccgccgacaccgaaaatcacaaatcctaaccaagtcgcaaaaaaacggcggcaataatccaatttatccattccgctgccacagccattcacgattgcgatatacccggcggcattctcgactgccgttcagcagaaagcgcacccattccaaaccgctccaatatgcctcgggcagcataccggcttcagacggcatatcgtccgaagcagacaaagtcaggctgtaacgcgtccctttggtcagaaccatcgccaaagcataagcaaacggcgcgcgagtcgccgatacggcatatccttccggcagcggatcgtccgccgccaaaaccaaaaccgacccgcatccctcttccaacagtgatgccgcttccgccaatgccgtttccacaccgtcggcacacacggccaatgccgtctgctcgctcatatcctgacgcaatatcgaccattgccccgccgttgcattgtgcaccgacaaaccgaacgaagtcggcgacacggtatgcgatttcaacagttccaaccacaaatcgaaactgcgtgccatttccccgtcgtgcgaggcataaactaccggactgccgggatgggcggaggcaatgtcccaagccgcgtcgcataccaaacgcgccgccttactcaaacggcggcgctgcatagcgggcaggaacggcaattccggcctgacatcgggcaaaccgtcggcaaaatccggacattccgcccattttgcccactgggccatatcgcgcattttgctgcccgaaacccgccaggcggcgatgtcgaagtggaaccggcaaataatcgacggcatagtttctttcaaaaatttacactgtgccgcattctaaccaaagcctatccccctgacaatgccgaaattcaaacgcatttctgccccctttctccgacaacgccgcccctcggaaaaccgccagaattagcctgaatttacatttatcattataatgcccgtatttgccagcctgccgccgcaatatatggacacactgccagaatgcccgattaccaacaccgcctccctgctgccgcacagcgggcgtatggttctgatagaccgcattacccgatacggcgatgattttgtcgaagcaggggcacaggtaagccccaatcacatccttttacttgacgacaaactgccctacacggcatttatcgaactgatggcacaggctgtcggcgcgtatgccggtatccaagcccgaaaaaacgcacggtcggtccggctcggcttcctgctcggcacgcgcaaacttgaaatcttcgcccaatccgtcccaatcggcacgcatctgctggcaacggcgcatatgtctattcaggatgccgggggtatgggcgtgtttgactgcgaactgcgttggacagacgcgccggaaacttcgtccgaaacactcccttcagacggcattttggcgcgcgcctcactcaacgtgtacagccccgaacaccctgccggaacaaccgatgccgtctgaacaggcacacacatacggagaacaacgatgaccgaaactgtcctgattaccggctccaacaggggcataggcaaagccgtcgcattcggtttggcggaagacggctttgatatcgctgtccactgccgcagtcgccgcgacgaagccgaagccgtggcggaagaaatccgcgctttgggcagaaatgcgcgcgtgttgcagtttgacgtgtccgaccgcgaagcctgccgcgagattctgaccgccgacatcgaagcaaacggcgcgtattacggcgtggtgttgaacgccggactgacgcgcgacaataccttccccgcgttttcagatgacgattgggatgtggtgctgcggactaatttggacggtttttacaatgtattgcatccgctggttatgccgatgatacgccgccgcaaagccggacggattgtgtgtatggcatcagtgtccggcctgacgggcaaccgcgggcaggtcaattacagcgcgtcaaaagcaggcattatcggcgcggcaaaagccttggcggtcgaactggcgaaacgcaaaatcaccgtcaactgtgtcgcgccgggtctcatcgataccgatattatcgatgagaacgtacctgtcgaagaaatcttaaaggctgtccccgcagcgcttatggggctgccggaagaagtggcgcacgcggtgcgtttcctgatggatgaaaaagcggcgtacatcacgcgccaggtgattgcggtgaacggaggtttgtgttgaataccagaagggtcgcagtaacaggcataggcggcattaccgccttcggccgggattggcaaagcatacaggcagcattcaaagccgaaaaaaacgccgtcaaatatatggattggcacgaacgtttccccgaattggaagcgcaactgggtgcgccgattgaaaattacgcgccgccgaaacattggacgcgcaagcagctcagaagtatggggcgcgtgtcgtacctgtgcgtcgatgcggcggagcaggcgctggcggatgccggtttgctcggggacgaaagcattaccgacggacggatgggcgttgcctgcggctcttccagcggcagcaccaaagacatcggcgatgtgggcgaattgttgctgaccggcacgtcgcgcaacttcagcgccaacacctatgtgcgtatgatgccgcacaccaccgccgccaatatcggcatctttttcgggctgaaagggcgcatcatcccgacatcgagcgcgtgttcgtccggcagccaaggcataggttatgcctacgaagccatcaaatacggtctgaccgatatgatgctggcgggcggaggcgaagaatttttcccgtccgaagtgtatgttttcgactcgctttatgccgccagccgccgcaacggcgaaccggaaaaaaccccgcgcccatacgacgcgaaccgcgacgggctggtcatcggcgaaggcgcggggattttcgtgctggaagaattggaacacgccaaacggcgcggtgcgataatttacgccgaactcgtcggctacggagccaacagcgatgcctaccatatttccacgccccgccccgacgcgcaaggcgcaatccttgcctttcagacggcattgcaacacgcaaaccttgcacccgaagacatcggctggattaatctgcacggcaccgggacgcaccacaacgacaatatggaaagccgcgccgttgcagcggttttcggcaacaatacgccctgcacgtccaccaagccgcaaaccggacacacgctgggcgcggcggacgcaatcgaagccgcgttcgcgtggggcattgccgaccggcaaagcaatcccgaaggaaaacttccgccccggctttgggacgggcagaacgaccccaacctgcccgccatcaacctgaccggcagcggcagccgctgggaaaccgaaaaacgcattaccgccagctcgtcgtttgccttcggaggaagcaactgcgtcttaatcatcggatgaaataagtttgtcaatcccaccgctatgctatacaatacgcgcctactcttgacgggtctgtagctcaggggttagagcaggggactcataatcccttggtcgtgggttcgaaccccaccggacccaccaattcccaagcccggacgtatgtttgggcttttttgccgccctgtgaaaccaaaatgctttgagaaaccttgataatgaaaaaagtcagcgtattgattgttgccaaaaacgaagcaaaccacattcaggaatgtattgaaagttgccgtttcgataaagaagttatcgttatcgacgactacagcaccgacaatactgccgaaattgccgagggtttgggcgcaaaagtcttcagacggcatttgaatggggatttcggagcgcaaaaaacatttgccatcgaacaggcaggcggagaatgggttttcctgattgatgcagacgaacgctgcacgccggaactatctgatgaaatctcaaaaattgtccaaaccggcgattatgccgcctattttgtcgaacgccgcaaccttttccccaaccatcccgccacacacggcgcgatgcgtcccgacagcgtatgccgtctgatgccgaaaaaagacagttcggtgcaaggcaaagtacacgaaaccgtacaaaccccctaccccaaacgccgtctgaagcattttatgtaccattacacgtacgacaactgggaacaatatttcaacaagttcaacaaatatacttccatttcagccgaaaaataccgagagcagggaaagcccgtgcgtttcgttagggacattatcctccgcccgatttgggggtttttcaaaatttatatcctgaacaaagggtttcttgatggaaaaatgggttggattatgtccgtcaaccacagctattacacgatgattaaatatgtcaaactatattatctgtacaaatccggcggaaaattttaaatggaaaaagaattcaggatattaaatatcgtatcggccaagatttggggtggaggcgaacaatatgtctatgatgtttcaaaagcattggggcttcggggctgcacaatgtttaccgccgtcaataaaaataatgaattgatgcacaggcgattttccgaagtttcttccgttttcacaacgcgccttcacacgctcaacgggctgttttcgctctacgcacttacccgctttatccggaaaaaccgcatttcccacctgatgatacacaccggcaaaattgccgccttatccatacttttgaaaaaactgaccggggtgcgcctgatatttgtcaaacataatgtcgtcgccaacaaaaccgatttttaccaccgcctgatacagaaaaacacagaccgctttatttgcgtttcccgtctggtttacgatgtgcaaaccgccgacaatccctttaaagaaaaataccggattgttcataacggtatcgataccggccgtttccctccctctcaagaaaaacccgacagccgtttttttaccgtcgcctacgccggcaggatcagtccagaaaaaggattggaaaacctgattgaagcctgtgtgatactgcatcggaaatatcctcaaatcaggctcaaattggcaggggacggacatccggattatatgtgccgcctgaagcgggacgtatctgcttcaggagcagaaccatttgtttcttttgaagggtttaccgaaaaacttgcttcgttttaccgccaaagcgatgtcgtggttttgcccagcctcgtcccggaggcattcggtttgtcattatgcgaggcgatgtactgccgaacggcggtgatttccaatactttgggggcgcaaaaggaaattgtcgaacatcatcaatcggggattctgctggacaggctgacacctgaatctttggcggacgaaatcgaacgcctcgtcttgaaccctgaaacgaaaaacgcactggcaacggcagctcatcaatgcgtcgccgcccgttttaccatcaaccataccgccgacaaattattggatgcaatataaactgctttcagacggcatatgccgtctgaaagcctttgatgcaacaaaccactaaattatattcgttcattggaaagaaacaccccgaattcatccttcaaaataagaaaatcccaatatcccccgatattacgcagcctattggcaaagttttgcagcgtcttccccggcttgtgctgccgcgtcaagtgctttgttacaatgtatagtagactaacaaaaaccagtacagcgttgcctcgccttagctcaaagagaacgattctctaaggtgctcaagcaccaagtgaatcggttccgtactatctgtactgtctgcggcttcgtcgccttgtcctgatttttgttaatccactatactaccttcacatttcttaataaattttatgagtaaccatacttcttggtcgtccaaaatcggtttcgtccttgctgcggcaggttcggccatcggtttgggcgcgatttggaaatttccttatacggcaggcaccaacggcggcgcggtgtttttcctgctgtttttgatatttactatcttggtcgccctacccgttcagcttgccgaattttatatcgggcgcacgggcggtaaaaatgccgtcgattccttcagggttctgcgtccgggcacgcaatggctttgggtcgggcgtatgggcgttgccgcctgctttattttgctgtcgttttacagcgtggtcggcggatgggtattaaattatgtcgtccacagttttacgggggcggttcataccggcgcggactttgaagccttgttcggcgcgacgatttccaatccggcaggttcgctgtcctatcaggcactgtttatgctgattacggtttgggtggtcaaaggcggcatttcagacggcattgaaaaggcaaaccgttatctgatgccggggctgtttatcctctttattgcgctggcaatccgttcgctgacgctgccgggtgcaatggagggcgtgtctttcctgctcaaaccgaattggtcgtactttaaagccgatacgatgattacggctttaggccaggcgttttttgccctgagcatcggcgtttccgccatgattacctacgcttcatatttgggaaaagatcaggatatgttccgttccggccatacgattatgtggatgaacctcttggtttcgctgcttgccggcctggtgatttttccggcggtgttcgccttcggttttgaaccgagccaggggccgggattgatttttatcgtattgcccgcagtgtttatgaagatgccgttcggtacggttttgtttgcggtatttatgctgctggtcgttttcgccacgctgacttcggcattttcgatgttggaaacggtcattgcctcaaccatccgccaagacgagcgcaaacgcaaaaaacacacttggcttatcggcacggccattttcattatcggcatcccgtccgcgctgtctttcggcgtatggggcgagtttaaggttttcggcaaaaccatttttgatttgtgggactatgttatttccgccgtcattatgccgattggtgctttgagtgtttccatctttaccgcctggattcaggacaagcagtctgtgttaaaagatgccggcgcgggcagcaccgtaccacgggcagtgctgctgctgtggctgaataccttgcgctaccttgccccgattgccattattattgttttcatcaattctttggacatcctttaaaagccatccaaacagcaaaaatgccgtctgaaagcctttcagacggcatttttgcttcgggttcagcctatttcgttcaaagtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatagccttgcgcgatgccgttcaaggacaaacccatacccttttcggcaaaacggatttcacggtcgtcaaacgagactttgccgaagccgacccgtttcagggcttcgtccacgctgttttgaggaggcggcgtttccgcatcgggacgggcggcaaaataatcggcatacagtttccacaacgcctgcactgtcggatcgaacgcgccgtccgtcagcgcgtgaatatcgcggcacaggctcaacagttccaaaaaatccgccgacggcgaagtcagataaccgtccctgttcaggcggctgatcaggctgtcttcacggtaaaggctgaacaattttttccaaacgcgccacttccgccaaaaccttgttgaccaaatccgccgcacgcctgtcgtccacaccgaacagacggagctccgcaccggaacccagtgcgacacctttccagaaaaacacattttcattgcgtttttcatccccgttgcgtttttcatcatcggcggcaaaaggattcggcaggaaagaaaccgccgcgcccgccgccgcaacggcggcaaccgtcagaaaacgcctgcgcccgaaatgcctgcccataccgcctctaaaccgacactgccgccttgatatgcggatgagggtcgtaaccttccaactcgaaatcttcaaacttgaaggaaaacaaatctttgacttcaggattgattttcatcactggcaaggcgcgcggttcgcgttccaactgcaatgcggcctgctcgaaatggttgcggtacaaatgcgcgtcgccaaacgtatggacaaactcgcccgcctccaatccgcacacttgcgccatcatcatggtcaacaatgcgtagctggcaatattaaacggcacaccaaggaaaatatctgcactacgctggtaaagctggcaggacagtttgccgtcggcaacgtaaaactgaaacagcgcgtggcagggcggcaaggccatttcatcgaccaaagccggattccacgccgatacaatcaggcggcgcgagtcgggattcttcttgatttgttccagcacattggcgatttggtcgatatgcctgccgtcgggcgcgggccagttacgccactggtagccgtaaaccgggcctaagtcgccgttttcgtccgcccactcgtcccaaatggaaacattgttgtcctttaggtatttgatattggtatcgcctttgagaaaccaaagcagctcgtggataatcgaacgcagatgcagctttttggtcgtcagcagcggaaaacctttgcccaagtcaaaacgcatctgataaccgaatacggagcgcgtacccgtaccggtgcggtctgatttgtccgtaccgttgtcgaggacgtggcgcatcaagtccaaataggctttcatagcagtctttcatcaaattaaacggcgcatattgtaacatttccggataatgcccaaaacacggatacaggcaggcaggattgttggcaatttcagtccttttccacagtaaaacccggtgggaaaacaaaattaccttgattggaatcaaaaaatctagtttaattacttagaataaaatttcaataatatttttatttacgaaattaatttatgattattgattaattatcggcaacaaacatcaaacatcgaaaatatggaaaaaataatgtcaacaatttttgccaaatcgggcttggcatcagaaaaaagtaggtttatattcccacctacaaaactgttttcccattagtacactatcaaccaaaaggagtatccgaatgactgacctgaacaccctgtttgccaacctcaaacaacgcaatcccaatcaggagccgttccatcaggcggttgaagaagtcttcatgagtctcgatccgtttttggcaaaaaatccgaaatacacccagcaaagcctgctggaacgcatcgtcgaacccgaacgcgtcgtgatgttccgcgtaacctggcaggacgataaagggcaagtccaagtcaaccggggctaccgcgtgcaaatgagttccgccatcggtccttacaaaggcggcctgcgcttccatccgaccgtcgatttgggcgtattgaaattcctcgcttttgaacaagtgttcaaaaacgccttgaccaccctgcctatgggcggcggcaaaggcggttccgacttcgaccccaaaggcaaatccgatgccgaagtaatgcgcttctgccaagcctttatgaccgaactctaccgccacatcggcgcggacaccgatgttccggccggcgacatcggcgtaggcgggcgcgaaatcggctacctgttcggacaatacaaaaaaatccgcaacgagttttcttccgtcctgaccggcaaaggtttggaatggggcggcagcctcatccgtcccgaagcgaccggctacggctgcgtctatttcgcccaagcgatgctgcaaacccgcaacgatagttttgaaggcaaacgcgtcctgatttccggctccggcaatgtggcgcaatacgccgccgaaaaagccatccaactgggtgcgaaagtactgaccgtttccgactccaacggcttcgtcctcttccccgacagcggtatgaccgaagcgcaactcgccgccttgatcgaattgaaagaagtccgccgcgaacgcgttgccacctacgccaaagagcaaggtctgcaatactttgaaaaacaaaaaccgtggggcgtcgccgccgaaatcgccctgccctgcgcgacccagaacgaattggacgaagaagccgccaaaaccctgttggcaaacggctgctacgtcgttgccgaaggtgcgaatatgccgtcgactttgggcgcggtcgagcaatttatcaaagccggcatcctctacgccccgggaaaagcctccaatgccggcggcgtggcaacttcaggtttggaaatgagccaaaacgccatccgcctgtcttggactcgtgaagaagtcgaccaacgcctgttcggcatcatgcaaagcatccacgaatcctgtctgaaatacggcaaagtcggcgacacagtaaactacgtcaatggtgcgaacattgccggtttcgtcaaagttgccgatgcgatgctggcgcaaggcttctaagcaaacgccgccgctccgcaaacaaaatgccgtccgaaccgcaaatgctgttcagacggcatttccttatccgcccgttcaaatcgggtgagactaccgatacatctgaatatgctatgccgtctgaacggcattcacaccgcccaatcctgcacgcgcttcaaatcattttgcgccaaagtatctgcgtggcggttacggctctgatattccctgtctttcaagatgctgctcgccacataattcaaatgtgcctttgccgcctccgaagcctcgcccggccggcggtttgatattgcctcatacaatacacggtgctgcgccatcagcttcggacgcggatcttcttcctgattcagataaataaggctgctgcgcgtctgccggtacagcattttcaacaaaccgcccgacaaatggctgaacaacaaattgtgcgccgcatcggcaatcgtctgatgaaagctgacatcagcttcgctctgatgttccaaattgccgctttcgcacgcctcctcaaacttttcaagccaaaacccaatccgcttcaaatcggcatccgtgcggcgttctgccgccaatgccgccatacagccctcgatgtggcaactgaaatcaaaaacatcctgttcccaattggaatgcttgcccaaaagctcctgccaactttgcaaaaaatcctgctgcggcttgaccgaaacataataaccgtctccctgcctcgcttccaaaacctgacgggcgaccaaaacattcaatgccgacctgaccgacgggcgcgaaacgccgaactcttccgccaaaacgcgttcgggcggaatcttgcccccttccgcgtaaaccccttccgcaatgcgctcctccaataccgacaatacctgatcgctgattttctgaggccttaccagtttcatcactcctcctttataaagattccctgcagaacccttccgaaatatagtggattaacaaaaatcaggacaaggtgacgaagccgcagacagtacaaatagtacagaaccgattcacttggtgcttcagcaccttagagaatcgttctctttgagctaaggcgaggcaacgcc

SEQ ID NO: 66 - DNA, 16678 bp, Neisseria meningitidis
gggtttatgaagcggcttgccggcaaacagatcataagcaaacataccgcctactttatgccctcctctgaagccgaccactgcacccatcagctgcttgcccgatacatattgtgcactttcgccagatacgcggccatagtccgcaccgagatagaactgatggttcggatgaaaataccaagttaaagtattctgccagtagaaacctcgctctccgaaaagactctgctccccatcaaatccgcgaacggtgtagcggctgccgattgacaatttatcttgggcaaccaacggcgttttgttccattgagcttgaatggcggttgcgtagaaaaactgctgtttgcctaaaataaatggggcggctgcgtccaaactggcagtaatgattttcatacgagatgtacctggaagaatatcgccgccgttttcttccggtgcaggcatactttggcgcatgccggtcccgcgtttgtaagacaacttgccgtcaagctgccaacggttgaggtaagcacggtggcgcaattcggcttcccagcctgcagagcggcggcgttgtacttcgatttcggcatcgtcgatgtatttataggtttggcgtgtccataatttcattccgactgaagttttatgaagtctgttacgccaaagcatgcgctcggcggccaggctgctctgatattgtttgccgttgtaatcgtaattgacggaatagccttcggttgcttcgtggtaacgatgtccattgtgattaaaagaaaacagccatttttttacgggcaccgaataatgcacgctgtaacttctggatccgctttcagtttccgtaccggtggcatcagtcaagtccgttttgtgcgccaaaccgcgtccatatgaaacataaaacaaatcgcttaagcccaaagggttatcgaacgataaagcgacatttccttgatatttgccggtcgttttgccgcccgcatcatctataccgatactgaaccgtatgggtttattctgctgccatttgatctgtaaatcgcttttgccttcttcttcggacggtataatctgaatatctgttttaacactcggcaaacgacgcaggttttccaagccctgctctacatcgcgaagattgagaattttgttcctatataagggaaatttgttattgaatgcactaatactgccctcggcagacttcccatcccgtttttcttcatagcggatatcccctatttcgcctgctgatacccgtaatttcagaattcccgaatccatattctgtggttggataatagcttgggaagtgaggtagccacgcacgatcagtatctgttgcgcggctttttgtagcctgctcaaattattggaacctaaacacatcccagttttaaaagctgtttctttcatgagcacagaaggaagaaaagaaaatttgcgcaccgtcttatcatctaaactaatgtaatttacccgagtacacggtgtttcatcttcactcaggacataattgttcttctccaatggttgctcgaaacggacatttgcatcagttaacaattcagcatctatgtgctgctgacgctgcatggaacggataagttctgcatcgttttcatcggcagctaaggttttaaggggtatgacagccaggataaccaacagacatggagcaggaaaaaatttcatgacatcaatattattttagcaatatttactattttgtcataaatttaaaagtatttacagttatagaatgagacctttgcaaaattccccaaaattcccaccaagacatttaggggattttggggaattttgcaaaggtctcggacagtattttgaacgcagtgcgcgtaaattcgtatggaaaccatgaaatcccgccacagccgccagacatgccaagccgcattctgatatttctgtttgcaggataacaggcagctttttctttaagcccaaagacaggttttgcagatggggcatagatttcctttttgaaaaatagggattaggaagttggatgtattttagaaaggccgcctgaaaaggtttcagacgaccttttgcgactagctgctattttatttaaagcttttctctaacaaacgagctaatatttttcctgtaataaaacagataaaaaacagcatccaatacgtcagattggaaaaatcggtcgtatagagaatcaacatataaagaagcagcatgatgccgagtgcgatgaattgataatgtttggcaaacatcatgacctcctcaactattaaggcaaaccgcctgaatattctcgttcaatcgtttcggcaatttccctataacgtcgataccatgaccagtcgaaattttcaatggcatggctcgcaaacgtaccaaattcaggcatccctatgcggctacctgctaaagctccgattgtagctccccaaccaggcggattactgaacgtattgtttggcaatcctaaagatttatcaggatttcccgtatcgttaagccctgcagattcgcaaatttcgcaataatatgagctttgttgcgcattacctgagcctccgacccaagtcatttcatgaacacatatagtggattaaatttaaatcaggacaaggcgacgaagccgcagacagtacaaatggtacggcaaggcgaggcaacgctgtactggtttaaatttaatccactataaaactctcattttgaaactccttgtatcgttaatcaaacaatcaaaagggcagatgccctatccttgcttttacaaacggagtgcctgtaaaaggggatggtttcaggcagttttgaagtttgtgtttttatatattgtcttctggtcgtctgaaaaggtttcagacaacttctttatctttacagcctcaagtcttacagtttgcccgacatactataaatcagctccaatacccattcgtacaatcaccgtttctcgtgtaggatgtctgcttccaacgtcatgccgatttgcagcggtttttcctcaccgtatgcagtgatggttgatttgtcgggttttattttcacaagataaacaggttcgttgctcttcgccaaatcggaggataccatgcccaatcccgacaattcctgtctgcccagtgccgtttttgctactgatacgacactgccggaagcaagcccgaatttttgatagggatatgcctgataacgtaggacaaccttgtctttcggcttgataaagcctgctgcactgctggggatatatagatgggcatatagctcggtacgttcgggaacaatgctcaagagcagtttggaaggatcaacctgctgtccgacttcgacgttcggtattgctatataacccgaccgtcctgcacggatgatttgttcagagcgcatttcaaaatccaaaacttcttgagaaatatcggcaatggtgcgttcaagccagctttgttctgtctcatgccgcttgggggaggctggccaatgtcagattctgcgtgcggatttcctgaagcagcccgacttcttctcggcggtaggcatcaagtttggctttctgctctaaaagctctgccttgacattcatcatttcttgttttggcactgcatcattggcggataggaaacgatatttctgcaacatttcttccgcaagtctaatgcgccttttctgaccgtctatctgttgcgaaatatggagttcctggttttccaaacgttcgacagttgctttaaggctgcgcgtttcattcccgtgtatcagcttcagacgacccagttcctgttctgccaacgttttcttcaaaactgcctccgttttcaactgctgctgcacgctacctcctgcgccgaaacgtgaggtcgaaagcgcaaatagcttgtcgccagccttaaccttttctccatcttccacgaatttcgctgtaattgtccccgtatccggtgcatacaccctgattacgcccgatgcaggtaaaatttgtccctccactgttgtctttcgcgtatagttaccaaatatcaaaaacaggataatcaataacgcagatatcgatgcaaatgtcgtccatagggaaaatgacaacggtcgtgtcagaatcactttacccgtcaggctggtttggcgggcaacggcgacttcgggacggaagaagggttgcttgggtctattcataaaattgaagttaagaaagtttcagacgacccctagagattgtctggacgatgagaaatatcagcagtaatctgtaccgtcagtgtagccgtttcctgatttatctgcttttgttgcgggagcagttaatccatgttcaatctcaaagattggtcttccgttataaggaggtgcattaacggcatcatttacccaattacgagtcacattgtatacaccatttgcaccagcagcaccgtaagcatttttcggcagataataaactgccgctgcggcagcaggtattgcaaccaaatccccccatgtgggacctcctttggttgtggcagcattagctacatttccagctatattgtctgttacaggacctccccctgaaaccagcttcaattcatgaagttgaagttcaatcatttttatactccttttcttggttggtattcctaaaaattcggctaacaaaaacatatggcagatatattgaaaaaaaattcaaagtaccctgaataaaattcaaattccaactatatttgttaatgtagtcgagaagaaacatatctgataaaaaatatagcacttgataacaagctattactaatattacgaaaaatgtaaattgcttccagtttttcatagaatccctcacaaaatttccagaaaatctaactctatcaactgataaatcaacttcctaacttcttcatattttccctgattgaagttaaccagtagatttttcaacaataacggttcattcttaccgatgtgttctaacacttttttccccaactcatctacgcttatcttcatcccattcccaatcaaatatcccttttccaacgtatccaaattattggcatttaatctcaacctgacgtcgtctgaaagcggagtagcgttgggattcgcgaactgttcgagatgaaaagcggtatcggtacgttctttgccgagaaagtcttcactgaaggcttcataattgacggggtcggcaatcatggcagcaatttgtgcggcagtatcgttgatacgcgtcctatcttgctcccagtctgagaaactgtggcgcagactttctatggtgggaaatttcttcattagccactcgaggtaattatagccgttgggtggaaaggtaccgacagcgaagtggaaggtttcacagccgagcgggataggtctgtgccaccaaccgcgtgggatgtagaggacatcacctgcttcaaggataatatccatatcgatatgttcaggaatggaaatatcagtatctttagtctgttgcatatacaatggcatagggaaatcaggggcagtaagttgccaacgtttcttgccgaaaagctggatggcatacacatcgcgggggtcccaatggtttttataagattcgtcgctgccaaaagcaagatatccactaacaatagtatgtgcgccggcaaagcgggcgacttgacgggcgatatggtctgaaaacggctcgttgttaatatggttatagactaacgacgcaccattcttcatatgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatctttccaagatgcggattcgagattccgaaccgctcctttaaagagcttgggcttttgatacagataagtctgtcggaacgttttaggactaatgccgaagtcgagatggatgctcattacttccccttactcagaaaatatttaaaatttataatgttacatatatttacaaatattaaagtttttttttgtgtgtgcgtcaaggaattgttgacaattttagttaaaaatttgtctccaaacggaaaaaagcggtttgttttttgttgttaacatttttattgtaattaaataaaaggtcgtctgaaaacggttttcagacgaccttttgctataatcgggcttcatcgccccgttcggtttggaaccttatgaaaaccctcgtcctcctcctgctttccttctccacgaccaccgctttcgccgcatacggtttgggtttggggcaggcaccgaaatatcctgccggctttcgcgcctacggttatgtttattccggacggcagggctaggttttaaaaacagaggcggatgccattaaattagacacgcttttcaaacgctttgtgtaccgtccttccgccgccaatcaaaaccccgtcggacagcgttcggacggcatacccgccaaccacacaaaggaaaaaccatgagtaaaaaaatcaaagtcggcattgtcggcgcgacgggctacaccggcgtggaactgctgcgcctgcttgccgcccatcccgatgtcgaagtcgccgccgtaaccagccgcagcgaagcgggaaccgcagttgccgattactttccgagtttgcgcggcgtgtacggcctcgccttccaaacgcccgacgaggcaggtttggaacaatgcgacatcgtcttcttcgccacgcccaacggcatcgccatgaaagacgcgccgcgcctgattgaacagggcgtgcgcgtcatcgacctttccgccgacttccgcatacgggacattccgacctgggaacactggtacggcatgacccacgccgcccccgacctcgtttcccaagccgtgtacggattgagcgaactcaaccgcgaagccgtcgcacaggcgcgcctcgtcgccaaccccggctgctacccgacctgcgtatccctaccgctcgtgccgctgttgcggcaatgccgtctgaagcccggtatgccgctgattgccgactgcaaatccggtgtgtccggcgcgggcaggaaaggcaatgtcggttcgctgttgtgcgaagccggcgacaacttcaaagcctacggcatagccggacaccgccacctgcccgaaatcaggcagaccatcgccgggcttcaggacggcatcgccgaaggattcgtgttcacgccgcacctcgcgccaatgatacgcggtatgcacgccaccgtttacctccacctttcagacggcagcgaccccgaaaccgtcctgcgcgactactaccgcgacagcccgttcgtggacatcctgccgaccggttccgcccccgaaacccgcagcgtgcgcggcgcaaacctctgccgcatcagcatccaacaggcggcgcaatccgatgtgtgggtcgtcctttccgtcatcgacaacctcgtcaaaggcgcggcgggtcaggcagtccaaaatatgaacattatgttcggactggaggaaacacacggcttggacgcaatccccctgctcccctgaagcgcaaacagcaaaccgcaggcatcgtgcctgcggtttttgatgccgtctgaaagcgacgtttttttgggttcggacggcttttgacccatccattcacacgaaaacaaaaatctaaaataccgtcattcccgcaaaagcgggaatctagtttatccagcttcagcaatttccgacacatttccacacgcttcgattccgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccatcattgccgcgaaaacaaaccaaaaacctaaaatcccgtcattcccgcaaaagcgggaatctagtttatccggcttcagcgatttccgacacatttccgtacgcttcaatttcgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccgtcattcccgcaaaagcgggaatctagtttatccggcttcagcgatttccgacacatttccgcacgcttcaatttcgtcatttctccggtttcagtcattgccgataacaccgtggttttttatttctagattcccgcctgcgcgggaatgacggcggagggcttgccgtttttcctggtaagtctctgcggcttctcattgccggtttccgcctacttgggaatgacgtgatttaaaatcatgaaaatgtgtcaaaaataatatagtggattaacaaaaaccagtacggcgttgcctcgccttgtcgtactatctgtactgtctgcggcttcgtcgccttgtcctgatttttgttaatccactataaaaatcagatttccgttacacttttttccaatatttcagacggcattttgctcacacgcccaaatacccttccctgccggaaagccaccttgccaaatgcgcttcgacgatttcggggttttgttcaatcagcatcggggcggtttcgcgcgcttgttccaagaggtgcaggtcttcttcgagcttggcgaaacgcagcataggcacgccgctttggcgcgcgccgagaaattcgccggggccgcggatgttgaggtcttggcgggcgatttcaaagccgtcggtgtgttcgtagatgactttcagccgcgctttggcgagttcgcccaagggttcggcaaacaggaggacgcacacgctttctgccgcgccgcgcccgacccgaccgcgtaattggtgcagctgcgccaagcccatgcgctcggcgtgttcgatgaccatcagggcggcattgggcacatctacgccgacttcgatgacggtggtggcgaccaagacgttcagcccccccgaagaaaaccgcgccatcacttcggccttttcggcggccttcatgcgcccgtgtaccagtccgatattgagttcgggcaatgccgtctgaagccgggcgagggtttcggcggcggtttgcagttgcagggtttcgctttcttcaatcaatgggcagacccaatacgcctgccgcccttttcggcaagtgccgaggacgaagccttcgacttcggcgcggcggacgttgttgacgaggcgcgttttaatcggtgtgcgcccgggcggcaattcgtcgatgacggacacgtccaaatcggcgaaaaaactcatcgcaagcgtgcgcgggatgggcgtggcggacatcatcagctgatggacttcgcgccctttgtttttgagggcgaggcgttgggcaacgccgaaacggtgctgttcgtccacaatggtcaagcccaaattgtgaaacgccacgccgtctgaaaacagggcgtgcgtgccgacggcgattttgacgctgccgtcggcgagtttggctttggcttcgtctttggcttttttacgcaaactgccaaaaaggcggacaacttcaatgcccaaaggttcgagccattgtttaaatttaataaaatgttgttcggcaaggatttcagtgggcgccattacagccacctgcgcaccggattcgatagccgtcaaagcagacaaagcagccacaatggttttgccgctgccgacatcgccctgcagcaggcggtgcatcgggtaggtttgcgccatatcgcggcagatttcggaaacaactttttcttgcgcatcggtcagggcaaacggcagggcttggcgcagggcttgggtcaatgtgccgtcgccgcccaatgccgccgccgtgccgccgatacgcttctgtcgcgccaagcgcatcgaaagctgttgcgccaaaagttcatcgaatttgagccgttgccatgcaggcagcgtgccgtctgaaagctgatgaatcgtgaaactcggcggcggcgaatgcaaaagacgcaggctttcggcgaggtgtggcagcttcagacggcacagcagggcatcgggcagcgtgtcgtgcagcggcgtaacgtccaacgccgtctgaataatacggcgcaaagtgggctggttcaaaccgtttacggtcgggtaaaccggcgtgaggctttccgccaaaccgccgccctcggcatcgcggattttgggatgaatcatctcgtcgccgtaaaagccgtgtttgatttcgcccacggcgcggatgcgtttgccgaccgccgtctgtttctgatggctggcgtaaaagtggatgaagcgcagaaaaaggacgctgccggagccgtcggcgatttggacaatcagctgcttgcgcggtttgaacgttacttcctgatggataacctccccctcgacctgacacggcacgccaatcggcgcgtccttaatcggcataatgtgcgtctcgtcctcgtaacgcagcggcaggtgcaacaccaaatcccacgcggtatggaggttgagtttgtcgagcttcttggcggaaacatcggtgattttgagctgttttcgggtttcgggcgacatcataggcagattcctttggacgcgcctattttatccgaaaacaaaaatgccgtctgaaacggattcagacggcatcgacaggcaggaatcaagccccggcggcttcggcttcctgctgttgttggtaaatcgcctcaaaattaatcggcgcgagcaggacgggcgggaagccggcgcgcgttaccgtaccggaaacggcttcgcgcgcgtaagggaagaggatgttcggacacgccacgccgagcagcaggtcggcatcttcttcggggatgttttccaaacggaaaataccgctttgggttacttcgttcaaaaacatcgtgcgctcgttatccaatttggcggttacggtaacggttacatccacgttgtagtagccgtcttccagcttttggctgccggtggaaacgcgcatctccacttcgggctcgccctgttccaaaaagatttgcggcgcgtgcggcacttccaaagacaagtctttgacatacagtcgctcgatgctgaatacgggttgcagttcttcgctcattttgttttcctagttgggggttaagggttcagcagtccgtccagcccgccttcctgctggaggcggtagaggtcggtaaatccgccgacgtgcgtttcgccgatgaaaatctgcggcacgctgcgctgtcccgaaagctgctgcatttcggcaaaggcttcggggcttgcatcgacacggatttcgtcgatatgtccgacacctgccgcgtgcagcagccttttcgccatcgcgcagtaggggcaaaacggacctgtgtacatggtaacggtctgcatattgggtttccgaaagttttgcaatgataatcaatataggggcatttcccctgtttggcaagtgcggaacagatgcacgttcaaacggcatgtgcggaatgtgtcaaagtttcttttttaaagtatgatagacattgtgaaaaatatttttgcacccgcgctgcgcggcggaacggatgcaaaatatttttattacattttcaggaaaaaccatgttgtcaggactccccatccccaaagacatcgcgcgcccgcccgaaacgatattggtcaacatcacgccgcagaaacgcgcgtagcggtgttggaggaaaacaatatctgcgagctgcacatcgagcgcaacagcgaacacagcctagtcggcaatatctatttgggcgtggtgcgccgcgtgctgcctgggatgcagagcgcgtttatcgacatcggcttggaacgcgcggcgtttttacacatcgtcgatgtcctcgaacaacgccgcaaccccgaagaaacccagcgcatcgaacatatgctgtttgaagggcagtctgttttggtgcaggtcatcaaagacccgatcaacaccaaaggcgcgcggctttccacccaaatctcgctggcggggcgtttcctcgtccatcttccgcaagaagaccacatcggcgtgtcccaacgcatcgaagacgatgccgaacgcagcagcctgcgcgaacgcctcgacaagctcctgccggaaaatgcctgccggggctacatcatccgcaccaacgccgaaaacgccaccgacgaacagctccagtccgacatcgactacctgaccaaagtgtgggaacacatccaagaacaggcgaaaatccggccgcccgaaaccctgctttatcaggatttgcctttaagcctgcgcgtgttgcgcgatatggtcggctgcgacacgcaaaaaatcctcgtcgattccaccgtaaaccacgggcgcatgacgcgttttgccgaacaatacgtccacggcgcattgggcaggatagagctgttcaaaggcgaacgcccgctgtttgaaacccacaacgtcgaacaggaaatcagccgcgccctgcaaccgcgcgtcaacctcaacttcggcagctacctgattatcgaatccaccgaagccatgaccacgatagacgtgaacaccggcggcttcgtcggcgcacgcaacttcgacgaaaccatcttccgcaccaacctcgaagcctgccacaccatcgcccgcgaattgaggctacgcaacctcggcggcatcatcatcatcgacttcatcgatatggcacaggaaagccaccgcgaagccgtgttgcaggagcttgccaaagccctcgccttcgaccgtacccgcgttaccctgcacggttttaccagcctagggctggtcgagctgacgcgcaaacgctcgcgcgaaaacttaaaccaagtcctctgcgaaccctgcccttcctgccaaggcagaggccgtctgaaaacgccgcaaaccgtatgctacgaaatccagcgcgaaatcgtccgcgaagcgcgccgttacgatgccgaaagtttccgcatcctcgccgcccccaacgtcatcgatttgtttttggacgaagaatcgcaatccttggcaatgctgatagatttcatcggcaaaccgatttctctggcggtcgaaaccgcttacacgcaggaacaatacgacatcgttttgatgtaaaaaatgccgtctgaagccttcagacggcatctgtctatttcagggtttccttgtccaacaacgcgcgtatcagcagaccgcgtccgaaacgtcggctgtcggacaattccaaatatccgccgtattttttggcaagcgtgtcggcgatggacagacccagccccgtcccctgctgctccgttcccaaaatacggtaaaacggatcgaggacacgggcgcgttcggattcgggaatgcctttcccgttatcttccacccacacggcaagatatttcccttcgtccgtgaaacccaaatctatcctgccttcgggcggcgtataacgtaccgcgttgtcggcaaaggttttaatcagcgtatagatttccgtttcgtcggcagacacttcgacatcgcctccgaccgccacgccgatgtcctgacatttttccaaagccagcggcatcagttcctgcaacacttggcggaaacggctttgcagaccgaatgtcgttttcgtcagagggatttcatccgactgcgaacgcgccaatgccaaaagctgttcgagcaggtgtttgttacgccgtatgctttgctgcaaaacggcaggctgccgcgccgcatcgggtgggagcggcatattgttgagccgttccgcctgaaggggaagggcggtcatcggcgtacgcaattcgtgtgccgcgtcggcgacaaaccgctgacggtggcggatgtcttcatccgcacgtttcaaaagcaggttgatggcggttacgaaacctctgatttcactgggaatattgtccacactcaaagcagacaggtcattgattcggcgttgttcgagactttgcgacaatttgcggacggggcgcatggctttgtgcgtaatccacacggtcagcaaaatcatcagcggcagtgccgccaacaggggcaacacgctttgccgtgccgcatccgccgccaaatcttcacggtattcgttttcctgcataacggcaatccgtccctgctcggtcgtgcggatatagacgcggtaataatcgtcgtcatcgtccgcctgaagcgtgtgcagaccgtccgccagatgcgcaggcaggctgacaacagggtcttcctgctgcggcatctgtaccaaaatacgcgtatcgccgtcgccctcgggcaaagtttcgggtttggaatcgggggcgacgtacaatgccgcctgacggagcaggtcgtcctgcaacgcttccgtttcgtggaaggtttcgtagtaggaaaacatacctgcaagcattgccagcggaacaaacatccaaaccgtcccgccccggcaaacccaaatccagcagcatcaagtcataaggctgggcagcggcagccgcgcgccgtttttgacccaatccaccgcatagccgccgtctttcaaacttgccgacaccgcctccgcaatcatcgcatcgtcttccaccagcaaaacacgcatcaactttcccttcaaaataaaccgtgcctattctaacaccccaaaattagccgcaatttagcggtctttacgcttgccggtatttttcaaaactgcagcacaaaaaaaccgcgccggcaactgccttcagacggcattggggcgcgattgcaacacacgggcaggcaggcagagcctgcgacagaccacaggaacgattcaggcttcagacggcttcgccgtttacggcagaggcacgattcctgccgctatcgaactggccaatatcgccagcgacaaaccccacgcccagaaaaacgaataacggatgtgtttgcccatcgacaatttcgccaaacccaagcccatccacaaagccggcgaaagcggcgtaacaaaagtgccgacgatactgccgatcaacatcgcataacctgctgcttcgggcgccacgcccgcctgcgaggtaatctgctccacaatcggaaacagtccgaaataataagcgtccgtactcaaaaccaactcaagcggaatgcccaacacaccgatggcaatatgcagataaggcagcagcgcgtccggcaggatatgcacaatgtctttggaaatcgcgtccaacatccccgcacccttcaaaatccccaaaaacgtacctgccgccaaaataatggacgccatcatcaccgcgccgccggcgtgggcataaatccgctccatctgttcctgcgggctgcggtaattcaaaagcaacgccgccgttgcagccagcataaatacataacccggtgggaagatgcccgaaaaaagcaggctcatcgccgccaaaaacagcaggacattccaccaaaacagtttcggacgcgccaatttttgttcttcttccgacaaaggcaccggctttatcaaatccgccacggcgggcaacgcgcccaactcccggacaatccgccttttttcacgcacacccaaaagcagggacagcgcaaggataaacaccacaccgataatttgcaccgtcaacaaaggtttatacaattcgcccacatctgcgcccaacacgcttgcaacccgcccggtcggcccgccccacggcagaaggttaatcaatcccgcactggaagtcagcagcaaaaacagcaggtaaggattcatatgcagacgcttgtaaagcggcaaaagggcggggacgaccaataaaaacgtcgtcgcacccgccccgtccaactgcgccaccaccgacaccaagaccgtccccacactcactgccacgatattaccccgagtcagcttaatcaaaccgcctatcatcggacggaacagccccacatcgttcatgattccaaaaaacaaaatggaaaacataaacataatcacaatctgcatcaccgatttggtgccgcccgaataaaattcttttaattgggatacatcaaaccccgccagcaacgccccaaacagcggcaccaagattaatgcgatgatgggcgacactttttccgtcagcagcagccatacgatgaccccgataatcagcagtccgataaacgtcagcatcatttctcctttattttattttaaacagaaaaccgaccgtgcaggcaaaaccgcccacagacgcgggataagccctgcattctacttttttattttgaaacaagtcaatcggtcatttcctcccatttacgcctgccgccattcctgcatccgtccgtcatttcacagcggcaaccgatacggaacaaccggtaaatcggtatcgggacggcgcgggggcattcatcccggtgcgccgattcaaacgaaaccgcccctatcattgcggagcgcggggcgtgccgtacacgcgggattttatagtggatgaacaaaaatcaggacaaggcggcgagccgcagacagtacaaatagtacggaaccgattcacttggtgcttcagcaccttagagaatcgttctctttgagctaaggcgaggcaacgccgtactggtttttgttaaaccgctataaacacgccggtcatttgccgcgcattatccggcaaaagggaaaccttgaggctgcccagcccaaataaaaaaagccgcaaaa

SEQ ID NO: 67 - DNA, 30078 bp, Neisseria meningitidis
taaccggattgaaatgtcccctgcccattttgctggcgaaaaaggctttggcgcaaatgcagcagggcgacgtgttgaccgttctggcaaccgacggcggmgcaccgggggattttgaggctttttgccgccaaaccggtcatgtgctgttggatgcttccgaacaggacggcgtgttcacgctggtcgtccaacacaaataaatgccgtctgaaatgcggatgtcccgcccgacggcgttgtttttgaatatcgtatgtgccgcgtgccgtttcaaaaacaaaccgtccggcgtgcagtgtcggcatttcgggcgtatcgccgccgatttgttccggaatggctgttaaccgccttgccgtcggcaaagaagcaaaacccaagcacaatcaaaatctaaaggctgtgtttgaagattccgttgatgcaacccaatcagtcggacaaaatgcctttcatccaatggaaccggtttccgaccggacggaataaccggctttcccccggcaaacggatggaatcgaccgggtattcaaacgcagccaaaacctaaaaaggaacaaccatgcaaaccctgaccattatccgccccgacgatatgcacctgcacctgcgcgacggcgacgcgctcaaagccgttgccccttataccgcccgccaaatggggcgcgccgtcattatgcccaacctcaaaccgcctgtcgtcagtgtagccgacgcgcttgcctacaaagcgcgcattatggcggcgttgcccgaaggtagcgcgtttgagccgttgatgacgctttatttgactgataacgccacgcccgaacttgtacgcgaagccaaagccgccggcatcgtcgccttcaaactctaccctgccggcgcgaccaccaattccgattccggcgtaaccgacctgttcaagctcatccccgtgttggaagaaatggcgaaacagggcattttgttcctcgttcacggcgaagtaaccgaccccgaaatcgacatcttcgaccgcgaagccgcctttatcgggcgcgtgatgaaacccgttttggcgcaagtgccgaatcttaaagtcgtgttcgaacacatcaccaccgccgaagccgcccgcctggttttggaagcaggcgacaacgtagccgccaccgttaccccgcaacacctcctgctcaaccgcaacgacctcttggtcggcggcgtgcgcccccatcatttctgcctgcccgtactcaaacgcgaaacccaccgtcaggcattggtcgccgccgttaccggcgagaaggcgcataaattcttcctcggcaccgactccgcgccgcacgccaaatccgccaaagaaaacgcctgcggctgcgccggtatgttcagtgcgatgaccgctatcgagctttacgccgaagtatttgaaaaagcaggcgcgttggacaaactcgaagccttcgcctcaaaaaacggcgcaaggttctacggcattcctgaaaataccgacacgatcaccctcgtcaaacaaagccaaaccgttcccgcaagtgttccctacggcgacggcgaacttgtcccgatgcgcgcgggcggcgaaatcggctggacggtgcagtattgatgggctggaaacaaaatgccgtctgaagggagggctttcagacggcatttgtgttgctgactgattgatacgtcaacggcgtttgagtttgttacgtttcggttatttccgataaattcccacaattttcaaatttcgccattcccacgaaggcaggaatccagaaattcgatgcgaccagagtttatcaaaaacggcagcaactcaaaaaaccggattcccgcctgcgcgggaatgacgagattgaagtttcagaatttatttgaaatacccaaaattcaaaaaaccaaattcccacctgcgtgggaatgacgaaacaaagaaagcagaaataaggacatagaactttctttaaatttgtgatgcatcaacggcgtttgggctcgtcggggcggatttgggcggcgagtttgtcgaggatgccgttgacgaatttgtgcccgtccgtgccgccgaaggttttggtaacttcgatggcttcgttgataatgacggggtagggcgtttcgggcatggcggacagctcgtggcaggcggtcagcaaaacggcgcgttcgatggggttgaggtctttttcgtccctgtcaagtagcgggcggatttgtcggatatactctgccgcattggtttgcgtgccgaagaaaagtttgttgaacaattcttcgtctgccttggcaaagtcggacatttcgcggatgtttttagcaatttcgggcgcggcggtgcggttgataagggattggtaaacggcttgtacggcaagctcgcgggaacggcggcgggctgttttcatgatttttccttgaaacggttgggcggcacggtatgccgtctgaaacggaaagggtgtattggtgtacgccctgtttgttattcttcgtcttcaaactgttcttcgagcagcaggttgacgaggttggcgcattcgacggcgactttggcggcatccgaggctttttcttcaatccgttcgattgcctgcgcgtcgttttcggtggttaggacggcattggcaatcgggatattgtagtcgagtgcgacgcggctgacgcctgctccggattcgttggaaaccagctcgaaatggtaggtttcgccacggatgacgacgccgatggcaatcagtgcgtcaaacttttcggaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgggtgtcctttggtattcggaggtttcggaatgccgtctgaaggtttcagtcttgcggctgccagtcggcgacggtttggaatgtgccgtcttcggcaagctcccatgcgctgccttcgggttgggagagcagtgcggcggtttcagggttggttttggcgatgtcggcgaggctgacgatgctgaagttgtccggatcgtcggtgtattcgtcggtctcgtcgccgctgaagaaacgccagccgctgtcgttttcaaaaacgggggcttcgcggtagaggaagccgacgggccggttttgtttggcgacggtgttggtggcgatacagcggtcgagtgccgaggaaagtgcttgtgcaaatgcgttcattacgggaatacgttgggggaaaacttacggattttaccacgattcgtgcgttgtcggcagacggcggcggtttggtggtacaatgtgcgccgtttgcagccttaaggtgtttctgtatttttggagtatggaaacgcattcgggctgttttttgcggaagacggtaatgaaagacgatgttttgaaacagcaggcacacgcggcgatacagaagaaactgggctacgcgttccgcgatatttcgcttttgcggcaggctttgacgcacaggagccatcatgcgaagcacaacgagcggttcgagtttgtcggtgattcgattttgaattatacggtggcgcggatgctgtttgacgcgtttccgaagttgaccgagggcgagttgtcgcggttgcgggcaagtctggtcaatgagggcgtgctggcggaaatggcggcggaaatgaatgtcggcgacggcctgtacttgggggcgggcgagttgaagagcggcggcttcagacggccttcgatactggcagacgcgatggaggcgatgtttgctgccgtcagcttcgatgccgatttcaacacggcggaaaaggtggtgcgccatttgtttgccgatcgcgtccggcgcgccgattttcaaaatcaggcaaaagacggcaaaactgctttgcaggaggcgttgcaggcgcgccgtttcgccttgccgaaataccgtatcgaagagcaaatcggttatgccaacgacagtatgtttgtcatttcctgcgatttgggcgaactgggtttcgtgtgccgtgccaaagggacgagccgcaaggcggcggagcaggaagcggcgaaagaggctttgaaatggctggaagagaagctgccgctgaagaggaaaaagaaatgaggcggcgcgtgaatatgccgtctgaacatatggatacgaaagcaaatatggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtagtttttcttgctgaactttacgcaaatgccgtccgaacaggtttcagacggcattttgtttcaatcgggaatatctttgttaaaaacgggttgatattatctgtgcatattatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaatccactataaagaccgtcgggcatctgcagccgtcattcccgcgcaggcgggaatctagtccgttcggtttcggtttttttggctagtgccgcaacattaaatttctagattcccactttcgtgggaatgacgcgattagagtttcaaaatttattctaaatagctgaaactcaacgcattggattcccgcctgcgcgggaatgacgaatttcaggttgctgtttttggttttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaactcaacgcactggattcccgcctgcgcgggaatgacgaatttcaggtttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaattcaatgaaccggattcccgcctgcgcgggaatgacgaagtggaagttacccgaaacttaaaacaagcgaaaccgaacgagccggattcccgcttgcgcgggaatgacgggattaagttttcaaaattcatcagaaattactgatttaatagcataaattttttagattatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataagtcattccggcggcaatttttgttgctttaacgggataggcggttggcggttgcgataaaggcggcgactttggcggcatcttttttgcctttagacgcttccacaccgccggatacatcgaccgattccgctccggtgatgcggacggcttcgccgacgttttcaggggtcagcccgccggcaagcacccacggtttgcccgaatattccgccagcagcgtccagtcgaagcggtttccggtgccgccgtattccgaaggatggtaggcatcgaacagcagtgcctgagcgtcggggaagcgcgtggcggcgtttcggatgtctgatgccgtctgaacacgaatggctttgatataggggcggtggaactggcggcagaatgcgtcgtcttcgtcgccgtggaattggatgatgtgtatcggcacttcggcaaggatgcggcggatgttttgcgcgctttcgttgacgaaaagggcgacaacgctgacaaacggcggcagtgcggcggtgatttttttggcgcgggcaatatcgacggcccggctgctgccttggaaaaagaccagcccgacggcatccgcacctgccgctgcggcggcagctgcgtcttccggtgtggtgatgccgcagattttggtgcggattttcctcattcggtattcctttatttgggaaacggcgcgcttttgccgtttcagacggcattcccgatcagtcgattttgatgtattcgacagaaaggatttcaatttcctcacgcccttccggcgtgttcaaaaccacttcgtcgccttcgcgcgctttaatcagacaacgagccagcggcgaaatccaagaaattttgttttgcgcggtatcgatttcatcgatgccgacgattttgacggtttgctcgcgcccgtcgtcgcgcaacagtccgaccgtcgcgccgaaaaacacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttgttgaccagttgataaagctcgtctttcaatgcctgccatccggcgggcgtaatgtagtttttggtttcggtactcatattgtgtgcggatgaaacgggaaatgtgatgccgatatgggaaatgccgtctgaaaacccggcgttcggatttcagacggcatcgcggtttgggaagccttattcttcgtcgcccgcatcgctgatgctgatgctgtgttccatcctgctcgggtggattttcagaccgccgcagccggatttctcggcagacaggcggtcgaggtaggcatcatcgatgtcgccggtctgataaatgccgttgaaacaggacgaatcgaaggattcgattttcggattgagtgctttgacgacggcttccaaatcgcccaagtcttgaaatacgatgccgtccgcgccgatttcggcggcgatttccgccgcgctgcgcccgttggcaatcaactcttcgcgcgtgggcatatcaatgccgtacacattgggatagcgcacttcgggcgcggcggaggcgatatagactttgcgcgcgcccgccgcgcgtaccatttcgacgatttcgcggctggtcgtcccgcgcacgatggagtcgtccaccagcaacacgcttttgcctgcaaattcggtttccatcgggctgagtttttggcgcacggattttttgcgcgtcgcctgtccgggcataataaaggtgcggccgatatagcggtttttaatcaaaccctcgcggtagggtttgtcgagatggacggcaagctccatcgcgctggggcggctggtgtcgggaatgggcatcacgacatcgatgccgtccacgggcagctcgcgtttgattttttccgccagcgacacgcccatatccaagcgcgattggtaaacggatacgccgtcaatcacagagtcggggcgggcaaaataaacatattcaaaaaggcaggggctgagtttggcacggtcgctgcattggcgggcaatcattgtgccgtcaaagccgacaaataccgcttcgcccggccggatgtcgcgttccaaatcgtaggtaagcgcgttgaaggcgacggattcggaggcgacggcataggattttctgccttcgctgtcggtttgcgaacccaataccagcgggcggatgccgtaagggtcgcggaaggcgagcataccgtagcccgcaatcatggcaatcacaccgtatgcgccgcgcaccaggcggtggacttgggcaacggcgttgaaaatattgtcggcattgagccggtgcgggtcggcgtttttagagacttcgcggcgtaattcgtgcgcgaatacgttgagcaagacttcggaatcggagctggtgttgacgtggcgcaggtgtttgttacacacgttttcatacagttcggcagtgttggtgaggttgccgttgtgcgccaaaacgatgccgaacggcgagctgacgtagaaaggctgcgcctccgcgctgctgcctgcgttgcccgcagtaggataacggacgtgggcgatgccggcgttgccggtcaaatcgcgcatattgcgtgtgcggaacacttcgcgcaccatgcctttgcctttgtgcatatggaaggtaccgccttccgccgttgcaatgcccgccgcatcctgccccctgtgctgcaacatctgcaagccgtcgtacagaagctggttcacgggttcatgactgaccaaacctaatacgccgcacatatcgtcttctccgattcgaggtttaagggtaaaacggaattataaagtaaacggtggttttttgcctgaattgttgacaatatttgagcgaaggacagataggtgggtttatggagaataagatttatagtggattaaatttaaatcaggacaaggcgacgaagccgcagacagtacaaatagtacggcaaggcgaggcaacgccgtactggtttaaatttaatccactataatctgtgatatggctgaggaaaggaaaaaacatttcagacggcataaaagaggatgccgtctgaaatatccgtatggcaatcaatcgtcttccggagtttccgccgtgccgccgctatggttcaacacggcttcggaaagcgatacgaaaaacggcagtgtgtaagattgccgccattcttcggtatcgggcaggtcggtttttgaagcaagcatgaccagcagggtaacaatcaaaacgcctttcaatgcaccgaatacgccgcccaaaatgcggttggcaaagcccaaaccgaccgccgaaactgcgctggtcagcagcgaacggagcattttctggatcagacaggcaatgacgaacagggaaatgaacgacagagccaatgcaaacaggcggggttggaacgaggcaaaggcgaggtcggcgaaggaggcggcaaagagtttggcgaaaaagaaggaaaccacccatgccgccattgagcctgcctccgcaatcacgccgcgcatcgcggatagcacgatgcaggcggcgatgacggcggagacgaggaggtcggcaatggggaggctattcattcgttacctgaccggcgataccgtgtacgcgcaatttgttcaaatcgcgttcggcatcccttgcgtttttatagttgcttgatttgacgcggtaaactttgccgttgtcggtcataatttcggtgatggtcgaatcgatacccgccgccttcattttgcgctggaggcttaaggcgcgttctttttcggcataacctgcctgaatggcggcttttttaccggatttttccttctcggcggttttggtcttgtccgctttgtcggttttttgtgccgtttcgtgttttttgccgtccgaacggtctttttcggctgtttttttgctttcagccttgtcggcttttttcgcttcttttaccgcgctgtcggattttgccgtatccggtttggttttttcggcggcagttttcggtttgtcggcaactttttcggcggttttggtttctttggctttgggcttggctttggcagtgcgttccgctttttgcggttttgtttcggcagtgcgtttcggtttttcaaccgctaccgtatccgtactgtcggcagttgccggcactttttcggcagcgcgttgttttgcctgcttcggtgcggttttggcggtttctgcctgttgcagtttctcggatgcttccaaacctttgatgttgctgtcttcgaggcgctcgttaatcagcaccagcggcgcgcctacgttttcaggctcgctgatttcgctgtcggcggcagaaggcttgtcttcgcctgccaagtcctgcggtttgtcggcggcggatttcaaggcaggggtttgtgccgcacctgccgctttgttttctacgccgcttgtttcgccggcagtctgttcggcagggccggaactgagggcggctgccagcaggatgcaggaggcggcaaccaggcaacttgccgttacgaggcggcggcggttgcgccgtttgagttgttcgtaaccgctcaggacttcgttttgtttgttttcggacatagaagtttccttttaaagtaccgacatgacatcggcaacggtatgaaatgagccgaaaacgacgattctgtcgttctcgcccgcttttgaggctgccgcccggtatgcttcgcggacggcggcgaatgtttgtatgttttcgatgctgtgttcgtgcagtttgttttgcaggctctcgagcgtcatgccgcgcggtacatccaacggtgcgatataccactcgtcaaactggtctttaacggtttccaacacgccgtctatgtctttgtcggacaacatgctgaacacggcggtgcgtttttgcgcaaacgccaaattaatcaggctgcggcgcagggcgcgggcggcgtggggattgtgtccgacatccaaaacggtcagcggccggccgggcaggacttggaagcgtccgggattttcaaccagcaacaaaccgcgcttgatggcaccgatgtccaccggcaatttgtcgttcaagcattccaatacggtcagcgcgcaggcggcattggaaagctggtatgtgccgcgcaatgcggggaagggcagggcattgcggttgcgcgcggggtcgtctgaatgttgcggccggaagcggtagttccattggatgttttccatcgcgtgaaactcgaaatcgcgctgcaccatcagcagtttcgcgcctatggcttcggcgtgtgaaagcaacgatttgggcgcggggttttgaccgcagatggcgggtttgccgctacggaacacgcctgctttttcaaagccgacctgctcgaccgtatcgcccaaaaatgcctgatggtccaaatccacgctggtaaccaccgcgcaatcgccgtcaaacgcgttgaccgcgtccaagcggccgcccaagccgacttccaatatcatcacgtcaacctgttcgcgcatgaagatgtcgacagccgccaaggcattgaattcaaaataagtcagtgatatttcgccgcgcgcggcttcgatgcgctcgaaagaggcaataatcgtatcgtccgaaacgggttcggcgttgatggcgatgcgttcgttgtaacgcaataaatgcgggctggtcagcgtaccgattttgtagcccgcctgtttgtaaatctgtgtcaggtaggcacagaccgaacctttgccgttggttcccgcgacaacgacgacggggcattgcggctcgagcttcatgcgttttttcacttcgctcgtgcgctccaaacccatgtcgatcaaaccgccgctgtgggcggtttccaaatgcgagagccagtcttgtagtgttttcatgagtgtttcgttttcaaatgccgtctgaaatcagtctgatgtatcggtttcggcggtttttttcggctgccgccaaagtacccaaactttcagcttgcggtaggattctttgtccgtcatgtcgggcatgatgcattggcggacggttttgccgccggtgtcccattgtaagaataaggcataaggcgtaaccatactgctgcccgacagtgccgccgcctttgccgttttgtctttgccggatacgatttccgcctgtccgtcgcggtctatggtaatggcggttatggcatggcggtgtttcagattcgttatcctgagcgagtatgcgtaacttgccaccaaagccgccaaaccgaaccacatcatccggccgtaaaaccaagtcaggcagacggcaagggaggcggcgtgaagcgatacagtcaggatgttcaggatgcgggacggcctcaatgccgtctgaaaggcgcgcacagccttacatcatgttgtcgaacacgggggtaatgttcaattccgcttcttccatgttcaacactatatcgtggatttcgatgtcgaaaaattcccaaaacgccttcagccccatatcttgcggccatttatccttatcgatgtcccaacctgccagctccgcctcgaaaatctgccggtagcgttcgtcgaagtaggaaacgacggcttccggttcgtcgaactgcggaacgaggaagacggaacagttggcacgaagctgctctatggtcaggtcgggcatattttcgtcggtgcttttgagccattccaaaaagcgcgcggtcggcttgaggacgacggcggtgcggtcaacaaaatacatggttttctttctcaatcatcttgcggtgtcgggatatgctgtctgaacgttcggttttcagacggtatagcatcagtgggtcatgacctgttgcaggaactgcttggcgcgttcgtgtttcgggttggtaaaaaacgcttcgggcgtttcgtcttcgaggatttgccctttatcgacgaaaatcacgcggtcggcaacttcgcgggcaaaccccatttcgtgggttacgcacatcatcgtcatgccgctttctgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagctccattgcctttttctccgcctgttccgcattttgcccttaaccttcatcggtgcgagggtaatgttttccaacacggtcaggtgcgggtagaggttgaagccttggaatacgaagccgacttcttcgcggattttgttcaaatcggttttggggtcggcaacgttgacaccgtccacccaaatctcgccgctttcgatgctttcaagctggttgacagtgcggatgagtgtggatttgccgctgcccgaaggcccgcagacgacgaccacttcgccttttttgatttccaagtttacgccgttgatgacgtgcaggtctttgaaatgtttgtgtacgtttttgaatttgatcatgtcttttctttcagacggcatttgccgttgcaggttgtcgttacgggagctccatatgatgaagcgtgtagcgtctgccgtcaaaaaaacggtcgttcggattggtcaggcaggctgcaagcggcagtatcaggggtaaaagcaggtatttcgtcatcggcttactcccttttcagacgaccttgcccgccagataattgctcaacgccacgtatttctctggcgcgatatgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaaccgaaaacggcagggcgtgataatgctgtttgaaggcttgccgtgtttggcggtttggtgcaaaaaccggctgtctgccgttttgcctgttggaggattgaacgtgtctgaaaatctgcttgaaatcgaaacccatcccttcgatcccgtgttgccgccgaaggctgctgtcatgatgatggggacgtttccgcccaaggaagacaaacgcgcgatgcagtttcattatccgaatttccaaaacgatatgtggcgcgtttatgggctggtgttttttaatgatgcggcgcatttccaaaggttgtctgaaaaagcgtttgatgccgagaaaatcaaggcgtttttgcacgaacgggggattgcgtcctgtccgaccgttttgaaggcggtacgtcagcacggcaatgcgtccgacaagtttttaaaggtagttgaaaccgtcgatttggcggcggtgttggcaaaaatacccgagtgccgccatatttgtacgacaggcggcaaggcgacggaaatcctgctcgatattcagggcggcggtatcaaaatgccgaaaacgggcgaaaccgtgccgtttccgtttgccggacgggatttgacgctgacgcgcctgccttcgacttcgcgcgcctatcctttgagtttggcgaaaaaagcggcggcgtatcgggcgttttttgaaatggcgggcttgtgtgaaaaacagttataattgccgacaatttcccgttcagacggcatgtttgcaaaaacggaaatgccgtctgaaaatttgaagcacaaggaagaatccgatgaagaactaccacgcgcccgacgagaagggctttttcggcgaacacggcgggctttatgtctccgaaaccctgattcccgccttgcaagagctggcggatgcctataaggcagcgaaaaacgatcctgaattttgggaagcgttccgccatgatttgaaacattatgtcggcaggcccagccccgtttaccacgccgcgcggttgtccgaacatctgggcggcgcgcaaatctggttgaagcgcgaagacttgaaccacaccggcgcgcacaaagtcaacaacaccatcggtcaggcactgttggcaaaacgcatgggtaaaaaacgcgtcatcgccgaaaccggcgcgggtcagcacggcgtggcgagtgccaccgttgccgcacgcttcggtatgacttgcgacgtgtatatgggcgcggacgacatccaacgccaaatgcccaacgtgttccgtatgaaattattgggtgcgaacgtggtcggtgtagaaagcggcagccgcacgctgaaagacgcgatgaacgaagccatgcgcgaatgggtcgcccgcgtggacgacacgttctacatcatcggtaccgccgccggccccgcgccgtatcccgaaatggtgcgcgatttccaatgcgtgattggcaacgaagctaaagcgcagatgcaggaagccatcggcagacagcccgacgttgccgttgcctgcgtgggcggcggatcgaacgccatcggtttgttccacccgtatatcggcgaagaaaacgtgcgcctcgtcggcgtggaggctggcggtttgggcgtgaacacccccgatcacgccgcgccgattacttcgggcgcaccgattggcgtattgcacggtttccgcagctatctgatgcaggacgaaaacggtcaggttttgggtacgcactctgtttccgcaggcttggattaccccggcatcggcccggaacacagccatctgcacgacatcaagcgcgtcgaatacactgttgccaaagacgacgaagcactcgaagcctttgacttgctctgccgcttcgagggcatcatccccgcgctcgaatccagccacgccgttgcttgggcggtgaaaaatgcgccgaaaatgggtaaagaccaagtgattttggtcaacctctcaggtcgtggcgacaaagacatcaataccgtcgcgaagctcaaagggattaaactgtaacctcgtccgtctgatatagtggattaacaaaaaccagtacggcgttgcctcgccttgccgtactatctgtactgtctgcggcttcgtcgccttgtcctgatttttgttaatccactataaaaatgccgtctgaagcctgagttcagacggcattttattttgctatgaatttagtattttagaaacgaatctgtattttaatttgtccggatttttgtttttccaattgttttccttttgtaatactgccatttacgtttaatgtaacattacggtacagtaacgcggcacctgctgaatattgctgttgattatctgctttatagacgaaggaattaccgcccacattcacgccgcctttgccataattggcaaagtaagctgcagataacaagggttttacggtaaggttgccgactttaaaccgataagcaaaatccagtccggccgttagtgttttcactgacatagaacttactttaacactgtcgttacccaacttgtaatctgcagatgacaggcggctgtaacggatccccgcactggggacaatctcgaattgattgattttcagcgtattgcccaaagtaaggccggtttggatgcttgctcggttaaagtttgctttttgctgcgtttgtaaccggcttctcaagctgcctgcaccaatatcgccggccacataccaagcatcatttaaataatacttaccataaaggttggcttgcacaaaagtatttttgccgctcgcctgatcaaaagtatgctgactgtcagagtaagtcaatacgccgcctatctgcatattttcggacaagctgcggtcaatgccgatttgtgtttgcgtgcgtttcgaactaaaccggcgatattgtgcggaagcataatcacgaccataaccggtgttcgacatccaaacactgtttttttcggcatcagcgcgtgatttttgtgcaatgtgccgtgttaatgaagcacctgtatccaacaagatagattgcgtgcttgccattgcgtcagataaagccgagttggtattggtgctgactgcatcggcttgcgcggcggcttgggcttgcagctgagtggcggcttgggctcgcggctgcgcggctcttggttgcaaactcactgtctcaactttttcatgaagttccgtattgtcttgaggctgtttgtctgatgtgtcaaccgattcggatacatcttcatcttccaacgcatccaaggggatttcttcataatcattttcatatttttcatgaagttccgtattgtcttgaggctgtttgtctgatgtgtcaactgattcagatacattttcatcttccaacgcatccaaggggatttcttcatagtcattttcataccagtccggattatgcaaggccctgggtgctgcgtaagctgacgaatcaaatgatggcgagggcggtgccggcagagtagatctgcgtccgcgacgtttcggacgattttgggaagctgccatataatcctgaggtgcggcacggcgttttcggcgttgcggctgggattgggctgcttgacggtgctcttcttcctcagcttttcgtttcgccgattctgccgcttctcgatctgtttcggctttttgttttgccgacaactctgctgcttggcgttccgcttcttgacgacgtgcaagttcggcggtctggcgagcttcttgctggcgttttgctgcttcggctgctgccctttgcttggcaagttcggcggttttgcgttcggtttccgctttttgtttgacggctaactctgcagcttttcgtgcttcttcctgttgacgcgcaagggctttttgttggcgtgccgccaatgcttgggcttcagctgcggctttttggtttgccgacaattctgccgctttgcgttctgcttcctggcgatgtgcaagttcggcagcttggcgttttgcctcttcggcttctgcttttcggcgcgcagccaatgcttgagcttcacgttcggcttctgccctttgttttgccaacaactctgccgctttgcgttcttcctgctgtcggcgcgcaagttctgcttgggcttgggcaatttccacattgttttgctgtaccgaacggtgtccgcggcgtttaggacggtcttgggaagctgccatataatcctgcggtgcggcacggcgtttgcggcgttgcggctgggattgggctgtttgacggcgttcctcttccccgaccctttgttttgccgacaactctgccgcttcgcgttctttttcatgccggcgtgcaagctctgcagcttggcgttttgcctcttcggcttctgcttttcggcgtaccgccaatgcttgagcctcacgttcggcttcgactttttgttttgccgacaactctgccgcttcgcgttctttttcatgtcgacgtgcaagttcggcgctgctgcgttcttgttctgctttttggcgggtcgccagctctcttgcttcgcgttcggcttctgctttttgttttgctaactctgccgatttacgctctgcttctgcttgctgacgcttcacttgctccgcttttgcttgctggcgttttgcttcttcggcttgatttgcctgcgggctaggcggtgcgacgacgatattttgaggcttggcaatttgtgcaccgtccgtttgtgttgccttttgtgcttgagaagccgtgtttgtggcaggagacggggccggtttgactcggcggcggttctcggcataaggattgtacaatcgggtaataccgttttctgttttgattgtataacgcaatgcccctaaatctacatggttattcgccaaggaaacagaaaggcgggagcggtcttgtacggatgatgcatcaaagagattcagcccttcctgattgggttcgcctgttttatcttgaacatggagctgataatgaccggatgcggattccttcacaagcactttatccccaagatttttcgccaggtgcgtcagataatgaaaatgcccgttaccggataaatgattgattttgagcgtgtggtatttatttgcactttgcgcatcggaggcattgttcaaatgaatatggctatccgccaatgacagattgtgtacttggctgtcgccggtcaaatgccatttgctatgttggtttaggctgacacggctgtttccttgcccttgaatttgcccccataatgcagccttgcccaagaccaatgccgcattctggttcagattcacattgccgttaatctgtgtcgctccaaagctgtttaaagccttatcggataagttgcctgtgttgcaggtaacgtaaccggtatagtccgagcgcacgcaaacctcatcgccgtttttgtaacccaaatttactttggcgttgtctgttgcggtgatgttggcggtgatgtcggatacatttctgccggaagagaatgatgcggattgattaaccgcaatttctgtggctttgaatgtgcggtttatccagtcgtcttcaaatacgacttcattgtttttggagaaatgtgcgtcttttcgggctgaagatttgttcacaaaatctcttgcgtgtggtgttggacgacctgataacaagacattgccttgagttacgcttatttttccgtttaaattagtgccgcctgttaacaagaaacggttttgcgcgcttttgccgttgaaattaaggtttaatgcaccgttatgtccttttccgttttcttcgccaaagaaaccgctaaaaccgctaatacgctgattgtttttgtggttcatcgcgtttttcttggcttcttcttgtgtgctgcccattaaaatccagtcgttattttccgtttgtccgttttcgggcatcggtgcgttcacgctgccgccggattttagggcgtaataacggtagtttttgaaataaagatctttgccttgtggaatcggtttcctagggcggtaatagtaataaccagcatcgtcatcatcattattttgaatataatgaatagagatggttttgggatcggtaatcaaagatttacccgttagcgtgattgtggaggcgtggcctgtgttgtggttgacaatgcgcgcgccttcatccacgttgcggatgtgttcaaaagtcaagtcattgccattggcatccaaacgaccgccacggaaaccgaaatataggttatcgggattaatctgatttgaactatttaataccaatgtaccgcgtccgctgacaatgccgacttgggagaaagcctggacttttttgtcggcatcggcttgttgattcagaataaccgtaccgtcgccgacttttaattgcccttggttaacgcctgtgccgtttatttctaatgtgcctttgccgatttttgccaatctgtcgccattcggatttttgacttgccaaacgacttttttgccgtcggcaacatcaatccccgcacctagccaagtgatgtcattatttatacctttgactgtgtaatcgcctttgaaaaacagaccgcccgcgccttggttgatgttttgatccaataccaaagtgccgttgttttcaaaggtaacattctgtccgttgtttgcatccctttcattgttggcaagccttaccgctgtcgaaccgatatggctgtttgtgcccgtggttttccaatgatgttctccattacctttgatggtgccggcgttatcgcgttgtttgatttcatctgcaaattcttttttatagatattccattcttgccaagagtttttttgatagcctgcccaataatcgtaagcacctaaaaagacccagcgtttttcttgtttatcataagcaaataatggtgaaccgctatcgcctaacacagcatagttagtcaatgcgttttgagataaaacttctttgagtttttctggggaatgatgttttgaattatcaccgaagccaatcaagccttcttgatttagattcgatgtgacattcacgtcttgataaggcgtacctgcaatggcataacgataagctcgtgaaagctctgtcatattgtagcggctgttatattcaaattgcgtacctgctccaactcgcacaaactcagaaaaacggtttttatctttataggtttcaacgccgccgcctgcactggttggtgcaataggtgcgacttctgttacgaatttattaaggcgtgccatgttgtagtcttcaagacgaccttgattaccgtgatgccaatttttatttggttcgtagtcattttgtgcaactgaacgatattcgttttcatcattgctaacatctaagtgcccattgtgatgcccgtaataagagatttcgtctccttttacatgtttgacgctgacggcatactggggatcgatgacggttaatgtacgtctgttgacatctgcaacgctaaaatcaatcatcggtacgttggataatgcgttgccgatgttttgaccttgtttgtttttcactgataaatcggttgcgccgacaaaaaatttgcctttgttttctgcaaagtcacggaatatttgataatcgacatcgtctctgaccaatgccgcttctgagtatggcgtaagggcataggcaagaaagatggataaggatatggcgttaattttaaaacgtttggttttcataaggttttaccgttttaagggtgataatgttttgtattttacgccggtttggtggtgttgactattttttgttgtgtaaatcattcattttggtgttttattgccaatttaaaaaaagaatcccgatgtttttatttccgcttcctttgttctgttattcaagcgaaggcgggaagccgattttcggggttcggttcttccgttaaatttctgcggctttttgtttttggattcccgcttttgcgggaatgacgggattttaggtttctgattttggttttctgtttttgagggaatgacgggatgtaggttttcttaaccctgagtcctagattcccgctttcgtggtaatgacgagatgggggttcgtgggaatgacgcggtgcaggtttccgtacggatggattcgtcattcccgcgcaggcgggaatctagaccttagaacaacagcaatattcaaagattatctgaaagtccgagattctggattcccactttcgtgggaatgacgggattttaggtttctgattttggttttctgtttttgtaggaatgatgaaattttgagttttaggaatttatcgggagcaacagaaaccgctctgccgtcattcccgcgcaggcgggaatctagaccttaaggcagcggcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagaacgtggaatctaaagaaaccgttttacccgataagtttccgcaccgacagacctagattcccactttcgtgggaatgacgggattttaggtttctgattttggttttctgtttttgagggaatgacgggatgtaggttttcttaaccctgagtcctagattcccgctttcgtggtaataacgggatgtgggttcgtgggaatgacgatggaaagtttgccgttgtctcggataatactgaggcttttcgtttgcattcttatagtggtttaacaaaaaccagtacagcgttgcctcgccttgtcgtactgcttgtactgtctgcggcttcgtcgccttgtcctgatttaaatttaaaccactatatcattttcaaatcttgttatgacggtttttcggatttgctttattatccgtttatttttgaaatatctggggtggggagacgtgttccgtcgttggtttttgccgtgttgggttgtcggcgcggcggcttcgtttgcgctgccggtcgtgccgcattggctgttttggctggcggcttttgcggtttttgctgtgtttgcaaggcgttttgcgtttgccggtctgatgctgtgcgtgttggcgggcgcggcttacggcgtattcagaacggaagcggcactgtcttcgcaatggcgggcggaggcggtttcaggtgtgccgttgacggtggaagtggcggatatgccgaggtcggacgggcggcgcgtgcagtttgcggcaaaggctgtggacagcggtggtcggacgtttgatttgctgctgtcggactacaaacggcgcgaatgggcggtcgggagcagatggcggataacggcacgtgtgcaccccgtcgtcggcgaattgaacctgcgcggtttgaaccgtgaggcgtgggcattatccaacgggataggcggcgcggggacggtcggtgcggacagggttttgctgcatggcggaagcggttgggggattgcggtttggcgcagccgcatcagccgtaattggcagcaggcggatgcggacggcgggctttcagacggcatcgggctgatgcgcgcgttgagcgtgggcgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcccggccgcgcgtgtgggttttggcggcggggtgtgcaggcgcgctgttttacgcgctgcttgccggtttttccgtgccgacgcagcgcagcgttttgatgttggcggcgtttgcgtgggcttggcgcaggggaagattgtcggcgtgggcgacgtggtggcaggcgttggcggcagtgctgctgttcgaccctttggcggtcttgggtgtggggacttggctgtctttcggtttggtggcggccctgatatgggcgtgttcggggcgtttgcacgaagggaaacggcaaaccgccgtgcgcgggcagtgggcggcttcggtgttgtcgctggttttgctcggttatctgtttgcttcgctgcctttaatcagccctttggtcaatgcggtggcgattccgtggttttcttgggtattgacgccgctggcgttgctgggttcggtcgtgccgtttgcgcctttgcaacagttgggggcatttttggcggaatatactttgcggtttttggtgtggcttgccgatgtgtcgcccgagtttgccgttgccgccgcacctttgccgctgttggtgttggcggtgtgtgccgctttgctgttgctgctgccgcgcggcttgggtttgcgtccgtgggcggtgttgctgttggcagggtttgtgttttaccgttcacccggcgtgccggaaaatgaggttgcggttacggtttgggatgcggggcagggtttgtcggtgtcggttcagacggcaaatcatcatcttttgtttgacactggaactgcatcggcggcacagacggggattgtgccgagtttgaatgcggcgggtgtccgccgtttggacaagctggttctgtcgcatcacgacagcgaccacgacggcggttttcgggcggtgaggaatattcccgccggcgggatttatgccgggcagccggaattttatgagggggcgcggcattgtgcggaacagcgttggcaatgggacggcgtagatttcgagtttttgaggccgtctgaacgcaaaaacatcgatgataatgggaaaagttgtgttttgcgtgttgtggcgggcggtgcggcactgctggtaacgggcgatttggatacgaagggcgaggaaagcctggtcggcaagtatggaggcaacctgtacagccaggtgttggtgttggggcatcacggcagcaatacgtcctcgtcgggcgtgttcctcaatgccgtttcgcccgaatatgccgttgcttcaagcggttatgccaacgcctacaaacatccgaccgaagcggtgcagaaccgtgtccgcgcacacggcattaaactgctgcgtaccgatttgtcgggtgcgctgcaattcggcttgggacgcggcggcgtgaaggctcaacgtttgagagggtataaattctattggcagaaaaaaccgtttgagtgaggtttgaaacataaaatgccgtctgaaacggattcagacggcattttggcgttaacgccggttcgtgctggcaaggcatatcgtttgattttcagtgtgcgtcaaaaacagaaagggcgttgcggttaacggcagggagaaccgtttgaatgaacggaaaggtttgcgccagaaggggaaatgccgtctgaaagggcttcagacggcatccggacatcggtgcggaatcagtgccagtaacgccaccagggcatatcgtcagatcgccacggctgctttaagaacgggcttttcgggaagttggtttccaacacgcggcgcgtatcggcggcaagccggggcttgtccaacttcttgtaggcaagttccaatatggcgagcgattcttcgacatagcgtgtattttgatagctgccgataattttttgggcgcggttggcggcggcgatatatgcgccgcgtttcatgtagtaacgcgctaccgacatttcattgccgcccaaagcatcgaccagtttgaccatgcgtgcggtcgcatcggcggcgtatttgctgttcgggaagcgttggacgagttccgcaaaggcctgatacgcttcgcggttggctttcgggtcgcggtcggaccagtcttgcgaggccagcttgttcaagaaagattgatcttcgttgaacagtaccaaaccgcgcaggtatagcgcgtagtccatattcgggtgttgagggtgaaggcggcggaagcggtcaatggcggccagcgccttatccttctcatcatctttatagtaggcgtatgccgtatccagttgggattgctgggcatggcggctggtagggaagcgcgattccaagatttcgtataatttgacagctcgcgtataattgctgctgttcagctcgtcctgggcttcggcatagagtttttccacactccagtcttgggtaatctgggcatctttatctaccgtaccttgagtggcacaggcactcagtgccaaacctaatgaaaccgttaaaagaatttttttcatgcagaatacttcctttgataatgaatccgattatagcgacgattcagactttgcgtcagcttccgaaactgaaaaccgtatcggtctgaccgttccgctcgagcttgcaggcgggcggttggatgcggtattggcgaaacttctgcccgactactcgcgcagccgcctgacatcatggattaaagaaggcgcggttattgtaaacgataaaccttcgcaacccaaagacaaaatgataggcggcgagcaaatttgtgtaaccgtccgtccgagtgaggaaaatctggcgtttgttccagagcctatggctttggatattgtttacgaagacgataccgtcatcgtcgtcaacaaaccggccggactggtggtgcatccggcggcgggcaactggacggggacgctgctcaacggcctgttggcgcactgtcccgaattgagccaagtaccgcgcgcgggcatcgtacaccgtttggacaaggaaaccagcgggctgatggtggttgccaaaaccctgccggcgcaaaattccctcgtgaggcagcttcaagagcgcacggtcaaacgcatctaccgcgccgtcgccaacggcatcgtccccttcgacggtaaaatcgaaacccaaatcggacgcgatccgcacaaccgcctgaaaatggcagtcgtcaaattcggcggcaaaccagccgttacccacgtcaaagtgttggaacgctatcttacccacagctatatcgaatgctcgctcgaaacgggcaggacgcaccaaatccgcgtccatatgcgcgaggccaaccatccgcttgccgccgacccggtttacggcaacccgcgccatccgtgcggcgacacggtgaaagaagccgttaaaagtttgggtgcgcgtcaggcgttgcacgcctaccgcttgagtttcacccatccggaaagcggcgaaaccgtttcgtttgaagcaccgattccaaacgacatatatcatttgttatccgtcctccgtcttgaagccggtttggattcgtctttgagcaatgaagaagaatggcaggacaaattcggcgcggacgacgacgatgattggaacgaagacgactatgatgtcgaagtggtttatgtaagggagtgaggcggcttgaaaggcggggcgaacgcaggcagccgaatcggagcagccgggcaatcgtccccgccgatttcaaacaaaggccgtctgaagggaccgggcagaaaccgccggttttgtttgccccgttcagacggcattatgataaaaggcgtttagggttttttatgtttaccggctttggccgcccaataagttgccagcagcgagccggagatattgtgccacacgctgaacaatgcgcccggaacggcaacgaccggcgcggcggcaaagtgtgcggcggcaagcgcggcggccaggcccgagttttgcataccgacttcgatggtcagcgttttttgtgcatcataaggcaggccggtccatttggcggcaaagaagccgagcaggtagccgatgccgttgtggagtacgacaaccgcaaaaatcagcaggccgctttccataatcttgcctttgcttgccccaacaaccgcgccgataatcagcacgatggcggcaacggaaaccagcggcagcgcatcggtcagcttttcggttttactgcccaaaaccttatggacaatcaaacccaaaacaatggggagcaaaaccattttgacgatggacatcaacataccggccgcttggatttccagcatttcgccggcaagcatcaggaagatggcgggagtcagcaatggggaaatcagggtggaaacagacgtaacggcaaccgacaaagccacattgccacgcgccagataggtcatcacattggaagccgtaccgcccgggcagcagccgaccaaaatcacgccgaccgcgatttcggcaggcaggttcaacagtttggacagcagccaggcggttgccggcataatggcgaattgtgcgattacgccgatgatgacgactttgggatgtttgaacaaaatatcgaagtcggaaggtttgagcgtcaaacccataccgaacataataatgcccaacagccaaggaatataaggccccgcccatttgaaggtgtcgggcgcgaaaaaagcggcggcggcaaagagcgcggcccagagggaaaatgtttttctcgataaagctgctgattttactgaggatattcataaataatgcgttgcgtgtttg

SEQ ID NO: 68 - DNA, 520 bp, Neisseria meningitidis
  misc_feature (7)..(7): N is any nucleotide
  misc_feature (15)..(15): N is any nucleotide
  misc_feature (123)..(123): N is any nucleotide
  misc_feature (157)..(157): N is any nucleotide
  misc_feature (179)..(179): N is any nucleotide
  misc_feature (337)..(337): N is any nucleotide
  misc_feature (505)..(505): N is any nucleotide
  misc_feature (520)..(520): N is any nucleotide
atgacgncatagggntttccgttttcccgataaattaccacaacccaaaatcccgtcattcccgcgaaaggatatatccggctcgttcggtttcagttttttaggtttcaggcaacttctgantcgtcattcccacgcaggtgggaatctaggtctntccgcacgggaacttatgcgcngtcattcccgcgaaaggggatgccagattcttcggtacagaaacttatcggataaaacggtttctttagattctacgtcctagattcccgcctacgcgggaatgacgatggaaagattgttgttgcttcggataaatttctgcagttttaaataaccngattcccgcctgctcgggaatgacggcataggtttttttgtttttccgataaattaccacaacccaaaatcccgtcattcccgcgacggcgggagatccagtcctttaaactccagccattcccgataaattcctgttacttttcgtttctagattcccgattttcgngggaatggatggatn

SEQ ID NO: 69 - DNA, 10000 bp, Neisseria meningitidis
catggtttggatatccatgctgctccctatgtacataataaaaaaatggccccgtggccatttttcgtcaaagttgaaaaatcggcgtgattataaccgcttttgcggagaaatgaaagtgttgatttattttgtgtttttgggacggaaaaaagcgggtgtaagggaggtttgtaatgggaaatcgtgaatattgttgacaaaacaaatgtatctatttgtcgcgtgcatgatttttatgtttgtaaatcaatatattgatattattttccgtgttcgggcggcatggaatcgggcggaggacaggtattttccatccttgcacaaagcctgctgcaagcctaaaatcgggcgggttattgttcagaatcaaggctgcatcatgtctctttatccgatttacaatttttccgccggccctgccgtattgcccgaagccgtgttggaaacggcgcggcaggaaatgttggactacaacggtacgggttttcctgtgatggcaatgagccaccgttcggaaatgtttttgagcatcctgcatcatgcggaacaggatttgaggcagcttttgaaagtgcctgacaactataagatattgtttctgcagggcggagcaacaacccaatttaatatggcagccatgaatctggcacacggtttccgcactgccgacgcggtggtaacgggcaactggagccgtatcgcttatgaacagatgagccgtttgaccgatacggaaatccgtttggcggcgcatggcggcgagcagttcgactatctcgacctgccgcctgtggaaacgtgggatgttgcacccgattcggcgtttgtccattttgccgtcaatgaaacggtcaacgggctgcaataccgtgaagtgccgtgcctttcagaaggcatgccgccgctggtgtgcgatatgtccagcgagattttgtcgcgcgagtttgatgttgccgactacggactgatttacgcaggcgcacagaaaaacatcgggccggcaggagttacggtggtgattgtgcgtgaggatttgctcgagcgttgtccgaacgatattcccgatgtgttcaactaccgttcgcacatcaaccgcgacggtatgtacaacacgccgtcaacttacgcgatttatatgtcggggctggtgttccgctggctacaggcgcagggcggtgtgaaaaaaattgaagcggtcaatcggctgaaggcgcaaaccttgtatgagacgatagacggcagcgatggtttttatatcaaccgtatccgtccgaatgcgcgttctaaaatgaatgtcgtgttccaaacgggggatgaggagcttgaccgccgttttgtgctggaagccgaattgcagggcttgtgcctgcttaagggctataaaaccgtcggcggtatgcgtgccagcatttataatgcgatgccgcttgaaggcgtgcgggctttggcagattttatgcgcgatttccaacggcgttacggttgatgtcccgatgttgtctgaagcggcttcagacggcatcggctgtttcggcgttctccggcggcgttttggaggtggtaagattgtgctgccggcggctatccgtccttttcaatccgagcgtgatgctgtttgtgccggactgtcccgtcggcggcgcggctgggtttttccaatatgaaatgctttgcccgtttttctggcaggggcggttgcagaccggttcgaatcttgcttacgatgtttttatgtctgccggacgtttgaatggcgggcggaaccccccgcacagccgccgttttcttgccctgctttgctccgttgccttataattaagaatctttttcaataatccggattccaaatgccggatgccttttccaacccttatccgacacattccaaatgataaaaccgaacctgaggccgaagctcggctcttccgcgctgattgccttcctttccctgtattcctcgctggtattgaattacgccttttttgccaaagttgtcgagcttcatccttttaacggcaccggggcggatatcttcctctatacgatgccggtggtgctgttttttttaagtaatttcgtttttcacgtcattgccctgcctttcgtgcataaggtattgattccgttgatattggttatcagtgcggcggtgtcttaccaagaaatatttttcaatatctatttcaacaagtcgatgttgaataatgtcttgcaaactacggctgccgaaagcgcgcgcctgattacgccgggctatgtgctgtggattgtatgtttgggcgtattgcccgcgctggcgtatatcgccgtcaaggttaaataccgcgtttggtataaggagcttttgacgcgccttgtgcttgccgccgtttcctttttgtgcgcgttgggcatcgcaatgttgcaatatcaggattacgcctcgtttttccgcaacaataaatcagtaacccatctgattgtgccgtctaatttcatcggcgcgggcgtgtcgaaatacaaagattggaagcgttccaatattccttatacgcaattggatatggcggtcgtgcaaaaccgcccggccggcagcctgcgccgtttcgtggtgctggtcgtgggcgagaccacgcgtgccgccaactggggtttgaacggttacagccgccaaactacgccgctgcttgccgcgcgcggcgatgaaattgtcaatttcccgcaggtcagaagctgcggcacatcgaccgcgcactccctgccgtgtatgttctcaaccttcgaccgcacggattatgacgaaatcaaagccgaacaccaagacaacctgctggacatcgtgcagcgcgccggcgtggaagttacttggttggaaaacgattccggctgcaagggcgtgtgcggcaaagtgccgaataccgacgttacctcgctcaacctgcccgaatactgccgcaacggcgagtgcctcgacaatatcctgctgactaagttcgacgaagtcctcaacaaaaacgataaagacgcggttttaatcctgcataccatcggcagccacgggccgacgtattacgaacgctataccgaagccgaacgcaaattcacgccgacctgcgacaccaacgaaatcaacaaatgcacccgcgccacgctggtcaacacttacgacaatacggttttgtatgtggaccagtttatcgacaaggttatccgcaaacttgaaaaccgcgacgatttggaaagcgtggtgcattatgtttccgaccacggcgaaagtttgggcgaaaacgggatgtacctgcacgccgcgccttacgccatcgcgccttccgggcagacgcatatcccgatggttatgtggttttccaaagccttccgccaacacgggggcatagatttccaatgcctcaaacaaaaagcggcggaaaacgaatattcgcacgaccactatttcagcacggtattggggctgatggacatttccaatagccaaacctatcggaaggaaatggatatattggcagcctgccgccgtccgcgctgatgccggatatgccgtctgaagccttcggacggcatatgtgtccgaacacccgaccgatgaccggagtataacgatatggatgctttaaaattattgacgaaccgccgatcttccaaaaagctgaagcaccccgcccccgatgcggcggagttggaacaaatatttcaggcggcaacccaagttcccgatcacggcaatatgcgccccttccgttttaccgtgattcaaggcgaggtaggattgcaacgttttcgcgatgtgttgaagcaaacggttgccgaattgaatttcggcgacgatgcgatgaaaaaggcggaaaaagtgggcaatatggcgccgatggttatcggggtaacgtttgcgccgaaccgcgatgtgcctaagccgaaaccggaatgggagcagatgctgacggcgggttgtgcggcgtatgcgctgcaactggcggcaacggctcagggattcgacaatgtctggattacggggatgtgggtcaatagccccctgttgcgggaggctttcggttgtgcggataaggataaaatcatcgggctgatgatggtcggcacgccgacagaggaagtgcataagcccaagaataccgatttggaagcgtttgtcagccattggtaaacggaatctcaagcacaatgccgtctgaaaggctttcagacggcatttttccatgcgttttaaaccggattcatgaaacgcccgatgcgttcggcggaaatgtcgggtgtcgcgccatgttcggaggcgaccagcgtaccaagtacgcaggcaaaggtctcatgccgtctgaaggttcagacggcatcggtatcggggaatcagaagtggtagcgcatgcccaatgagacttcgtgggttttgaagcgggtgttttccaagcgtccccagttgtggtagcggtatccggtgtccaaggtcagcttgggcgtgatgtcgaaaccgacaccagcgatgacaccaagccccaagctgctgatgctgttgctttcgtgataggcaggtttgctactcggtctctctgggatagtgcctcccactgtagcgtctcccgttggtgcagtggtataaatcgtggttttggtttccaccgaatgaacctgatgtttaacgtgtccgtaggcgacgcgcgcaccgatatagggtttgaatttatcgaatttatcgttgagtttgaaatcgtaaatggcggataagccgagagaagaagaggcgtggaacgtaccgtttccctgattttccgtcttcagttttatcctgttgccctggttttctttcaacacttttgtgttgacggaatatttattgttgctccattttctgtaactggcataatctgccgctatcctccagccgccgaaatcgtagccgactgacactcgggggtggatggaatgcgcacggatgtttctgaaataatcgcttactgtgcttattttgtctttgtctgtaccggttgctttcggataatcgtgggtaatacgttcggcggcataagctaaatccgcctgcacataatacgggctgcggctgccgtcttcacttgccgcctgcgctgcggaagagaagagaagagaagagaagagaagagaagagaagagaagagaagagaagagaaggttttttgggggctggattcattttcgactccgtattcggttttaactgattaaaaagaaagattttcaatgatgttgcaggagcggactatatcaggtttgtggcgatgtttcaacacaatatagcggatgaacaaaaaagagaacgattctctaaggtgctgaagcaccaagtgaatcggttccgtactatctgtactgtctgcggcttcgccgccttgtcctgatttttgttaatccactataaggaccgtcgggcatctgcagccgtcattcccgcgcaggcgggaatctggaatttcaatgcctcaagaatttatcggaaaaaaccaaaacccttccgccgtcattcccacgaaagtgggaatctagaaatgaaaagcagcaggaatttatcggaaatgaccggaactgaacggactggattcccgctcaggcgggaatctagaatttcaatgcctcaagaatttatcggaaaaaaccaaaacccttccgccgtcattcccacgaaagtgggaatctagaaatgaaaagcaacaggaatttatcggaaatgaccgaaactgaacggactggattcccgcttttgcgggaatgacggcgacaaggttgctgttatagcggattaacaaaaaccagtacggcgttgcctcgccttagctcaaagagaacgattctctaaggtgctgaagcaccaagtgaatcggttccgtactatttgtactgcctgcggcttcgtcgtcttgtcctgatttttgttaatccgctataaagaccgtcgggcatctgcagccgtcattcccgcgcaggcgggaatctagaccttagaacaacagcaatattcaaagattatctgaaagtctgagattctagattcccactttcgtgggaatgacggttcagttgctacggttactgtcaggtttcggttatgttggaatttcgggaaacttatgaatcgtcattcccgctcaggcgggaatctagaatttcaatgtctcaagaatttatcggaaaaaaccaaaacccttccgccgtcattcccacgaaagtgggaatctagaaatgaaaagcagcaggaatttatcggaaacgaccgaaaccgaacggactggattcccgctttcgtgggaatgacgggatgtaggttcgtaggaatgacgtggtgcaggtttccgtgcggatggattcgtcattcccgcgcaggcgggaatctagactttagaacaacagcaatattcaaagattatctgaaagtttgagattctagattcccactttcgtgggaatgacgggatgtaggttcgtgggaatgacgtggtgcaggtttccgtgcggatgaattcatcattcccgcgcaggcgggaatctggaatttcaatgcctcaagaatttatcggaaaaaaccaaaacccttccgccgtcattcccacgaaagtgggaatctagaaatgaaaagcagcaggaatttatcggaaacgaccgaaactgaacggactggattcccgccttatatgatgcgctctatcaaaggggcgcattacttttcttaacattcccctttgacagccaagtgaaaggggcttttttatgtcagtagcaaatgtaatattttcttgttcctattggagaatatttaaaaaatcagattattgcgttttatgtttctatcagttcaggcatggtgaaccgcataaactcgctgaacaagaaaatttttcaaagctttatcaggcgttcgattatatagattcggttggctcgaattttccggtaattatcacaacagacggttgtggtctttcttcttgatctttaacagtttgtcaggattgggctttcggtcgttgaccgttggacgcgctttagcgcggcagacgggaaacggctgaaagcccccccctgactaacagggggggagcgaaataaaacaaatccctaaaggtactgaacaaaatgagtgaagcagaatatttttcccatttcatatctaacggcaatgggaagttattagaaattccgcaacgtaggggcaggcaggacggcgtttttatagattggttgtcattcacactgcacgaagattccttgctgaaagtttccggatgccccttagtttccgatgccgaatatatgtttgttttaagcaaaaaattggaggaaatattagggtttggcatcacgagcagatgcaaatcgaagggcaataaattttacgattcgatgtttaggttgggatcggaagaagttgactacggcgaagtccattacggaggtcagcgaaatacggttttaatcgaattgaaaggtgtaggttgcaacattgcaaatccaggttgggaattgaggcttaagcagtttttggaagattcattgaggccgaggataacgcgggtagatttggcacttgatttttttgatggggagtacacgccggaacaggcacttttggatcacgataacggttttttcgataacagtaacatgaggccgaaatctgaaatggttggaacggcttggcggagagaggacgggagcggcaagacattttatgtaggtcgcaagaaaaattctcgttttgtgcgtgtttatgagaaaggcaggcagctaggcgataaagaaagcaagtgggtaaggttcgaaattcagtttaatcatggagatatggaaatacctttggatattctgataaatcaaggttcttacttttcaggcgctttcccgatttgtcagaaatttaaaaatatgccgaatccggaaaggttcgattaccgtaaaaaagtggctaatttaacttttcagcataaattgagatacgcaaaaaacgcggtcggcaaactgattaatttcatgtttgatatgggttttgatagtgatgaaattgtcagatatctgaaggcagatttggggtatcccaaagggctagaacctgaaaaatattcgttggccggattgaaggaatctttgaaattcggctttatccacgaacaaccggatgtagatttagaggttgaattggaagaactcggaattatcaaatttaagcaatcagataaattcgatccggataaaaggcttttcgatccacatcacgatgtggaaagtgagaggcaatatcagctttatctcgacagaatgtatgatcttcatgcaaatcaaaattaacctaaaaaggaaaaattaatatgtttaatcaaactcaaactgtaacttatcccgcaacttttttaggagctaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaatatcatgaaaatgaaccttgcaacactaattatcggctgggtggtctgtatgtttctttttcttttcgcaatcctctattttatcggctaaaaacgagattcggaaaagacttcgtccggatgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataaacagagtgaagaaaaaggggcgtataaatgggctatcgtgtcggcataaattgttttgatacaagattgcatgcagacgactatttattgtcgtcccttcctcctactgttacccaggacggaaaaatcatcaggccggaaagggtgggcgaaaaatgggtcttgaacggaaagccggtaatgttgtcctatccgaaatgttccaattttgagcagatcaaacagggttcttatgtcggttcgacggttttaattctgttcgtagtcatttacggcttcaggcttttgattaattttttaaaagacatgggcaaggttgggattgattgatggttattgatttttggtttcttctcggtttcttcttggctttgtctgtcgctttgatatttaaatgacgtgttttaaaatcaggctttcaaaacaacctttgaaaggcagaacaatgaacaaaccgtttatcacgcaggcgcagttggcactttataaatatcagccgtcaagcaagtattatggtaaaacaatggcatatactttcgctagtgagcttttggattattcaaaagttaataaatttataattcatgaagaaatccaatgttttttaaatagaaggatttctaataatatttggaaaatttatttttctgatgagtctgtygcgtatataaaaat

SEQ ID NO: 70 - DNA, 21091 bp, Neisseria meningitidis
caatgcggattcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaagccccagccaaaccggtgctgcccgcggataaaaaataggggaacctgtaaaggaaagggcatcggccgccgtcggtgcttttttgtttggaagggaaatggctaaaatatgtagcattatgttctgtatcgttgtttaccgcttccgcacctttgtccgccttaaagcaggtagacaccgcaatgaatcgacgcaaagaaaatgccgtctgaacatgcgttcgggcggcgttttgttggggggtatcggagcggaacgtctgaaaaagggtttcaggcggtctttgggcgtgtggtgacagtcgaaaacgtgataaggctacctgaaaagtttgggagattttcaggtagcctttggtattgggcgcaacagacgcaggtacagattagcggtgtgccgtaatcgtacgaatgccgattcaacctaagcagacatcagtatttaggaagtggatgtttgatggagcaaaggttgtaccaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaaaaacaaaatagtacaatactcaactttgaaggtctaaccatggcatactctgcggacttaagaaacaaagctttaaactaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagtactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaaaaagaaaatcatgccggacagtattgtttataccgatagtctgagcagctgcgacaagttggacgtgagcggttttatccattaccgcatcaaccattccaaggaatttgcagaccgtcagaaccacattaacggcattgagaatttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttagggctaatctagtacagcacctaacaaaaaccagtacggcgttggctcgccttagctcaaagagaacgattctctaaggtgctgaagcaccaagtgaatcggttccgtactatttgtactgtctgcggcttcgtcgccttgtcctgatttttgttaatccactatattttagataatgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgactatagaacgttgcggctacgcggaagccgtactcgttggatttggagcggcccattttggttttgtcaccgtccaagacaatctcacggggtttgtagattgttttgtgacggtagtatggatcaaactcgagaccgacgctgtcggtcaactgtttgcctacattcagaccgataccgacactccaacctttggcgcttttgctgacatcgcgggaagcacccatctgggtcgtcatcactttggttttgccgcgcaaatctgcatatgcatccgcccaaggggtcagggatcatccgtcccccaaatcttggcggatttcgccatggactttcaaagcaaggttttcatgcttggtaacggtgtttttccttatcgccgatgatggctttgcctttgccgttagactcgggaatatcggctaccgtaacggcggacacggctgcaagtgagagtgcaagcagggttttttcatgtttttcttcctataatgaggataaataaatggaaaaagtgtgggaaatacccgcattcccattaaatcttttttcaagcaatgagttctttttgttttcaacattttccttgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctctccttgtgtatgaaattttgccggatgtgaaggcggaatcggcagcgggggtgttctgtaccggattgtcgtggaaatgggaaaacggatgttccgtgcaggtttgtccaaatgaatggcgggtattgtttttatcaatctgtttctttttatttgaaataaaatttctaaaataataaaaatatgaaatttaaaatctataaaaaaagatatatcagttattttgaaataaaatagctttgtagtaatatgttgcacttgtttgtgcaaggtaaacgatgtaacctaagccgcgtataaaaacccatcaggaaagatgcaagatgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttgagatttttgacgcagaatgtcataaaatgtcgtctgaagcgttcagacggcatttttgtggaggaaatatgctcaaaataaccctaattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggcggcaagtttggaggcggcattggcattgtgcgcaggcgcggaagaagccgtcattatgggcggcgcgcagatatacggacaagcgatgccattggcgaccgatttgcggataaccgaagtggatttgtctgtggaaggagatgcatttttccccgcaatagaccggacgcattggaaagaagcagagcggacggaacgccgtgtcagcagcaaaggcacgcgctatgcttttgtgcattatttgagatattgaaatataaactctctataaaatcccccgcaaatgatgggctgaaatagaaaatattgttattcccccgaagatgggaatccgggattttaaagttagggtaatttatccgaaataacaacaatcttccatcgtcattcccgcaaaagcgggaatccggaaacgaaaagctaaagcaatttatcggaaaaaaccgaagtttaaagaaccggattcccgcctgcgcgggaatgacgagattttaggttatggggatttattgggaataatggaacaaagaaagcagaaataaggatatagaggctgtctttggatttgcgatggttgtcggagaatgccgtctgaagccgtttcagacggcatttttccagcttgagaacggatgcctgctcaaataagcattggtaaacataccgtcggcagtgatttcccgtcccagccagtccggacggtcaaaatcggcattctcgtcgggcaactcgatttccgcgacgaccaaaggcgcattatcgccaagaaaaacatcgatttcaaacaggctgccgccccatctgaccggataacgccatttttccattttaaacgggcacatcgtttccatcatcttttccgcatcggcaagcgggatttcgtattcaaactcactgcggctgatttccgaaatatagcctttcagcgtcagccacgcctgttttccggcaatgcggacacggacggtgcgttctttttcaacagacagataaccctgcctcaacagcagcggttcgtcggcgtattgccgccagttgtcgtttccaatcaaaaaacggcgttcgatttctatcggcataagatgctccgtcaaaacggtttgaacacgaccagatacagcgcggcaaccatcagcagcacggggatttcgttgaacacgcggtaccagcggtgtgaaaaagcattgctgtaatcctgaaaacggcgcagcagcacgccgcaatacaactggtaagccaagagcatcaagcccaaacacagtttgacgtgtacccagccgctgccccaccagccggcggcaaacggtatcgccgcgccgaacacgaccgcgccgaagcccaacggcgacataaaacggtacagccgcaccgccatgcccgacagacgcacatactcgggattgccgcgcggcacatcaatcatcgccatattgacgaaaatcctcggcaggtaaaacagccctgcaaaccacgaaatgacaaaaaacaagtgaaacagcttgaaccaagaaaacatcatcgcccacaccctgccgaaaagcggtattgtacaggcaaaccgcttgggaaacgtgataaaatcaggcggataaacaaatcgaataaatccttaccgcaaaacggaggcaaaatgctcaaatccatcgaactcaattcccacatccgcaaccgccttgcagaatatctgaaaggcaggggtatggattttcagacggcaatgcaggaagaaaaaggcaacaaagaaatcgccgccatcgtccacagcggtttgcccactctggtccgcaaactgtattccgaacaaaaaatgcagaagtttttttgggaaaagcgggatttgattgccgactacatcagccgccggatgcagggataggtggctgaaatctgttttcaggcaagtgaaaagacaatatggcagattgaaattacgcttatcgtcattcccgcccgcgcgggaatccgacttgtttggtttcggttatttttcgtttcgtaacttttgagccgtcattcccgcgcaggcggtaatccggcttgttcggtttcggttctttttctcgtttcgggtgatttctaaaccgtcattcccgcgcaggcgggaatctaggtctttaaacttcggttttttccgataaatttttgccgcattaaaattctagattcccgctttcgcgggaatgacggcggagggtttttagttttcccgaaaatgcacatcatccaaaatcccgttattcccacaaaacagaaaatcaaaaacagcaacctgaaatcccgtctttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaagtcccgttattcccacaaaaacagaaaatcaaaaacaacaatctgaaattccgtccttcccgcctgtgcgggaatccggcttgttcggtttcggttctttttctcgtttcgggtgatttctaaaccgtcattcccgcgcaggcgggaatctaggtctttaagcttcggtttttcttgataaattcttgccgcattaaaattctagattcccgctttcgcgggaatgacggcggagggttttttgttttcccgataaatgcacatcatccaaagtcccgttattcccacaaaaacagaaaatcaaaaacagcaacctgaaatcccgtccttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaaatcccgttatttccacaaaacagaaaatcaaaaacagtaacctgaaatcccgtcattcccgcgcaggcgggaatccggcttgttcggtttcggttctttttcttgtttcgggtgatttctaaaccgtcattcccgcgcaggcgggaatccagacctttaaaccccgaccatccttgataaattcttgcggcattaaaattctagattcccgctttcgcgggaatgacggcggagggttttttgcttttcctgatttttcattgcgatgtagtataatgtagtatataatcattataattttaacacttgacaaaggaaaatttctcatgacactgaaagcaagcaagcaagcaagcaagcaagcaagcaagcggtcgggttaatctattaacattatctgttttatcgctgttttgcacgccatatgtttgaggttcggatgcgtacgatcccgtcaaagaagccgagattaaaaacaaatttattttagaagcggcggaagacagaaattcccacgtttggcgcggcccgtgcagcatatcttttgattgcttcggtatgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttgatgcgtcgggaaatgttttgacgcacaggcggtacaccggcacggcaccgcgcgccgccccgcaaaccaatccgaaccctgccgccccgaagggcggggcataatgatgaaaccggcggaaaaccgccggttttttgccgccgtttgaaacccgattctggcttcagacggcattgtcgcggcatcgggcggcagggtttggaacagcggcataaaaaactgatacaatccgccgattgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctgattgctgttccttttcggaggaaaccctgccggcggcggtatcacggcgggcatcggcggctttcgggcggtgctttgcgtgccgccgcgtgtgcggaaacgcattccggtttttccggcataacggcgatgcgaggtaaaatgccgtctgaaacccgattcgggcttcagacggcattgtcgcggttgcggcgggcgggttcaccagattccgtcaaaggttttcgcgccgcgccaaaatttccacctgtcggcgggtttgaaggtcagcgtaccgccgtgttgtccgtccgtggtgatgtccagccgtttgattttgccggtgcggacggcttcgtagattggtgcgaaccagcgttcttcccactgctgcaatattgccgcataccgctccctgtcccctgtcagggcggtcaggcgcaaatcgtccataaacaggatatggtgcgtgtcgggcaggtgtgccgccgtttcttcataggcgcggaagttgtcgggtaatgcgcggcggtcggagtggaaacggctccaaaccgtatcggcgaaaagcgtgccgccttgcgcgccgccgtttgtgccgtcccaaagccataagccgttcaactcgggcagcccgcgtttcttgcggttatggttgacggggtgcgccgccagccacatttggatttcggtttggacgcgcagccattccaacgcatcttctccgtccggctgatcgtcagcgcccaacaatccgcccaagtccaaaacgggcttcgcgccccagcggtacgcgcaaggaagggaaaccagccataattcgggcaggacgggaacgaaacgccatggaatgtcgccgtaaaacgccgacaggtcgcggcagatccgttccgcttcatccgtaccgacgttcagatattccgccgttagcacatttgcctgatgcatccccatcttttgccagacgggcgtggcgagcgcgacggcttcagacggcatattcaggctttgcgccgcgcgttccaccagtctgccgcaccacaaataacgcgcgtaaaatgccgaagccgtgcagctttggcggtgcagcgagccgtattgcaggattttgttgaaagcgtgcaggcatagaggtattcggatttcgtcttcatccaaattgagcgagggaatggcgagggtgagtttcatcgtttgacgtttcagaaatgcaggtcaggcgcaacattatagaggattcggcgcaaacgccgtcaaaaaggaacaatatggctgtcttcccactttcggcaaaacatcggaaatacgcgctgcgtgcgcttgccgtttcgattattttggtgtcggcggcatacattgcttcgacagagaggacggagcgcgtcagaccgcagcgcgtggaacaaaatctgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaagaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaatccgcgaatccttaagcgggattttcgccggccgcttcagccttgacggtttgaaggaaggcgatgccgtgcgcctgatgtacgacagcctgtatttccacgggcagcaggtggcggcgggcgatattttggcggctgaagtcgttaagggcggcacaaggcatcaggcgttctattaccgttcggacaaggaaggcggagggggcggcaattattatgatgaagacggcaaggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattgaagtttgaaccggcgacgaaaacaatgccgtctgaaaacctgcaaacaggttttcagacggcatttatagtggattaacaaaaatcagtacggcgttgcctcgccttagctcaaagagaacgattctctaaggtgctgaagcaccaagtgaatcggttccgtactatttgtattgtctgcggcttcgtcgtcttgtcctgatttttgttaatccactatgcagttgattaaaacaaaactaagccaaggaagcactgccgtcattcccgtacgggcgggaatcctgacaccacggcacggaaacccatccgctgtcattcccacgaaagcgggaatctagaaatacaacgcggcaggagtttatcggaaatgactgaaacccaacgtaccggattcccgctttcgcgggaatgacgaagtgggcgggaatccggatttatccgttccgacagtgtttgcaaataaaagaaaacccaaccgtcccgattcccggcagggctgttttacggattttgcagcgagggcgcggggcggtcttgcgcctgtttggtttgcagggttgtcagttttttcgtcagcagattcagtatcacgccgtaggcgggcaggaagaagagggtgcagacggtaagtttgaacaggtaatcgacaaaagcgatgccctgccagtttgccgccataaatccatcgctgcttgcgtagaaggcaacggcgaaaaataccagcgtatccaaggcgttgccgatgacggttgatgcggtcggtgcaatccaccacgctttcagacggcgtaatttgttgaatacaaaaatatcaaggatttgtccgatcgcgtaggcggcaaagctggctaaggcgatgcgtccgacaaaggtgttgaattcggacagcgcgcccaagcctgtccaactgccgttgtggaacaaaacggaaaagacgtaggaaagcaaaagggcggggaacatcacccaaaagataatccgccgtgccaagtgagaaccgaaaatgcggacggtcaggtcggtggcaaggaagatgaagggaaaggaaaatgcgccccaagtggtgtggatgccgaaaatttggaaagggaactgcaccagatagttgctggcggcgatgatgaggatatgaaaaagcaccagccggaagagtgccttctgttgctgtgcggcggtaaatgcgtacataaaaatctttcggaaaggcgttcagacggcatatcgtatcgaaggaatgccgtctgaaatatgggaaggatggtttattgtgcgtcgtgctcaaacaagcgtttgcgtgccaatgtttcgaactcggtgcctgcttttccgtagttggcaaacggatgaatggcgatgccgccgcgcggtgtgaactcgccgaatacttcgatgtatttcggatccatcagggcaatgaggtctttcatgatgatgttgacgcagtcttcatgaaaatcgccgtggttgcggaagctgaagaggtagagtttcagggatttgctttccaccattttgatgtgcggaatgtagcggatgtagatggtggcgaagtcgggctgcccggtcatggggcagaggctggtgaactcgggacagacgaatttgacgaaatagtcgttgtcgggatgtttgttgtcgaatgcttcgagaatttcaggcgcgtagccggtcggatattgggttttttgattgcccaaaagagagatgccttgcagctcttcgttgttgcgggacatgagggtttccttagttttttaatgtgggaggttttcgaaccacgggcggcgattgtaatataagcggcggtatctgtgtagttttcttcagacggcatggtttggacggcggcgttttccgtgtcatatatagtggattaacaaaaaccagtacggcgttgcctcgccttagctcaaagagaacgattctctaaggtgctgaagcaccaagtgaatcggttccgtactatttgtactgtctgcggcttcgccgccttgtcctgatttttgttaatccattatataaacgaaatatattttcagttttgccgcctgaagcgttgttttttgaatattgcatctaaaatactgacttgattgcgttattgcgcggatatagaatctgcttcctattgaaagaacattgtttatatgaaatcaggaaattcggaacccaatcttatggatacgcacacggacgaaacaaaacttcaaaacacgcaagccaaacgcaaacgccgcctgacggcattgacgctgctgttcgcgcttgccgccgcagccgccgggtcggcgttttttttatggtggcagcacgaagaggaaacggaagacgcttatgttgccggacgcgtggttcaggttacgccgcaaaagggcggtacggtgcggaaggttttgcacgacgatacggatgccgtgaaaaaaggcgacgtgctggcggtattggacgacgataatgatgtgctggcttacgagcgggcaaaaaacgagctggttcaggcggtgcggcaaaaccgccggcaaaatgccgccacttcgcaggcgggggcgcaggttgccttgcgccgggcggatttggcacgcgcacaggatgatttgcgccgccggtctgctttggcggaatcgggcgcggtgtccgccgaagagctggcacacgcccgtgcggcagtgtctcaggcgcaggcggcggtcaaagcggctttggcggaagaatcttcggcacgtgcggctttgggcggtcaggtttctttgcgcgaacagccggcggttcagacggcaatcggcaggttgaaagatgcgtggttgaaccttcagcggacgcaaatccgcgcgccggcggacggtcaggtggcgaagcgttcggtgcaggtcgggcagcaggtggcggcaggcgcgccgctgatggcggtggtgccgctgtcggatgtgtgggtggatgctaattttaaagagacgcagttgcggcatatgaaaatcggacagcctgccgagctggtgtccgatttgtacggcaaacaaattgtttatcgcggcagggtggcaggtttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctgatgccgtctgaaacggaggacacaatggattatccaccgcttaagggtgcggcattggcgtgggttacgctgtctttggggcttgccgtatttatggaagttttagatacgactatcgccaatgtcgccgttcccgtcatcgccggcaacctcggtgcggcaaccactcaggggacgtgggtcatcacttccttttctgtggcaaacgccgtttccgtgccgctgacgggctttttggcaaaacgcatcggcgaggtcaaattgtttaccgccgccgctgtcggtttcgtcatcacatcgtggctgtgcggtattgcccccaaccttcagtcgctggttgttttccgcatcttgcagggctttatcgccgggccgctgattcccttgtcgcaaagcctgttaatggcatcctatccgcccgcaaaacggacgctggcactggcattgtgggcaatgaccgtcgttgtcgcccctgttctcgggccgatactcggcggctggatttccggaaactggcattggggttggattttcttcattaatatccctatcggtatcatatcggcatggattacatggaaacatttgaaatatcgggaaacggaaaccgttaaaatgccgaccgactatgtcgggcttacattgatggtagtcggtatcggcgcgttacagatgatgctggacaggggtaaggaactcgactggttcgcctctggagaaatcattaccttgggcgtagtcgcactggtgtgcttgtcgtattttattgtttgggaattgggagaaaaatatccgattgtcgatttatcgctgtttaaagatcggaattttaccgtcggcgtcattgccacgtcattgggttttatggtgtatatggggacgctgaccctgctgccgttagtgttgcagaccaacctgggctatacctccacgtgggcagggcttgccgccgcacctgtcggcatcctgcctgttttcctgtctccgttaatcggcaggttcggcaataaaatcgatatgcgcctgttcgtaactgccagcttcctgacctttgcctttactttctattggcgtacggatttttatgccgatatggatattggcaacgtcatctggccgcagttttggcagggtgtcggtgtcgccatgttttttctgccgctgaccaccatcacactgtcgcatatgaagggcgggcagattgccgccgcaggcagcctgtcgaatttcttgcgcgtgctgatgggcggtgtcggcgtatccgtcgtcagcaccctgtgggaacggcgcgaagcgttgcaccacacacgctttgccgaacacatcacgccctattccgcaacattgcacgaaacggccgctcatttgtcccagcacggcgtttccgacattcaaaccctaggcatcatcaacaataccattacccagcagggttttattatcggctcgaacgaaatctttatggcgggcagcttgttattcattatcatgatacccgtcatatggctggcaaaaccgccgttccacaacggcggcggcggtggacattgagggatttgaaaacttgaaatgccgtctgaaaatactggaaatatgttcggacggcattttgaatgcagcagttcccgaaatccgctataatcgcgccccatctgtttcgcacctgcaaacgttccacagatgcgacaatcggaaggattatccgcgcaaaacagccgtttttcgtttaaaacacttgaactaacactgtttttcgtggtataaatcgcgttttactattttagaagtttggagactgattatggcacgagtttgcaaagtgaccggcaaacgcccgatgtccggcaacaacgtatcgcacgccaacaacaaaaccaaacgccgttttttgcccaacttgcaatcacgtcgtttttgggtagaaagtgaaaaccgctgggttcgcctgcgcgtttccaacgctgcactgcgtaccatcgacaaagtaggcattgatgtcgtattggctgatttgcgtgctcgcggcgaagcttaatttaaacactatttaattaaggattactgcaatgcgcgataaaatcaaactggaatccagtgcaggtactggtcacttctacaccactaccaaaaacaaacgcactatgcccggcaaattggaaatcaaaaaatttgacccagttgcccgcaaacacgtagtgtataaagaaactaaactgaaataatttcagtttgaaagcaaagcctccgactgctcggaggctttgttatttttatcgtgtttcctttccgcttgaaacatctgccgtatgcgaatctgctgcaaaccgtctgccaaggatatgaaaaccgcaaaacggttcataacacaaaaatgccgtctgaaacgtttcagacggcatttcggcagttttcaaccggtcagttgtttggtgatcagtttcttcagcggtgggaaattgttgctggcacgcaataccaagccgcgcaacagttttgccggtgcggtctcattggtaaacagtttcagcatcatattggttccgtgataaagcggatgggcgtgcagcatatgtttgctgctgtatttttccaataatgaagatgcaccgatgtcttgaccgcgctgttcggcttcgagtatcagttttgccaaaatatctgcgctggaaagccccaagttgaaaccgtgtgctgtaacggggtgcataccgacggcggcatcgccaatcagcgcgctgcgtttgccgtagaaacgtttggcaatcatgccgacaagggggtaatggtggatgctgctgaccaattccatatcgccgagcctgcccttgagctgttcttttacgcttgccgccaattcttcgggcgaaaggttttgaacgctgttgattttatcggtatcgacggtaatgacggtattggtcaggtgctcttccagcggcagcagtgcgatggtgcgtccgtaatggaagcattcgtaagcggtatgttggttggaaagggtatgtttcatacggcagacgaacatggttcggctgtaatcgtgcatatcggaggagataccgagttgtcgacgggtttgcgagaagcggctgtctgccgccaaaagcaggcgtgcagtcagtattttgccgttttccaaaatgacttgtgcttcgttgtcagatgttttgacttctttgacaaccgtatcggtcagaatgctgacattgtcgagttgtgatacgacttcataggcggcgcggcggatattgtggttggaaatcagatagcccaaacagtcggcaggttcgccgcgcgcttcagtcggttggggaaagtggagctggtagtcggaacgtccgttcagcactttggcatcgcgcaaagggtagatttcgttttcgggaattttgtcccacatacccaaacgctgcatgatttcgcgggaaaaatgggtcagggcgatttcgcgtccgtcatatggaggattttgcagaacagtcagtgggctgcgttcgatcagggtaactttcaaaccgctgccggcaagttcggctgcaaaacttaaacccgccgggcctgcgccgacgacgaggatgtcgctgtgtaaactcataaaatatcctttgcatagacggatgccgatgatttcagatggtatttg

SEQ ID NO: 71 - DNA, 8183 bp, Neisseria meningitidis;
ccggttcgagtagtcagttaatagtttctcctctatttctcctttgtagacttggcacacattcaactggatgtgtgcatttttttatctgaagcaacaagcctctgtgcgtgatgttgttatgtttcatttaggtgtcaaaccgcatatccggtctgaaatattcaatccaaatccaaaaccggattttctttgacctcctccatcacaacataactcctactctccgaagcggcaggcagttgcaataggatattgcctagcatatcccgataggcagacatatcgggcaaacgtactttaatcagatagtcgtattcgcccgacaccaagtggcattccataatttgcggaattttcagcacttcttttttgaaatcttcgaaaatattgcccgatttggattgcagcttcagctcgacaaaaaccaataaaggtttgcccaacagatggggattgagatgggcgtgataaccggaaatataatgttcccgctccaaacggcgcaccctctctgtaacgggcgtggtggacaagcctaccttctcggcaagctccgtcatcgggatgcgggcattctgttgaaggatcttaaggatgcggaaatcgattttatctagttctttcatttagattgccttgtatttattattgattttaacaaatagagtatatagtggattaacaaaaaccagtacggcgttgcctcgccttgccgtactatttgtactgtctgcggcttcgtcgccttgtcctgatttttgttaatccactatatatttgagaaagcgattatatcaggaaaagcaaaccgccttcctacctgaaaactgctgcttcggcttgaagacacaaggttctttaatattttaaaagccttgccgttggattataatcccccaaccgatttcttaattttgctaataaacacttgcttggtaaggaatgaatttatgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgatgaaggaatcaggctgcgggagagcggcattacccatccgattgtccttttggaaggcgtatttgaagcatcggaatacgaagcggtcgaacaatactcgctttggccggcagtcggaaaccaatggcagcttgaggctttgctgatccgccattggaaaaaaaccgtcaaagtctggttgaaaatggattcggggatgcaccgtaccggttttttccctcatgattacgcttcggcatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgcgccggtctggcgttatacggcatttccccgttcggaggaggcgatgacaggctgaagcccgtgatgaggctttcaacccgtattttcggcgaacgcgttttacagccgcactcccctatcggttatggcgcaacattttataccagcaaatctacgcgcgtcggcctgattgcctgcggttatgcggacggttatccgcgccgcgccccaagcaattcccccgtcgctgtcgacggcaaattgacccgggtcatcggcagggtctctatggatatgatgaccatcgagctggatgcttcgcaagaaggtttgggacacgaggtcgaactgtggggcgatacggtcaacatcaataccgttgccgaagcggccggaaccatcccttacgaattgatgtgcaatatcaaacgtgcaaaattcacttatatcgagtaatcaagtccaaacgaaaatgccgtctgaagcctttcagacggcatttccccatcaaaaccgcaatcagtttttcatcgattgaaccggagccggaattctgccgcctcggttgacgaatacttcgcacgaaccttctttgaccggcatcacaggcgcgtagcccaacaagccgccgaactcgacgctgtcgccgacggttttaccggttaccggaataatgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttcttcaagaatgcgtgccactgagtcgccgacggcgggggtcggcgccagcgacaagtcgagaataccaaacgggatattcagcatttttgaggcttcgcggccgatgagttcgcccacgcgggtaattttgaaagcagttttcttcactacttccgcaacttcggtcaatgtcgttgcatctgaattttccaacgcggcttttacgacacctgggccggatacgccgacattgataacggcatccgcttcgcccgaaccatgaaacgcgcccgccataaacgggttgtcttccaccgcgttgcagaacacgacaattttagcgcagccgaaaccttcgggcgtgatttccgccgtgcgtttgacggtttcgcccgccagcttgaccgcatccatattgataccggcacgcgtactgccgatattgatggagctgcacacaatatcggtagtcttcatcgcttcgggaatggagcggattaacacctcatccgaaggcgacatccctttttgcaccaacgcggaaaaaccgccgataaaagacacaccgatggctttggcagctttatccaaagtttgcgccacgctgacgtaagaatcagcatgggtggccgccgcgatttgggcaatcggcgtaacggaaatgcgctgattcacaatcggtacgccgtatttggcagacagatattttgccgtagtgaccaagtctttgccgactgtggtaattttattgtaaatattttggttcaacacattgatatcgctgctgatgcagtcgtgcaaatcaatgccgatggtaatggtgcggacatcaaaattctggtcggcaaccattttgacggtttctaaaatttcgccggattggatactcatcacattcctccaactcaaatgcggtgcatcgcttggaagatttcttcgttttgcatacggatatcaagcgcgagttttttgctctcttccgcaaacaaatccaaaacctcttgacgcgatttgctgcattttgaagtgtccaccaagataatcatagtaaaaaaatcgtccatcagctgttggctgatgttgagaatattgatttggttttccgccaaaattttggaaacatcgtacacgatgccgacgcggtctttaccgatgacggtgatgactgaattgttcacaggcttactccttgcagatatccgttaaagtccgaaattataccaccgttggattttgaagaaatattgtcaacaatatatacatacaaaatgccgtctgaaactatttcagacagcatcaagattcagggttcgattaaataaccatccttatcccactgggttttcctgaccaacttgtcatcctgataaacagcttcgctctttttagaaccatcttcataccactccaaaaccaccccgttgcgttgatggtggcggatagacagttccgagagtaatcggccgctttcatcccaagtcagaattttggcaggctcatcgttgaccataaccatttccgtcttgatactgccgtcggcataccattgcttccatacgccgtttgccttattttgcttaaactggatttcgctttccttgccgccgttacggtaatagcggtatcccgtaccctcactcaagccatttttataaggcataacggcagattttttaccgttcggataccagttgacccactccccgtccggcttacccttgctgaagccccccgccatttttttctgaccattaaaatgccacaaaatcaacataccgttttgcagggtaggcacaaaagatttgatttgcgttgaagcaacgatataaggttcagaatatttcttcatcgacggataataaaaatcctgcgcgtgcgcaatacccgccaccacactatattgcctgatataagcggcagaagacatcgtcgccgtcagctttccgttctgattaaaataaacagaataggtctgcgccggcaaagcggccgaaaaacccaacaggacagttgaaaatacaatccgagataattttttcattgcaatagcgatataaaaacaaggctgtgttttagtaatctgttgatttcaattatttgcaagggaaaagacaattattttccggttaggaataaacctattctattgaatatattgaagccaagtacgcctatcaacactatattaaaacactgccaaaaacaattaacttataaacaatatggtaaggatttctctgccaagcatcaaacccgagacaacgtatcgtaaaaatgccgtctgaaaacaaatcgtcttcagacggcatttccccttcaactcactcttcacccaataactgctcgcgcgtcaagaggaaaacaaaaccgtcgcccccgctggtttccaaccaagtaaaaggcaactccggatacgctgcttccaatacatccctgttatgcccgatttccaccagcaatacacctttgggattcagaaactttgccgcattcagaagaatctgcctggtggcatccaacccgtccgccccgctgcccaatgccaattccggttcgtgcaaatactcttcaggcaataactcaaccgattccgcatccacataaggaggattggaaacaatcaaatcataagtgccttccaatccttcaaacaaatccgtatgaataagccggatgcgttcttccaaaccataatcttcgacattaatccctgccacttccaaagcatccaagctcacatcaaccgcatcaatttgggcatcaggataatgatgcgccatctgaatggcaaggcaaccgcttccggtgcaaagatccaaagcattatgcaccaactcatcgtattctatccaaggacgaagtccgtcacccaacaattcataaataaaagaacgaggtatgattacgcgctcatccacatagaaatcaaactctccctgccatgcctggtgtgtcaaataagcggctggaatgtgttcgacagcacgacgctcaataaccgccagcacttcctctttttcagcttccaagagttttgcatcaagatatggggcaagcatatccaaaggcaaattcaaagtatgcagaatcaaataagctgcttcatcatgcgcattatctgttccatgaccaaaaaagagccctgcctcattaaaacggctgactgcaaaacgtaaaatatcgcggatagtcgtcaattcttgtgctgcctgattaaacataatatgaaccattctgcgtatagatacttttaattataacagaaacaacaagcaaaccttttcatatcgccaaataaccacccaatctacccatacaactacataaatgcccgcgcgaaaaccatcgcccgaacggaaacgacaatggccgacggtatgggcaatctgattggctgggaaaaaacggggcttgttgtcggtaagcagtggataaccgcaaaagacgacaaggtgtccgatgtctgcaatgccaacggcgagatgggcgtaatcgggctttacgagcctttctcacacggcgcattgacgatacccggtcatccgaactgccgatgcgaggttgtttccgtatcgggtggcgaattgggggaatttgccgaaaaaaaggagcttcgtaaagcggctatgcagtatgcgcgggataactttatcggcaaaagctatgtcaataaaaacagcgggcatgaactgaaggtaacttggcaaggtgtgaaacacgctgcgtcaaaggcaaatcaggcggaattatccatcatgacaaaacttgatgacttattgcgctacgcaaaatatgagggttcttattcggataggaaaggtcatcctaatattattgcagcacataagtatcgtgccgttgccaaggttgggaatgagtctttaaatatcggtgtgattgtaagggaatttccagacgaccataaacattacgaccatttcatcttgaaggatgaataaagcccttttgcagtgtcgttctggagcggatagcgttaaggcaagtacacttccagccttgaaaaagggctttaaattcagcatgccatttatacaggcaggagtaaacccatgacaaagttatacgcagaaatcgccaagatggagacgcaggacgacgacacggtcaaggtttggggttacgcttcaagcgaggaaatcgattcggacggcgaagtcatcgcggcggcagctatgaaggcggcgattcccgattatatgaagtttggcgcggggcgcgagatgcacggctcaaacgctgcgggaacggcaattgaaatcaacgtggaagatgacggcagaacctttttcgtggcgcatatcgtcgatcccgttgccgtgacgaaggtcaaaacaggcgtttacaagggcttttccatcggcggcagcgttaccgcccacgatgagttgaacaagtcgcaaatcacgggtttgaagctgacggaaatcagcttggttgaccgacccgccaatcccgatgcggtgtctacctgctttaaggcggacaaaggtgcggaagcggtaaacaacgatacagaacataatgctacatattttagccatttcccttccaaacaaaaaagcaccgacggcggccgatgccctttcctttacaggttcccctattttttatccgcgggcagcaccggtttggctggggcttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaagagcagccccgtcaaacttccaacgccactgcagata

SEQ ID NO: 72 - DNA, 4688 bp, Neisseria meningitidis
taaatgggactataagcaggaaggcttaaccagagccggtgcagcgattgttaccataatcgtaaccgcactgacttatggatacggcgcaaccgcagcgggcggtgtagccgcttcaggaagtagtacagccgcagctgccggaacagccgccacaacgacagcagcagctactaccgtttctacagcgactgccatgcaaaccgctgctttagcctccttgtatagccaagcagctgtatccatcatcaataataaaggtgatgtcggcaaagcgttgaaagatctcggcaccagtgatacggtcaagcagattgtcacttctgccctgacggcgggtgcattaaatcagatgggcgcagatattgcccaattgaacagcaagktaagaaccgaactgttcagcagtacgggcaatcaaactattgccaaccttggaggcagactggctaccaatctcagtaatgcaggtatctcagctggtatcaataccgccgtcaacggcggcagcctgaaagacaacttaggcaatgccgcattaggagcattggttaatagcttccaaggagaagccgccagcaaaatcaaaacaaccttcagcgacgattatgttgccaaacagttcgcccacgctttggctgggtgtgttagcggattggtacaaggaaaatgtaaagacggggcaattggcgcagcagttggggaaatcgtagccgactccatgcttggcggcagaaaccctgctacactcagcgatgcggaaaagcataaggttatcagttactcgaagattattgccggcagcgtggcggcactcaacggcggcgatgtgaatactgcggcgaatgcggctgaggtggcggtagtgaataatgctttgaattttgacagtacccctaccaatgcgaaaaagcatcaaccgcagaagcccgacaaaaccgcactggaaaaaattatccaaggtattatgcctgcacatgcagcaggtgcgatgactaatccgcaggataaggatgctgccatttggataagcaatatccgtaatggcatcacaggcccgattgtgattaccagctatggggtttatgctgcaggttggacagctccgctgatcggtacagcgggtaaattagctatcagcacctgcatggctaatccttctggttgtactgtcatggtcactcaggctgccgaagcgggcgcgggaatcgccacgggtgcggtaacggtaggcaacgcttgggaagcgcctgtgggggcgttgtcgaaagcgaaggcggctaagcaagctgctcctaaagaaacaataaacaatttggcaaatttagccaaagcagaacagcagattttattccgtattgcccaacgcgatacgcaactggatgcatggaagacgggatttaacaatagagtaaggaaaggagcaggcttgcttgatgcaagtaatattccgataaccattaacggaaaaaccatcaaacctgtacaagccataagcttaaagggagcacccgtttacagcggcgtaagcgaacaggagatttttgcgctttatcggcagatgactggccagaatccgaattttagagttttgcctgacggaagattagcaaatggcattatcagtactggagaatgggcaggaacaaaaattgcattaagaaatttttcaaaaacagagaattcaactcaagcacgatggacattagatttgcagaatcctccatcatttattaaaggtactaaattggagcttaaattccaataatttacaaaggattttaccgtggatgagaaacaaaaaattaagattcttgattttcaaatcgatttatcctcaatttttaactcttataaaaatcaaatgggtattaatattcaagatgaaaacttaaaaaacaatttctgttcttttatggaagaactgttaaatgacggttcaatccgtttacatgattataccgacggtatcggaattcctctaactggaacttcaaaagaacaagtgcagaaattgaaagacatatggcctactttggaagatgcccaagcaatatggcctgaagacccttggtattacttagaatggctttggtgggatattgcgtgtccaatagatttggccgatttgccgaatattgatatttatgagcaagcgtaggtatggttagccgcctttagcggcgtaaccgtacgcatatcagcaaactttataaaataacaaggccgtctgaaatctgtttttcaactttttcagacggccttgcaacttggcatttcattcgtacggttacgcgctaaaggcggctaaccgtacctacgagctctgataaaaatgatttatggaagcaagctgtagcctgcatgaaacctaaaatccatgcgtaaggtgtgtgcttcagcgcgcacgcgttccatgatttacggctcaatgccgtctgaaaagctcacaatttttcagacggcatttgttatgcaagtaaatattcagattctctgtatactgttcagacgcgtgcgtgctgaagacacctcctacgcttgctgcagaactttcgggtaaaaccggtgtgagcattagcgcgccgtatgccaatgaaaacagccgcatcctgctgagcaccacggatatcagttcggaaaacggcaaaatcaaactgcaatcctacggcgaccagttctactacgccggacagggtgagctctacaccttcgataaacgcagctataaaaccggtaagtggtacaaactaaaacatgttactgaaatcaaagagcataaaaacgccaaagccgacccggtgagcctcagtgcgtcacaaggtattgaaatcaaatccggcggcaatatcggtgcccacgccaccttgtttgatgcaccccgcggctccgttaaaatcgaagccggacgtgggctggttctctatgccgtggaagatctcaactacgacaaacttgacacccgtaccaagcgcaaatttatcggcattacctacgacaaggtgcacgacaccaccacccacaccatgaaaaccgccctgccctcaagggtagttgcagaatcggccaacctgcaatcaggctgggacgccaaactgcaaggcacccagtttgaaaccacgctgggcggcgcagccatccgtgcaggtgtaggcgatcaggcacgagcagatgccaagattattcttgaaggcatcaaaagtagtgtgcgcactgaaacagtaagcagtagcaaatctgccctctggcagaaacaggccggacgcggcagcaatatcgaaaccttgcaactgccaagtttcacaggctccgttgcgcccgtactctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaagccgggta

SEQ ID NO: 73 - DNA, 15449 bp, Neisseria meningitidis
gatgatgacgaaatttacagactgtacgcggtcaaaccgtattcagccgccaacccacaggggatacatcttgaaaaacaacagacaaatcaaactgattgccgcctccgtcgcagttgccgcatcctttcaggcacatgctggactgggcggactgaatatccagtccaaccttgacgaacccttttccggcagcattaccgtaaccggcgaagaagccaaagccctgctaggcggcggcagcgttaccgtttccgaaaaaggcctgaccgccaaagtccacaagttgggcgacaaagccgtcattgccgtttcttccgaacaggcagtccgcgatcccgtcctggtgttccgcatcggcgcaggcgcacaggtacgcgaatacaccgccatcctcgatcctgtcggctactcgcccaaaaccaaatctgcactttcagacggcaagacacaccgcaaaaccgctccgacagcagagtcccaagaaaatcaaaacgccaaagccctccgcaaaaccgataaaaaagacagcgcgaacgcagccgtcaaaccggcatacaacggcaaaacccataccgtccgcaaaggcgaaacggtcaaacagattgccgccgccatccgcccgaaacacctgacgctcgaacaggttgccgatgcgctgctgaaggcaaacccaaatgtttccgcacacggcagactgcgtgcgggcagcgtgcttcacattccgaatctgaacaggatcaaagcggaacaacccaaaccgcaaacggcgaaacccaaagccgaaaccgcatccatgccgtccgaaccgtccaaacaggcaacggtagagaaaccggttgaaaaacctgaagcaaaagttgccgcgcccgaagcaaaagcggaaaaaccggccgttcgacccgaacctgtacccgctgcaaatactgccgcatcggaaaccgctgccgaatccgccccccaagaagccgccgcttctgccatcgacacgccgaccgacgaaaccggtaacgccgtttccgaacctgtcgaacaggtttctgccgaagaagaaaccgaaagcggactgtttgacggtctgttcggcggttcgtacaccttgctgcttgccggcggaggcgcggcattaatcgccctgctgctgcttttgcgccttgcccaatccaaacgcgcgcgccgtaccgaagaatccgtccctgaggaagagcctgaccttgacgacgcggcagacgacggcatagaaatcacctttgccgaagtcgaaactccggcaacgcccgaacccgctccgaaaaacgatgtaaacgacacacttgccttagatggggaatctgaagaagagttatcggcaaaacaaacgttcgatgtcgaaaccgatacgccttccaaccgcatcgacttggatttcgacagcctggcagccgcgcaaaacggcattttatccggcgcacttacgcaggatgaagaaacccaaaaacgcgcggatgccgattggaacgccatcgaatccacagacagcgtgtacgagcccgagaccttcaacccgtacaaccctgtcgaaatcgtcatcgacacgcccgaaccggaatctgtcgcccaaactgccgaaaacaaaccggaaaccgtcgataccgatttctccgacaacctgccctcaaacaaccatatcggcacagaagaaacagcttccgcaaaacctgcctcaccctccggactggcaggcttcctgaaggcttcctcgcccgaaaccatcttggaaaaaacagttgccgaagtccaaacaccggaagagttgcacgatttcctgaaagtgtacgaaaccgatgccgtcgcggaaactgcgcctgaaacgcccgatttcaacgccgccgcagacgatttgtccgcattgcttcaacctgccgaagcaccgtccgttgaggaaaatataacggaaaccgttgccgaaacacccgacttcaacgccaccgcagacgatttgtccgcattacttcaaccttctaaagtacctgccgttgaggaaaatgcagcggaaaccgttgccgatgatttgtccgcactgttgcaacctgctgaagcaccggccgttgaggaaaatgtaacggaaaccgttgccgaaacacccgatttcaacgccaccgcagacgatttgtccgcattacttcaaccttctgaagcacctgccgttgaggaaaatgcagcggaaaccgttgccgatgatttgtccgcactgttgcaacctgctgaagcaccggccgttgaggaaaatgcagcggaaatcactttggaaacgcctgattccaacacctctgaggcagacgctttgcccgacttcctgaaagacggcgaggaggaaacggtagattggagcatctacctctcggaagaaaatatcccaaataatgcagataccagtttcccttcggaatctgtaggttctgacgcgccttccgaagcgaaatacgaccttgccgaaatgtatctcgaaatcggcgaccgcgatgccgctgccgagacagtgcagaaattgctggaagaagcggaaggcgacgtactcaaacgtgcccaagcattggcgcaggaattgggtatttgattcccaactgccctttcgcagatcaaggatgccgtttcagacggcatcttttttgccttatcggtgtaacggataaagtttgaaccggcacaggctcaaacagcaggtcgacggcaacaaaatgccgtctgaaacccctaaaggcttcagacggcattggcggcggcggtatcaggcagtttgataggcaaccgaatcgtcgccgcttttcttttgaatgaactcgattttgtatccgtcggggtcttcgacgaaggctatcacggttgtgccgtgtttcatcgggccggcttcgcggacgacgtttccgccctgccgcttcacacgttcgcaggcttcgtaggcatcgtccacttcaaccgcgatgtgtccgtaggcgttgcccaagtcgtatcgttccgtatcccagttgtgcgtcagttccaaaaccgtgctgtcggtttcatcgccgtaaccgacgaaggcaagggtaaatctgccttcgggataatcttttcggcggagcagtttcatacccaaaacgttttggtagaaatcgagggattttcgagattgcccacgcggagcatagtatggagtaagcgcattttttgtgttcctttcggtggtggttaaacttcgattttattcggggtaaacgtctgccatttgttgcaggcggggcagtgccagaaaaagacttgggatttgaagtggcagttgcggcaacggtacatcacgctgcgctgtagctgccgtccgataaccgaacgcatcatgtcggcatcggctttccaagccggattcatatcgctgagtttcaaaccgagcaggcggtacacgccgttaaggtcgggcttgcggcggacaagctcgacggcggtttgcgcggcttctttctcgcacttaagcagcagggatttctcgtacacgacattgatcaggtcaagttcgggaaacgtctgcatatatcctgtcagacggttcaagccttcttcaggttttccctgcgcggcataggcttcgtaaagcttctcgccgaccatgctcaagtatgcatggttttgctgctcgatggcggcataggcttcgacggcggcagggaaattgccttgtcggtgttcgatgtcgcccaaaatcatgttggcgcgggtgcattttttgttggcttcgagtgccttgccgacattgaaacgcgcgacatcgaaattggacttgaacagcgcggcttgggcaagttcgcaataaaactgggcgatttcaaactgataggtctgatcgtcatggctgagcagccgggcggtttcaaccgctttttcccaatccctgtcctgttggtagatattgagcaggtgctgtctggcttcacgcgccattttaccgtcttgcagccccaaaaaaatctgttcggcacgatcgaccaaccccgcactttggtagttttgcgccaattcaaacaggacgcgcgcgcgcttttcgccgaccgtatcgggagaatcgagcattgtccggtgtatgttgatggctttgtcgttttcgccacgctggcggtaaagtttgccgagggtgaggttcaaatcatacgattgcggccggccgtcgacgacttccgccaactcccttgccgcgcgcccgctgttgcggtcgaccaaagcgtccaagcttttataaaatcccgaagggatgctttttgcctgcttcaatacggttttcatatccacgcgggcggcaaaccagcccatcgcgaagaagacgggcaaaaggataatcggcagcaggataatccacaattcgttgtccatatcggctttcttaaggctgtttggtagattcgggcgcattttgcgccggtggtgcggtcagctccttccccgtcaaacgcgcatttttctttacttcggcacgcaacctgccgttctcgccacgtaacgacaacaaccgtccgaacaaggcaaacattccaaaaataataccgactacaaatgcgccgaacaatacgacaatcagcggcaaatcgaatttttgccccggcaggtaggaaaaggtaacggcatccgtattaatgacggcaagcagcaggaagagcagcaggataatgattttgatgacggtatagataagtttcatgtttgctccgtaaataaaaacgccgcccagacagcttcgcactctgaaccaagattgcgctagtttaaacgatttgcacggtttcggataggatgcggcagcgtgttcggacgacatacggagtatgcgattgccgacaattttaccaaatacaccgttcctttccatttgaaaaataacggattggacaccgcatcgacagaaaaacccgccgcgcacttgtcaaaaccctgtttgcaggcgtatctttacaatcttcaaattcaaaccgttcattgaaacatatcagaataagaaaggctttacatcatgagcagacccgtacccgccgtattcggcagcgtttttcacagtcaaatgcccgtcctcgcctaccgcgaaggcaaatggcagccgaccgaatggcaatcttcccaagacctctccctcgcaccgggcgcgcacgccctgcactacggcagcgaatgtttcgagggactgaaagccttccgtcaggcagacggcaaaatcgtgctgttccgtccgactgccaatatcgcgcgtatgcggcaaagtgcggacattttgcacctgccgcgccccgaaaccgaagcttatcttgacgcgctaatcaaattggtcaaacgtgccgccgatgaaattcccgatgcgcctgccgccctgtacctgcgtccgaccttaatcggtaccgatcccgttatcggcaaggccggttctccttccgaaaccgccctgctgtatattttggcttcccccgtcggcgactatttcaaagtcggatcgcccgtcaaaattttggtggaaaccgaacacatccgctgcgccccgcatatgggccgcgtcaaatgcggcggcaactacgcttccgccatgcactgggtgctgaaggcgaaagccgaatatggcgcaaatcaagtcctgttctgcccgaacggcgacgtgcaggaaaccggcgcgtccaactttatcctgattaacggcgatgaaatcattaccaaaccgctgaccgacgagtttttgcacggcgtaacccgcgattccgtactgacggttgccaaagatttgggctataccgtcagcgaacgcaatttcacggttgacgaactcaaagctgcggtggaaaacggtgcggaagccattttgaccggtacggcagccgtcatctcgcccgttacttccttcgtcatcggcggcaaagaaatcgaagtgaaaagccaagaacgcggctatgccatccgtaaggcgattaccgacatccagtatggtttggcggaagacaaatacggctggctggttgaagtgtgctgatgctttaaataaaaaatgccgtctgaaacccgtttggcgtttcagacggcattttcgcatccgaaccgtttccgctgcacctgcagcaagtcggcacaaaggcaatcggttaaaacaagcgtccgcatttcccatcccgcctgccgtaagtcgggcatttccctagaaatacgcttcagacggcaaaacgccgcccgaaaccgatatgcggcacggacggcgcacggatttgaaaacggcggattatccctcggtgctcaaggcattaatgctgtaaccgccgtcaacgtaagtgatttcgccggtaatgccggacgacaggtcggacagcaggaaggcggcggtattgccgacttcttcaatggtaacgttgcggcggagcgggttgtgggcggcgacgtgtcccaagagtttgccgaaatcggcgatgccggaggcggcaagcgttttaatcgggccggcggaaataccgttgcagcggatgccctctttacccagacaggcagcggtaaagcggatgcctgcctcaaggctggcttttgccatacccatcacgttgtaattcggaatcgcgcgcaccgcgcccaagtagctcagggcgacgatggcggaatttctgccgcgcatcatcggacgggcggcttttgccaacgcgggcaggctgtatgcggaaatttcgtgtgcggtgttgaacgcttcgcggctgatgctgtcgaggaagtcgccgctcaaggcttctttcggcgcaaaaccgatggaatgcaccaaaccgtccaagccgtcccaatgtttgcccaagtcggcgaacacttggttgatttcgtcgtcgctggcgacatcgcagcggaatacaagttcggaatccaattccgccgccattttgcggacgcgctcttccagtttgtccacaacgtaggtaaacgccagttccgcgccttgttcgcggcaggctttggcgatgccgtaagcgatggaacgctcggaaatcatgccggtaatcagaatttttttgccttgcagaaaacccattttgtatccttcaaatagtgttcggttcgttctaaaccgttgattatagcaaattgtccctgtttctgtgttttcacgttgcagcgtgcaaacggcaatgccgtctgaagcggatttcagacggcattggacgtttcaaatacggtttaaggcatcagatgccgcgcaacaattcgttgacgctggttttcgcacgggtttgcgcgtccacgcgtttgacgatgacggcgcagtaaaggctgtggctgccgtctttggaaggcatactgccggatacgacaaccgaacctgccggtacgcggccttgatagatttcgccggttgtacggtcaaagattttggtggattgaccgatgaacacgcccatagaaatcacgctgccttcttcgacaatcacgccctcaacgatttcagaacgcgcaccgatgaagcagttgtcttcaatgatggtgggtgcggcctgcaggggttcgagtacaccaccgatgccgacgcccccgctcaagtgcacgtttttaccgatttgcgcgcaagagccgacggttgcccaagtatcgaccatcgcgccttcgtcgacgtatgcgccgatgttgacataagatggcatcagcacgacatttttcgccacaaagctgccgcgtcgggcaaccgcacccggaactgcgcggaagcctgcgtttttgaactcgtcttcagaccagtcggcaaacttggtcggcactttgtcgaagtatttgttcacgccgtcgttgaggacttcgttgtcttggatgcggaaggacagcaacacggcttttttcgcccattcgttgactttccactcacccacgcccaaacgttcggcaacgcgcagtttgccggaatcgagttggcggatggtttccaacacggcttctttgacttcgggagtaacggtggtcggggtgatgtccgcgcggttttcaaaggcggtttcgataatgttttgcaaagacataatatttccttatgtgagatgtttcgtgggacgcttgccggtattttcaagcagtatgttcatttgaaatgaatgcgctattgtgccacgcaaacgcatattcgtcagcaatacgcgagcggttgccaaacattggcgtttcggaatcgggcaggcggcaggtattgccttttccgcgcccgaatcaatacagaaaggcggcagtacttttatgccgcgccgccgcctttcagacggcattcgcggtaaaacgccatcagcccttcggtcgaggcatcgtgtacggacgtgccgccttccagttcgccgatgatggtttttgccaactgtttgccgtattccaccccccactgatcgaaggggttgacgttccatatcgcgccttggacgaaggttttgtgttcgtaagccgccatcagcatacccaaattgtagggcgtgaggcggtcaatcaaaatgctgttgctggggcggttgccggggaactctttgtgcggcgcgaggcgttcgcgttccgcttcgggcaaatctgccagttcggcgcgtgcttcgtccaaggttttgcccttcatcaaggcttccgcttgggcaaaggcgttggcaacggtaaaacggctgcgtccgtcctctctgccctgcgccgtcatcgggacgataaaatcgcagggaatcaggcgcgtgccttggtggagcagttggaaataggcgtgctggcagttgaccccttcaccaccgaacacgatgccgcccgttttgcacacggcgggactgccgtctgaagcgcggcttttgcccaaactctccatatcgagctggttcagccacgccggcagcaggcgcaggttgtggctgtacggaacggcggtctgcccgtccgcgtgctggaaattgttgtaccacacggcaatcagtgccattaaaacggggatattatgacgcgtcggcgtactgaaaaaatgcctgtccatcgcgtgcgcccccgccaacaactcgcggaaacgcgccccgccgaccgcaaccatcacgggcaaaccgacgggcgaccagacggaatagcgtccgcccacccagtcgtacatcgcaaacacgcgttccgccgcgataccaaaagccgcagctgccgcagtgtcggcagacaccgcgcaaaaatggcacgccgtttcggattccgagaaccctgcaccgcgataccacgccttgactgcctgtgcattgagcagggtttccggtgttttgaaggacttgctggcaacgcaaaacactgtcgtttcggggttcagacggcataaaaccgcatccaggcaggcaggatcggcgttggcggcaaaatggacggtgatatgccgtctgaacggctcaagtgcctgcacgcacattgccggcccgaggtcggatccgcctatgccgatgtggacaaaatccgtaatccgttttccggttatcccctgatacgaaccgtcgtccaaactgtgtgcaaacttcaacgcacgatttaactcgcggcggatttcgggcaacacgtccctgccgtccacataaacggcatccgcaccgtcgggcaggcgcaaagccgtatgcagcgcggcacgcccctcgctgccgttgactttcgcacccgtccgcaaagcacgcattttcccttccaaatccgccgcgtcggcaagattgcagagcagttgcagcgtatcttcgcccaaacggtttttgctgtaatcgaacaacatcccgtccaaacgctcgtgcatacgctcaaaccggtccggttcgcaggcaaagcggtcgcgcaaaaggacatgacgcgtatcctgataatggcgttcgagcgcataccatgcacgggtaaaagcattcatctgttttccttgatttttcagaaccggattaaaatgtagcagaatgtagtttaacaaacggcagcggctttggcgaatctccggaacaccgcccgccgcgtccaatagcaccttatttccatatggcggaaatgccctccggccggcatttgacccgcaacaatatcctgcaagatttattgtgtacgcataaatgccggacagccgcctaaataaggtataatcgcatccgattctgtcccgtttgccgcccgcaggcgggatgtcggcggttttcatcttaccgggaacacgccggtactgttttttaacgatgtttcttacattttattccaattactttacggggctagaatatggctaaaaacggaggattttctttgttcgcaaagaaagaaaaacgctttatctttgaaggcaggcattccgcctccgacaaactggtcaacggcgaagtatccgcgtttaccgaagaagaggcgcgcaaaaaactggcaaaacgcggcatccgcccgttgcagattacccgtgtgaaaacaagctccaagcgcaaaatcacacaagaagacatcaccgttttcacccgccagctgtccacgatgattaaagcgggcctgccgctgatgcaggcatttgaaatcgtggcgcgcggacacggcaacccgtctatgacggaaatgctgatggaaatccgaggcgaagtggaacagggcagctcgttgagccgcgcattctcaaaccacccaaaatatttcgaccgcttctactgcaatctggttgcggcgggcgaaacgggcggcgtattggaaagcctgctggacaaattggcaatttacaaagaaaaaacccaggccatccgcaaaaaggtaaaaaccgcactgacctatccggtatccgtcatcgccgtcgccatcggtttggtattcgtgatgatgattttcgtactgcccgcctttaaagaagtttacgccaatatgggcgcggagcttcccgcactgacccaaacagtgatggatatgtccgactttttcgtctcatacggctggatggtgctgatcgcactgggctttgccatatacggcttccttaaattgaaggcgcgttcgattaaaatccaacggcgtatggatgccatactgctgcgtatgccgattttcggagacattgtccgcaaaggaacgattgcccgctggggcaggacgacggcgacgctgattgcggcaggcgtgcctttggtcgatgtattggactccactgccggcgcggcgggcaatttaatctatgaagaagccacccgggaaatccgtacgcgcgtcatccaaggtttgtctatgacttcggggatgcgtgcgacggaactgttccccaatatgatgttgcagatgtcttccatcggcgaggaatcgggttctttggacgatatgctcaacaaagccgccgaattttacgaagacgaggtggacaatgcggtcggcaggctgtccgctatgatggagccgatcattatcgtgattttaggcttggtcatcggcacgcttctggtcgccatgtatctgccgctgtttaatttgggcaacgtggtcgcctgatttgccgcacagatccggcgcggattcgctctgcgccggtttgtttttgttttgaatacattgagaacaaaatatgtctgatttgtctgtattgtcgccgtttgccgtgcctttggcagcggtgttcgggctgctggtcggaagtttcttaaatgtcgtcatttaccgcgtgccggtcatgatggaacgcggctggacggtatttgccaaagaatatttaaacctgccgctgaccgaagaggaaagccgtaccttcaacctgatgaaaccggattcctgctgtcccaaatgccgcgtgccgatacgcgcgtggcagaacatcccgattgtcagctacctgctcctgcgcggcaaatgcgcttcctgccaaaccaaaatcagcatacgttatcccttaatcgagctgctgaccggcgtattgttcgggctggtcgcctggcaatacggctggtcttggattacgctgggcggattggtactgaccgcgtttctgatttccctgacctttatcgatgcggacacccaatacctgcccgactcgatgacactgcccttaatttggctgggtctgatatttaatttggacggcggcttcgtgcctttgcagtctgccgttttaggtgcggtcgccggctatggttcattatggctcttatgtgcagtgtataaactgctcacaggaaaaaccggtatgggcaacggagatttcaaactgattgccgcattgggcgcgtggctcggcatatccgcattgcccgtactgatttttgtttcctcgctgatcggtttggtcgcggcaatcgttatgcgcgtcgccaaggggcagcattttgccttcggccccgcactgacagtttcgggctggataatttttacggcaaacgattccgtatggcgggcggtcaactggtggctgacccatccggtgctgtaagatgacggtatgggtcggactgaccggcggaatcggcagcggcaaatcggcagccgcgcaatgttttgccgatttgggcgtgccgcgcatcgatgcagacgcggcggcgcactcgctgacggcttcagacggcatcgccctgccggaaatcaggcggctgttcggcgacaccgtttttgacacacagggtttgttgcggcgcgacatattgcgtaaagaagtctttgcctccccatcgcgaaaagccttgctcgaatccgtgatgttgccgctgattttctcagaaatcaaaaaacagcaagaaacctttactgatgcagcttacggcattgtcgaaattccgctgctgacggaaaagcgtcaatttatcagcctgatacggcgtgtcctgaccataagtgcccctgtggaaaaacgtatcggcagggtgatggcccgcagcgggctgacgcgcggcgaggtggcggccgtcatcagccatcaggcatccgaatccgaacgcctgctgcttgcagacgatgtgctgctcaatgacggcagcctcaaaagcctgcgtgagaaaacaatgcgcctgcacgcgttttattcagggattttcgcctcaaaaccaacacaaggaaaacacaatgactgaatcgcggcaaacacgccttcaagtcaaatgtccgacctgtcaaacagcagtagtatggaaacccgaaaacgcattccgccccttctgttcgcaacgctgcaaactgatcgacttgggcggatgggcagacgggaaatatacggtttccggccaaacggaaagtttgccggaaatatccgaacccgacatggcataccgctgaccgccccgccttcccggcaaacaccctgaaagtcaaatgccgtctgaaacaaacacgcttcagacggcattttcattctcaaacctaatcgttggtatttgccgttacctcttccaatgaagtaatgccctgcataactttcaaaataccggcccggcgcaaatccaccataccctccttataggcaacgtccaaaatatccacttccgtaccgttgttcataatcacacgctgcatttcttcgctgatgggcataacctcatacacgcccgcacgccccttataaccctgcccccggcaacggtcgcaaccgacggcgcggtaaagtttccaatcttttgcaaggtcctcatcggtgaagccgacttccttcaaagcagaggcagacgggcgttccacttcctgtttgcagctcgaacacagcctgcgtaaaagacgctgcgccataatcaggctgaccgaactggcaatattaaacggcgcgacacccatattcagcatacgcgacaacgtcgccggcgcattattggtgtgcagggtggaaaacaccatatgccctgtttgtgccgccttaatcgcaatatcggcagtttccaaatcacgaatctcaccgaccataatgatgtccgggtcctgacgcaggaaagacttcaaagcagcggcaaaagtcaggccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtagggacggtgaatcgctaccaacacaattttttctgaaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctgccgtcctgcggtatccgtttttcggaaatgtccaaacgcgacattaccttaatccgtgaagcaagctgcccccttaccgcaatgggcggctgaaccacctcgcggagctgcccgtccacacggaaacggatacgggcattgtgttcgtaaaactcgaaatggatgtccgatgccccgctgcgcaaggcatccgacaaagtcttatggataaacctcggaacagggccgtcttctgcctcctcgttgtcgatatacagggtgtggctttcctcttcctcctgcccctccccaagctcctgaagcagcgatgtcgaacgcgaacccacccaatcgagcaaacccgccaactggtcatcctcgacaatgaccaactcaacctcaatccctgcggcagaaacggttttctgaatttgcggcatctgtgtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctgaaaacagcatcggcaacacttccttacccgcctgcgactcattgtagtaatgctcggcctgctcaacagtaaccacctggttttgaaccagaatcctcagcaaacctacgctcatacgaccttatccccaaatttattcattgttatacctgtacagcttttatagtggattaaatttaaaccagtacggcgttgcctcgccttgccgtactatctgtactgtctgcggcttcgtcgccttgtcctgatttaaatttaatccactatatcataaaacaacagatttccaagccggaacatcttttacgaagcctgaaaatcatttcatgattctaccgtcctaaaggtcggtttttcaagcaggaagaaaaattttcagatggcaaaaaagccctccagcactgaaaggccttatatcggaaacttcccgcaacacgggaaacagacaaatgaaatcgtcaaacctcgccaacaggaatcgaacctgtattttacgcttaagaggcatacgttctatccgttgaactatggcgagccgaaatgaaaaggagattttaaccctttccgacgacaaaga

SEQ ID NO: 74 - DNA, 13423 bp, Neisseria meningitidis
ggtatagacacgtccgttgcgtttcagaatgccgaagacaaccacttttcctgctgcaccgcgaccacgtctacctttacgccgtccgccgaaatcgctttcgtccggctcgacagggccctcaaaaacctcatcggcagccaaggctaaatgatggttgataaccgtgcggattttacggtagaacagtgctgccgaattgggatggatacccaaaatatcggcggcagaacgggcggtaacttccagtacaaaaaacggagcagttctttctgtacttttttctttaatttgcagtgcgttatcttcatatttcgagggtaacatatctgctaatctagtacagccccttaaatttagtccactataaaaaacggcggaaataaattttttccgcctcacttgaatttacccgcacacaccctaattttgccgacttatacgggcagctgcttgacggctgtccggtttccacttcaatctgcctgaaccgttcgggcagatgattgttttcaaactattttatcggagcataaatatgaccatccgtcctttacacgaccgcgttgtcgtcaaacgcttggaagctgaagaaaaaaccgcatcgggcatcgttttgccgggtgcggccgccgaaaaacccgatatgggcgaagtcatcgccgtgggcgcgggcaaaatcggtaaagacggcagccgccgtccgctggatgtcaaagtcggcgacaaaatcatcttcggcaaatacagcggccaaaccgtaaaagccgacggcgaagagctgttggtaatgcgcgaagaagatattttcggcatcgttgaaaaataaatacggacacgatgccgtctgaaacggcaaaccgccttcagacggcataaacggttttatcagacagttttaatgatttttggagaattgaaatggcagcaaaagacgtacagttcggcaatgaagtccgtcaaaaaatggtaaacggcgtgaacattctggcaaacgccgtccgcgtaaccttgggccccaaaggtcgcaacgtagtcgttgaccgcgcattcggcggcccgcacatcaccaaagacggcgtaaccgtcgccaaagaaatcgaactgaaagacaagtttgaaaatatgggcgcgcaaatggtgaaagaagttgcgtccaaaaccaacgacgtggcaggcgacggtacgactaccgccaccgtactggcgcaatccatcgttgccgaaggtatgaaatatgttaccgcaggtatgaatccgaccgacctgaaacgcggtatcgataaagccgtcgccgctttggttgacgaactgaaaaacatcgccaaaccttgcgacacttctaaagaaatcgcccaagtcggctctatttccgccaactccgacgaacaagtcggcgcgattatcgccgaagcgatggaaaaagtcggcaaagaaggcgtgattaccgttgaagacggcaagtctttggaaaacgagctggacgtagttgaaggtatgcagttcgaccgcggctacctgtctccttacttcatcaacgatgcggaaaaacaaatcgctgctttggacaatccgtttgtattgttgttcgacaaaaaaatcagcaacatccgcgacctgctgcctgttttggaacaagtggcaaaagccagccgtccgctgttgattatcgctgaagacgtagaaggcgaagccttggcgactttggtcgtgaacaacatccgaggcatcctgaaaaccgttgccgtcaaagcccctggcttcggcgaccgccgcaaagcgatgttgcaagacatcgccatcctgaccggcggcgtggtgatttccgaagaagtcggtctgtctttggaaaaagcgactttggacgacttgggtcaagccaaacgcatcgaaatcggtaaagaaaacaccaccatcatcgacggctttggcgacgcagcccaaatcgaagcgcgtgttgccgaaatccgccaacaaatcgaaaccgcaaccagcgattacgacaaagaaaaactgcaagagcgcgtggctaaattggcaggcggcgtggcagtcatcaaagtcggtgccgcgaccgaagtcgaaatgaaagagaaaaaagaccgcgtggaagacgcgctgcacgctacccgcgcagccgttgaagaaggcgtggttgcaggcggcggcgtagccctgttgcgtgcccgtgctgctttggaaaacctgcacaccggcaatgccgaccaagacgcaggcgtacaaatcgtcttgcgcgccgttgagtctccgctgcgccaaatcgttgccaacgcaggcggcgaacccagcgtggttgtgaacaaagtattggaaggcaaaggcaactacggttacaacgctggcagcggcgaatacggcgatatgatcgaaatgggcgtactcgaccccgccaaagtaacccgttctgcgctgcaacacgccgcatctatcgccggcttgatgctgaccactgattgcatgatcgctgaaatccccgaagacaaaccggctgtgcctgatatgggcggcatgggtggtatgggcggcatgatgtaagcaatgccgtctgaagctttcagataaaaaaccgcacggtcaacgccgtgcggttttttttgcgaataagtgcggctaaggcgcaaaccttaaaattgccaacgccgttctttgcatttttgttttttgatacgcgcgcttttgttttatttcccgccatcccaaaaacgaagagcggcaggaatttatcggaaaaacagcaacctttccgccgtcattcccgcgaaagcgggaatctaggtctgtcggtgcggaaacgtatcggataaaacggtttcttcagattttacgttctggattcccactttcgtgggaatgacgtggtgcaggtttctgtgcggatagcttcgtcattcccgcttttgcgggaatgacggcgacagggttgctgttatagtggattaacaaaaaccagtacggcgttgcctcgcctcagctcaaagagaacgattctctaaggtgcttaagcacgagtgaatcggttccgtactatttgtactgtctgcggcttcgtcgccttgtcctgatttttgttaatccactataaatgtgaaatccgccctttgaaaatcgggcggcggtttttgtttgcctgctttcaggcggcaaagccggttttcacgggtttctgcctgtttttcggatggtttgacgtgcttcggcggcgtgtttgccagaaaggtaaatgacagggtatgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcagattggaaagttgaaaatgatgccccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgcggaggcggcaaaattggatttgccggcaccggttttggaaaatgtggggcgttttcggaaaaaaacggaggggctgacgggctggcgtttttcgggcggcatcagtccggcggtcaatagaaatgccaataatgccgcgccgcaatattgccggcaaaacggaggccggcagatatgcagtgtcagccgggcggagcgggcggcagggttgaattatgaaatcgaggcggaaaagctgacgccgttggcagataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatagggcggaatacaataacggcaggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggttgggcgcaggagtggcggcagttgggcggtttgaacagtcgggtttccgcgtcttatgcccgccgcaactataagggcattgcggctttctcgacagaggcgcaacgcaaccgcgaatggaatgtctcgctggctttgagccacgacaagttgtcgtacaaaggtatcgtgccggcgttgaattatcgtttcggcaggacggaaagtaatgtgccgtatgcgaaacgccgcaacagcgaggtgtttgtgtcggcggattggcggttttgaatggtgggataatgccgtccgaactttggaaacaggttcggacggcatttttgcgcgttcaggcaagggcggcggcaaatacgccgcgcaaggcgttggagaggcggatttcttcggcttcttgcagtgttttttgtgtgatgtgtgtttcgattacttgatttgtttgcaaatatttttgcggttcgtccaatacggcttggcgcattatgccgtttaaaatgtctaaatctaaagagggtgtgagccattgtccgcgatgtttgatgaagacgttgcttctgccgccttcgagcaggatgccgtctgaattgaaaaacaggctgtcgaacgcgccttgtgtttcggcggtttgccacgcttggtcgaagagggcgcggcaggtggttttgaagcggcgcaggtagttttgtgcgggcaggacggcgggcgaaatgatgacgcgttgtttgtcggtcagacggtttaaaacggcgcgggacaggctgatgccgtctgaagcgagcagggctttgacgcggaacgcgccatcgggcaagtcggcaatgtattgtttgatttgattttcgcagccgtcgggcaggggcaggttgagggcttgggcggaggttttcagacggcataggtggcggtcgagcagggtgcagcgtccgttttccgcgcgcagggtttcaaaaatgccgaagtcggggcgcaattcgttgaggaaacgggctttccagccgcattcgcgatattcggcggcggggtcgctgtcgatgacgatgccggaaccgacaccgtacacgccttgataaatgccgtctgaaagcggcgtgagcgacaaggtgcggataacgacgttgaacgtgccttcaaaccccaagccgccggaacacgggttcaaatagccgatgctgcccgtataaagtccgcgcgcttcggcttcgagcgattcgataatctgcatactcatttttttgggcgcgccggtgatgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcataggggacgggctggcgcaggcggcggtagaggctgacgggattgccgtaggcttgcaggtgcaggcgggtggtgtagttgatttgataggtgtcgccgcgccggatggcttcgtggatttggcggatgcggtcgaggtaatcggtttcggatacggagggttgcggcgtggaaatgccggcggggaggccgtctgagtgtcgggcaagccagctttcggcatcgatgtcggcgcagttggcaaaccagtgcagggcaagattgccgccgcgttcggactcaacccccgtcagcggcaaaccgaatccgtagtctgcaaacaacaccgaatgcagccctttttgccagcccgattgcagcgcgccgtccaaagcatcgagttcttcgggacggaaaaaacggctttccacatgattttgatagcgttttgcgcggccgcttacggcatcgtcaaacagggcgaaataaggcatggcaatccggggcaaatgttttgattatacgccccttattacacatattttcagacaattcggcaaatatcggcaaaatgtaattttatgtagagaaagcgggggcgaaggtgtaaaattgtgaaaacaaattccgatttccaacctgaaatacaataaggagacctttatggcagaccaccagctgcaaccgtttgaaaacgtagaattaggcgaaaagcaagaccagctccaagtatagtggattaacaaaaaccagtacagcggtgcctcgccttagctcgaagagaacgattctctaaggtgctgaagcaccgagtgaatcggtttcgtactatctgtactgtctgcgtcttcgccgccttgtcctgatttttgttaatccgctataaagaccgtcgggcatctgcagccgtcattcccgcgcaggcgggaatctagtctgttcggtttcagttatttccgataaatgcctgttgcttttcatttctagattcccactttcgtgggaatgacgggatgtgggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacggaaagtggcgggaatgacggttcgggcattccttaaatcacccgtgtatcgctgtaaatcttagagatggtggaatatagcggattaacaaaaaccagtacggcgttgcctcgccttagctcaaagagaacgattctctaaggtgctgaagcaccgagtgaatcggttccgtactatttgtactgtccgcggcttcgccgccttgtcctgatttttgttaatccgctatacatctgattaatgccgaatctttggaagaagtcttgaaacaatagaagcaggcaattggaatagggttttcttttcataagaaacagccgcaaagaccgtgatctttgcggctgtctgcttcctgtccgtcagaaccggtagcctacgccgactcgtccgctgtggttgccgtactgtttggaaccggcgtagctgtaacgtgccaagccgttccagccgttgccgaattcgacatccgcgcccaggccggcaaccagacgggtgtgcggcatattgcgtgcccccgtcttgccggttgctgcagtcgcgccggtaaagccgcccgttaccgtgtagtcgcgtccgttcaggtcgcgttccacgcccgccgttgcaaacaggacggctttatcgctcaagggttgcgacagcttcagacccgcgagtccgaccagcgtgccttcagtgaggctgttgccgctccagcccaaagcactgcctttttcggcgaatgcatcctgtttgagcaggtcgtagcgcagaccgccttcgaccgtcaaatctcccgttgcggcaaacggaacgttgacaccgcccagtgcgcccagctgcatcagcgtgccgttgacgctgccttccgcatgttcgtccgcaccggtgctgcggctgatgctgtttttgtagcgtccgtaggagaacaggcctttgagatagccgatatcgcccgcatcgtgccgtatgcctgcaaacagactaatgctgtcggtttttgcatttgcactgttttcgctccatgtgctgcgtcccatgcccagtgtggcggctgctgtcgtattttcgccggttttcgcggcaatgccgacggtttgggtactgccgcgcattttgccttcaacaccgccctgttcccacgttccaccgtcctgttgggtttgcgcgatgacgcgcagacccgtgccgttgtggtccaacccgtccgatacggctttcaggcggcgtccctgcatatcggcatgggcggcggtactgtcggcatagacggtagcggcgagactgttgaagatgcgtacaccgtcggcggcattcgcatgctgtacggctgccgctgcgcggaaagttgcgccgtaggggcggatgcccggcatatctgtgcggtcggctgccgcagtttcaaccgtctcgggtgttgcggatgattcggaggcatccagttcgaccatcaggttttccagattgctgccgccctgttctacggcgtgtttcagaccggcgggcgcggaatgtgccgctgccgaagcagtccgtgccgcattgccgcgacggacataataggacagcgtgtcgccttcactgcccgctgttttttcgacgctgtcgagggaagccagcaggccgccgtcggtttcgatgtttgtgaagaaagaataatcctgcccgattttggcggcactcaggaagggaacacgtcgtccggtactgttgagatagcctgcccccttgccgcgtgccgacatgtacagcttgccgccgataatcgccgtaccgtccactttcagcagtttgcccaaacgtgtgtacagcgtacctttgccgtccagctgcagactgcctttgatgtgtacggtttcgtttgcgccggattggtcggtatctgccagatagacaatgccgtcgctgttcaggctgccgccggatgccgccccgttataaatcagcgcacctttggtttcgacgcgcatatccgatttgttgttgccgtacaacaccagcgaaccgccttcgataatggttttgcccgtataggtgttgttgccgtgcagttgcagttggctgccgccttttttgatcaggccgcccgtgcctgaaatgtcgttacggaaggagtaggcaatatcggatgtacctttcgtatcggcggtaaagtcgccgaacggaaaggacgcgggtccgttcatggccttacccgcatccagcagtccccagccgaacttgctgtccacgccgactgcaccgatgtcctgagccgtcgtcagcaacgtggtacgcaggttgtcgttgctcatccacgggtatttctgcagcagcagagccgccgtgccggttacgatgggtgcggaaaaggatgttccggcaatttgaatcgggtttgtacgggtgaaacggacgcttgcttcatagggtgccgacaggcaccacatggcagtaattccgcaatggttggagccatactcaagcggttctgtacccggttctccatacatttcccgtttgaacttttctccactgcggtctacgcctgcgactgtgataatgcctttttgagcgtctttttcataaaatggcaatagggcatatgtgttgggctgagcttgtgcgtcattgcctgtcgaaaagatgaaaagcatgtttttattacggatgtggtaggacaggttgccgtaatcgctctgttgcatcaggcggataccctcgtctgttttatcaccgccggaatagtcgagcaacgcttggcggtactgctcctccgaattggctatttggaaaaggtcggcagtgcctgccctcgatgttgttccaaaactgttattgacgatgcgcacgccacgttcgcccagcttgacccatgcattgcggatggctgcaaccatcatttcgttcttggtttcatcattcgtattcattatgtgtagcgtcgcatcgggcgcaataccgcctgcaggtctgccgtccacggaacgcccgccaataatatgggagaccaaatcgatgtgtccgatttcttttacgtggcggatatccgtcggctttgcttcagtctctataacggcctcatcgtcgaaagaagcttcaatgtctttaccgcctccgtcttcaggcgcttccttccgcatatacgccgtatagtttttgtaattttcgttatagccgtgttcttttctgccatacagttcgggaaaggatatgctgccgacggattcgcctgtgtcgacgatacctacctctaccccgcgtcctgtatagcctgcttcaattgcaggtttgaggttgatcaaattcttgtatgcgtcatttgggtttggaaagtctccggtatgcagattcggggggggggcattgattttggcatccctgtctgtaaccgcaacgtcatcccgaccggcacagagcatgcttctgtctttgcacatttcgttcttgataccggcgtaagatactgctgctgatttcgctgttgttgctctgctgttgctgccgataccggtaccgcctgcattgaagtcgggcgcagaagtgccgcctccgccgccgcctaagcaggcagaaagtgttgttgcaacagctaacgccatggcagtcggtttgaaagtttttgtagggaaggttggggtcgttcgcatgatgaggtctccttgaatctgacaatagaattcaggcgagggaataaaaattccgtaatgtttagatgtaacccatttttatattttgaattatattattataggggttgtcttggacaactaggataaactcgattttactaattgttttaaaatggaaatttgaactttcgacaaatagctcaatgagtttattttgtttataccggcttagacggctttttctcatagggataattctaacttaatttgaatttccctagttatagtggatgaacaaaaaccagtacggcgttgcctcgccttagctcaaagagaacgattctttaacaagtgaatcggttccgtactatctgtactgtctgcggcttcgtcgccttgtcctgatttttgttaatccgctataaagaccgtcgggcatctgcagccgtcattcccgcgcaggcgggaatctaggtctgttcggtttcagttatttccgataaatgcctgttgctttttatttctagattcccacttccgtgggaatgacgggatgtgggttcgtgggaatgacgtggtgcaggtttccgtgcggatggatttgtcattcccgcgcaggcgggaatctagaccttagaacaacagcaatattcaaagattatctgaaagtccgagattctagattcccgctttcgcgggaatgacgaaaagtggcgggaatgacggtttgggcattccttaaattacccgtgtatcgctgtaaatcttagagatggcggaatatagcggattaacaaaaaccagtacagcgttgcctcgccttagctcgaagagaacgattctctaaggtgctgaagcaccgagtgaatcggttccgtactatttgtactgtctgcggcttcgccgccttgtcctgatttttgttaatccactatacaaagacaaaaacatcgacctcggtcatgactgattgccggtgaagcaataaaaatgccgtctgaacctgaaaacgggttcagacggcattttctatcggggttttaaagcggcattaaatgtcggtttccaaataaacgacttgggtttgcagatattcttccaaaccgtgtttgccgtccgcgccgccgataccggattttttccaaccggcgtggaaaccctgcatcgcttcaaagttttcgcggttgatgtaggtttcgccgaattgcaggcggcgggtaacgtagaaggcttcgtttaaattagtcgtataaacagaactggtcagaccaaactcgcaatcgtttgccaaggcgatgacttggtcgagcgtgtcgaaagcggaaacgggcagcacggggccgaaggtttcttctttcataatgtccatactgttgtcggtgtcggtcagcagggtcggctcgaagaaataaccgcgtccttcggcgcgtttgccgccgcaaaccaatttcgcaccttgtttgactgcccgttccactttttcggcaacggctttgacggcgcgttcttcaatcagcgggcccatttccagcgcgcctgcttcggcttcggcagggttgccgtagcgcacgcctttcatcgcggcggtcattttttcaatgaatgcgtctttcagactgctgtggacatagacgcgctcggcgcagttgcagatttgaccggtgttgccgacgcgcgaagccaagatggatttcaccgccaagtccaaatccgcatctttcaaaacgatggcaggcgctttgccgccgagttccagcgaaactttggtgatgttggcggaggcggcttccatcacttggcggcctgcttcgacggagccggtcaggctgaccatatcgacttgcggatgggcggacaaggcattgccgatttccgcgccgggaccgttcaccacgttgaacacgcctgcgggcagtccgaccgcatcgacgatttcggcgaagatgtggcagttgatcggggttacgctgctgggtttgacgacgatggtgttgcccgttaccaaagcggggcccattttgcgggcaatcaggaagaaggggaagttccacggcaaaatgccggcaattacgcccagcggacgtttgaacaataaaatattttcgcgcgggcggtcgctttggatgatttcgccttcgtagcggcgcgcccattcggcctgataatcgagatagtcggcggtgaacatgacttccacgcgtgccaagtctttggttttgccgccttcggcaacgatggtgtcggtcagctcgtcggcacgttcgcgtatgccttgggcgattttacgcaaatacgcgccgcgttcgaccgcaggcagacgctcccaagccggttgcgccgcacgcgccgccgcgacggcgcggtcaacgtccgccttgccgcctttgggttcgcgggcgatggcctcttcggtggacgggttcaatacgtcgcgccattcgccgttgaaatcgttttcaaagcgtccgttgatgtacatggccaattgtttcatttcgggttctccagttttgtagttagatgtagttttagtttattcccaaataaattgc

SEQ ID NO: 75 - DNA, 33962 bp, Neisseria meningitidis
gatctaagcgacacagccggggcgaacactgaggcaatctacacttcagacggcattaccgccaactctacccaactcgaacagctcaaaaaactgtttcccgcctgttttgacgcagacggaaatttccttatcgacagattacaagccgaaatcgcgccgcagaccgacatcggacgcgaattttacgaaatgaactggctgggcaaatcatatgctcgcctgcttcgcaacctgccgcccgaaaccctgataagtgaagacaagacgcacaacgccaagcccgaaaatgcaggcagccaaaacctgctgattcgtggcgacaatctagaagtgttgaaacacttaaaaaacgcctacacaaacagcgtgaagatgatttacatcgacccgccctaaaacaccggatcagacggctttgtctatcaggacgaccgcaaattcacacccgctgaacttgcccgcctagccaatattgatgaagacgaagccgcgcggattttagatttcaccgacaaaggctcaaactcgcacagcgcatggctcacctttatgtatccgcgcctgtatgtcgcccgcgaactgttaaaggacgacggtgtgatttttatctcgattgacgataacgaagcggcgcagttgaaattgttgtgtgatgaagtgtttggggaagggaattttgttgcacaattgccttggcgaaaaagaacagctaaatcagatgtgccttttggtatttcgcaggattatgaatggatatttgtattcgcaaaatcttgccaatttattgcagcaactaaaggcaaggaacgacgctattatgagactgatgatttccccgatcgtccttggcgtacccacgacttaacgaaacaaacaactgcggcggaaaggccaaatagttttttcacaatggttgatcccaagacaggaaaaaaatatccagcaaatccaaatgcaacttggcgtgtaaccaaagatacatttcaagattattataataaaggaaaaatcgttttccctgatgattatgatttcttaaatatcagcaatccagttatgcgttactttaaagatgacgacatgaaaaaagctggcgaggattttggcaaagtagctgtaagcagtagattacctgaaaatgttggtacattagccgatgcagtagccgaatatttggctatttttagtaggacgctacctgaaaatatcggaatgactaaagaaggcacaaaagaaatcacagatttatttggtagcaaaatatttaccttccccaagcctagtcaattgattaaatttttagtttcaataagttcaaagagtaatgacctaatcctagacttcttcgcaggcagcggcacaaccgcccacgccgtgatgcagcttaacgccgaaggacaaaacggtaaccgccgctatatctgtgtacagcttcccgaaaaaaccgctgaaaaatccgaagcccgtaaagcaggctacccgaccatcttcgacatcaccaaagcccgcatagaaaaagccgccgccaaaatccgcgtcgaacatcccgattacacgggcgattcgggcttcaaaatctttcaaacggcagacaatttcaggcagcatccggacaaggatttttcgcccgaacaaccggatttgccgcttaacgatgaattaagcgaagaacagctgcaaacgcttctgaccacctggacgctgtatgacggggcggcactgaccacgccggttgagcctgtgcggttaggggcttacacggcgtatctgtgcgaaaaacggctgtatctgatgaatgccggttttacttccgccgatttgttggcgtttatccgcaagctggacgacgatgcggatttcaatcccaaccgcgtgattgtattcggcagcaatatggcaagcgccatgcagcacgaacttgaccaggcggttcgcggttatgccaataaaaaagagattgagttgaatgtggttatcagggtttgacggaggcaattcatgagcggttttaattacgagaaaaaccagccgcaccaaatgcgggcggtttcggcggttttgggcgtgtttgacggggcaacgcccaaatatcggacggcagacgaaaatcccgaacttttgtttgctgcaaaacaatacgcaaacaatatcctgaaagtgcaaagccaaaacggtatagacggccgattccccgaccgttcggacgaccaaaatatccttgatatttccatggaaacgggcacgggcaaaacctatacctacacacaaaccatgttcgagctgcaccgttggctgggcgtgttcaaatttatcgtggtcgtgccgactttgtccattaaggcgggaacacagcagtttttgcaaagcaaggctttggcagagcattttgaacaggatttcggcggcgattatgaaggcgtacgcctgaaaacctatgtggtggaaagcgcgaaaaagaataagggcaaaaagtccaatgcgcccataacgattgagcaatttgtcaaagcggaaaacaaaaaggaaattcatgtgctgctgattaacgcgggcatggttaattcgtcgtccatgaacgatacgggcgacaaggcattgaaggatttgtttgacaatcccgttgatgcattggctgccgtgcgcccgtttatgattgtggacgaaccgcataaattcccgacccgagatagcgcgaaaacgtggggcaatatcaaacgcttaaaaccgcaatatattttgcgctacggtgcaacatttaacgatgaatattacaacttgctttaccgtttgacggcagtagacgcgtttaacgacgggctggtcaaaggcgtgcgcgtgtttcaggaagaaatgcagggcggcatggatgcggcggtaaaactggtgtcgtcggacggcaaagaagcgaaatttgaattaaacgaaaaggacaaaaagcagacgttcaaactggcaaaaggcgaagatttggcgcaaatccatccggctatttcggatttgaaaatcgacaaaatgaataaaaccgtggtggtgttaagcaacggcttggagttgaaaacgggtgccgtcatcaacccttattcctattcgcaaacggtgcaggatgcgatgatgcagcgggcggttgccgaacatttcaagctggaacgcgcgcttttggcagaacgcgcgccacagcccaaaatcaagccgctgacgctgttttttattgacgatatcgcgggctaccgcagcggcaacgagctttcaggcagcctgaaagataaatttgaaagctggattcgcgcggaagcggcacgccgtctgaaaacggaaagcgacccgttttaccgcgattacctgcaaaagacgttggacgatgtatccgcctgccacggcggctatttttccaaagacaatacagacagcgacgatagaatcgagcaggaaatcaatgaaatcctgcacgataaggaaaaactgctgtctttggacaacccgcgccgctttattttttccaaatggacgctgcgcgaaggctgggacaatcccaacgttttccagatttgcaaactgcgttccagcggcagcacgacttccaagctgcaagaagtcggacgcggcctgcgcctgccggtaaacgagctgatggcgcgggtgcgcgatgtaccgtacaaactgaattattttgtcgatagcagcgaaaaagactttgtgaagcagcttgtcggcgaaatcaacgacaattcttttcaggaagaaatctccaaaaagtttaccgaagagctgaaacaaaaaatattgcaaaaataccccgatatcaaaccgctggtattggtaaaccaactgtttttagatggcatcattgacgacaatgaaaactttgccgaagacggctatgacaaattaaaagccgcctatcccgaagccttccccaaaggtttggacaaaggcaaagtcagcaacgccaaagacgaaggcaaagacaccatcatcatgcgcgaaggcaaatatgaagaactcaaagccttgtgggagctgattcaccataaagccgttttgcagtataaaatcaaggatgaagccgaatttgccgatttatttaccgcctatttgcatgaaaacgctgccaaattcccacaggcaggcatacgcacggcggtaaacgaagcttatatcaacaacgggcttatgctttcccgccgcatagacagttttgaagatgaagattttatccgtttcaacacaatgacttaccgagagtttctggaaaaactggcacaaacggcaaaaatccgtatgcagactttgcatcaggcgttttactgcatccgcaacgaactgaacattggcgattttttgaatatgcaaaccatcgcccaaatcaaaaacggcttcaaccggtttttgcttcatcattccttccataaattcgaactggattaccggcttgtcggcagcaaaatccatccgaccaaatttaccaataaagacggcaaaccgcgcgcggtgaaaaaagcagatttgggcagatttgaagatacggagcaccggcctgccgccggctatctcttcggcgagattttctacgattcggatatagaacatgaaaatgtcgccaacaaccaaattgaaggcgtaatcgtatttaccaaaataccgagaaactccatcaaaatccctgttgccggcggcggcacgtattcgcccgattttgcctatatcgtgaaaaccaaaagcggcgagatcctgaactttgtgattgaagccaaagggactgacggggcggaagatttgcgaaaaagcgaagagcggaaaatcaaacatgccgaaaagctgtttgccgagatttccaaagaaatcaaggtggtgttcaaaacgcagtttgacggckagaggatagccgaactgatcgggcaaaatatgcccgcaggcgggcattctgaaaacgggcgttaaagaacgaatgttcggggcgcgtgccgtctgcttcgggattttaaaatgcccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataaaggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccctgggtcagttgcgtgtagctcatggcaatctttcttgcaggaaaggccgtatgctaccgcatactggcctttttctgttagggaaagttgcacttcaaatgcgaatccgccaagttctaattttctaaagttttcaccttttttccaccaaggcacaatatagttttttacagtgattttttcatctttaagggttataagactatcatcgtctctttgcggatcagaaaataaagacacccattccatctcttgaatattagtatattcatgggcttccgcctcaaaacataatgccgattaaatcaacaaagcaatggtagataaagcaaattttctattttagtctccttaatgtttaattgaaacgctgatttgggtattgtcatgccgatgcggaatcggtctccgtgccggatatattgtgtgaagtctctcgtcttttccagtatgcgcctaatatcggcttaaggcaaacggaggggcggaatccgtatgcggcacgccgccgttccctgccgtataatcatattgtttgaaaacctgttgacggagccgttatgaccgatttgtttgcccgagaacccgacgcgccgcttgccgaacgattgcgtccgcatacgcttgacgacgtggtggggcaggaacacctcatcggcgaaggtaaacctttgcgcgtggcggtagaaggcggcaagccgcattctatgttgctgtgggggccgccgggcgtgggcaagacgacgttggcgcggattttggcgcagagtttcaacgcccagtttttgcctgtttccgccgtattttccggcgtgaaggacatccgcgaggcaatcgataaagccgaaatcgctttgcagcagggacgcgcgacgattttgtttgtcgatgaagtccaccgcttcaacaaggcgcagcaggacgcgtttttgccgcatgtcgaaagcggtttgctaacctttattggtgcgacgacggaaaatccgtcgtttgaagtcaatcccgcgctgttgagccgcgctcaggtgtatgttttgcaacccttgtcttcagacgacctgaaaaagctgattgccaaggtattggctttgcctgaataccaagagtttacgattgaaacggatgcgcaaaaattactcgtgaataccgccgacggtgatgcgcgcagattgttgaatttgttggaacaacttttacgcgccgccgatacacgtcgtctgaaaaacttaaccgccgaatttctcgccgacagtctcggggcgcaaatccgccgtttcgacaaaggcggcgagagtttctacaaccaaatctccgccctgcacaaatccgtgcgcggttcgcatccgaacgccgcgctgtattggttctgccgtatgctcgacggcggcaccgacccgcgctacctcgcccgccgcatcgtgcgtatcgcttgggaagacatcgggcttgccgacccgcgcgccttccaaatcgccaacgatgccgccgccaccttcgaacgcttaggctcgcccgaaggcgaactggctttggcgcaagcggtattgtatcttgccgccgccgcgaaatccaacgcgggctacaaggcatacaaccaaatgcgccacttcgtcaaagaaaacgctagcgacgaagtgcccgtccacctgcgcaacgccccgaccaagctgatgaaggaattgggctacggacgcgaataccgctacgcccacgacgaaccgaacgcctactccgccggcgaaagctatatgcccgacggcttggacgaaccggacttctaccaacccgtcccgcgcgggttggaaatcaaaatcggcgaaaagctggaatggttgaaatcgctggacgaagaagtattaaaggcaaaatgaagcaatgctgtctgaagcagaacagtatggcaaagccggtacaccaaaaaggcgtatcggctttttttcaggtcttatcctgtttattgataaagccaataaagacaacgtggtatagtggattaagtttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatattaatcgacgcatcgggcttgggcgaaaaaattaaagacggcaaaaaaaccgtactttcccgcgaagaagaacaaaaaaatctgcaataccttcacgcacaaacaggcagtggaagatttcagtgtggtaatcggctacgatgaaatcaaagcgaagaatcacagcttgtcggcggggcagtatttcgaggtaaagattgattatgtggatatttccgccgacgaatttgcgcaaaaaatggcgggattttcagcggatttggataaacttttcgccgaatctgccgaattggaaaaagagattaaggatagattggcgatgttgaaattcaattcataaataccgatgaatgaaaccggtcaaacttaaaatgccgtctgaaagcctttcagacggcattttgtttggtttggaaaatacttatgccgttctttccctgaaagagagaatccaaaaaaccaaagccacaggaatttatcggaaatgacaaaaacccgacgaaccggattcccgccagcgcgggaatgacgaattagaagttacccgaaatttgaaaaaacaaaatccaacccaacagaccgggttttcgtttgcacggaaataatgcaataaataaagcaaatataaagtatttgaatttactatattatttttccgcttcttcaaagccgacgacttccaaaccgaagccggtcaggccggtgaaagatgagggctgcccgaggacgcgcagttttttgacgttgaggccggcgaggatttgtgcgccgatgccgtagcttttgctgtcccatttgtaggcttggtttgcgcctttgggtagggttcggtcgagcagggatgcgccgtcttcggtgcggtgtaagaggatgacgacgccgctttcggcttgttggatgtgctcaagggctttgggcagcgaccatgaatggcgcgggttggcttgaatgaagtccatcacactgaagggttcgtggacgcggacgagggtttcggtgtcggcggcgggcgtgcctttgacgagggcgaggtgggtttcgccggagagtttgtcgacgtaaacgtgttgttggaactcgccccacggggtttgtacaggcgcattgcccatgtcttcaagcaggctttcggtacggctgcggtattcgatgaggtcggcaatcgtgccgattttgagcttgtgttcttcggcgaatttcatcagttcgggcatacgcgccatcgtgccgtcgtcgttgatgatttcgcaaataacggaggcaggaatcagcccgttcatttgcgccaggtcgacgccggcttcggtgtgtccggcgcggacgagtacgccgcctttttgggcgcgaagcggaaagatatgaccgggttggacgatgtcttcgggtttagcggtcggggaaacggcggtttgaatagtcagggcgcggtcggcggcggaaatgccggtggtaatgccgtgtgcggcttcgatggagacggtaaagttggtgccgtattgcgcgccgtttttttgggtcatcatcggcagcccgagtttttcgaccatttcgccgtccatcggcaggcagaccaagccgcgcgcgtgtttgatcatgaagttgatggcttcgggcgtgacgaattgcgccgccatcagcaggtcgccttcgttttctcggtcttcggcatcggtgatgatgaccattttgccggctttgatgtcggctaggatttcggggatgggggagatatgggacatggtgtgttttcctgtgtgttcggacgggcgggcggtgtgttcggtatcgagccaaaaggcgggcatttttgccgcctgttcgattttacgggcttttttctcgccgaaggatttgtttttcaaaagggcggagagttcgcctgtgttgagggcaacggcttcagcaaaacgagtttgcaaaccgccgtagtatttttctatccactgccgcaggttgtggcggcgcagaccggctgtgtcggtcatcgtttcatcctttgtagaaatcggatgtagcggattgtaatcgcgtatttaccaaaaagcaaatctgtttttttcgccaaaccgaattatttgctttttggtaaacagatgccgtctgaagccggattcgtggcttcagacggcattgccgcaatccccgccggcggggcggctgtttcttcccgcccgcttccgattcggggtttgccggaagcttattccgaaaaaaatttctgataaacggccttgattgccgggtacagcataggcggtacgagcaggcgcaatatcggcaatcctatgatgaatgcggtcttcccgataaaaaccggacggattgccttcgcgccgaatatctttctgcatttttctttaaatgaaaaatatttccggtagatgaggataatgtttttggaaaaataaagccttaccaatatagacctcagatagccgatattgtcgaagacaaatttttgcaaaccgccgtagatgggggaatttttgttttcgactaaaaaatccacaccccagtcgagatgcgtcagcacatcgctgaaatttttgtatttgatgttgtggctgatagagccgccgagaacgcggtactggtaaaaagggttatcgtaaaaggcaaaagtcttgataaaacgcgccaattgcaaactgtacgggaaatcctcgtgaatgtatccttttgggaaaaacagattgtttttaatgatgatttcccgcctgacaatctttgtccacgcgttggcgatatagtaccgcccctccaccagcgtttcaaaatggcggacaaaatcattatccgaaaagtccgcccctttggggatgtcgcggtaattgaaggacgagggatgcaggatcaaatcaacctttttgtctgcaagttgttgtaaatcaaagagaatccccccccgcgttttttgaacggttggtatcggcccaataatcgtcgctgtccaaaaagattaggtaatcgccttttgccgcccggataccggcgttgcgggcatccgacagcccgccgttttcttgatgaatcacttttatatgcggatatttgcctgcatattcgtcgcaaatcttcccgcagccgtccggcgaaccgtcatcgaccaaaatcatttcataatcggcaaaattttcggcaagcacggaatccacgcagcagcggaggtattttccacattgtaaatagggacgatgatggagaaaatcataaatatcaatccattatattaagatgtttgcgcgtatgcctcaaacccgcgctcgcaatgcgtttgcatccgcaccctgtaactttatatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaaacttattgctttatcaaggtatggaaacctgtttcccgaaaggcggcgcaggatgcccgttccctgcaactttgccttattccgacatcagatgtcccagcttgtctgctttggtttggaggtagcgtttgttttcaaggttttccccgacgtgcagggggatgcgttcgaccacgttaatccccgcatctttcagggtttggattttttcggggttgttggtcagcagtttgaccgagcggatgcccagatattcgtagatagattgcgccaaacggaaatcgcgggcatcgacgggcagcccgagtgccaaattggcttcaaccgtatccataccttggtcttgcagatgataggcgcggattttgttaatcagcccgatgccgcgtccttcctgacgcagatagacgatgatgccgcgcccctctgtctgtaccgccctcatggccgcttcaagttgaggtccgcagtcgcattttctcgagaacagcgcatcgcccgtcaggcattcggagtggatgcgcgtcagaaccggattgccgtctgaaaaattaccgacggtcagcgcgacgtgttcctgcccgtttgcctcttcaaagccgtgcatcgtaaatacgccccattcggtcggcaggcggcaggatgccacatggttcaacatttcagacatcttcactcccatcttttccggcagacatacccaacagcagtttcaaaggttcggacaaagccaaggcaagagccacccattccacctgtgctgccgtacccgcacactctgcgcattcaaattccacatgaaccacgcccaacacaccgccactttccgtgcagaccggaatggaaatttgcgccgccgaagcatgattgcgttctcccgaaagctcccccaaatccaaccaacggcgtacatccgaggcaacattcatccaaccgctttgcgccgaacggcaagccagcgaaaccttgcctgccgcttcatccaaatcccacaggttttccaaaacctcgccctgtcgggacaggcatatcagttggaaagcctggttttcagatggcatcaaggcatagaccgccgcactccgcacgcctgtcgagcgcgaaaacaccgaatccaaagccatgaaaagccgtttcagtgcatcttcgcggacattgtcgcacgacaggtaatcggcaagtttccaaccctcatcactgcgccacaaaaccgaacggtctatcgaagccgtccccatatccattaccgtctgcgccgtcagatacgccgcccgaacctcgtcaagcggcagcttcaaaccctgagtcagcagaaaatccttaatcaaagcagcaggcatacccaaattccgtcaataaaaacaaaaaaccgcccgattccgatgtcaggcggacgaaaaacagattttaccgccccaaaccccaagccatcaacagccccgccgaaaaccttgcacaaaaaaacaaaatctgtataatcgtccaattcccatgcggacgtggcgaaattggtagacgcaccagatttaggttctggcgccgagaggtgtgagagttcgagtctctccgtccgcaccaataatgataaataaattatatagttaatgcttatcgggacaaattagtgccacaaaacataagtcgtctgcttttcagcgggcggcttttttatctgcctatatgtttcaacacgcagaacggtacataaagtgccgccatttgttccgcaccgaatcggaaacgggtgcttccgcacgcaatcagattcaccacccctaatgccggggtttcaaccggaaagaagaaaatattgattttgatgatggcatcaaaaaaccccttccgctcgtctgccaaaaggaatggttaagaaaagcaatgcgtcttttgatggaacgcgatatataaggaattgaggggaagggcaggcgggtttctgcccgttaatcctgcggacggtcccgccaaacccgacacgcgcgggcatatggcggactgtttacaatattgtctaaaaatctgaacctgcaaacgtgaaataaggtagaatacgccccgttattttaccgtccaatccccatttaccaaggaaaaacgatgagtacttcattgagttaccgcgatgcaggtgtcgatatcgacgcaggcgaccaactggtcgaaaacatcaaaccgtttgccaaacgcacgatgcgcccggaagtattgggggatttgggcggttttggcgcattggtcgaaatcggcaagaaatatcaaaatcccgtattggtcagcggtacggacggcgtgggtaccaagctcaagcttgcctttgattgggataaacatgatacggtcggcatcgaccttgttgcaatgagtgtcaacgatattttggttcaaggggctgagcccttgtttttcttggactattttgcctgcggtaaattggatgttccgcgcgcgaccgatgttattaaaggcattgcccaaggttgcgaagaatccggttgcgccctgattggcggggaaactgccgaaatgccgggtatgtatcccgtcggagaatacgatttggcgggttttgccgtcggcgtggtggaaaaagagaatgtcattaccggccgcagcatcggcgtaggcgatgtggtattgggtttggcttccaacggcgcacattcaaacggctattcccttatccgtaaaatcatcgaacgcgacaatcccgatctggatgccgagtttgataatggcaaaaccttgcgggaggctgttattgcgccgacccgtctgtatgtgaaaccgattcttgccgctttggaaaaatttaccattaaaggtatggcacacattaccggcggcggcattaccgaaaacgtgccgcgcgtgttgcctgaaaacacggttgcacaaatcgatgctaaatcgtgggaattgcccaagctcttccaatggcttcaaaaggcgggcaatgtggaaacccaagaaatgtaccgaacctttaactgcggcatcggcatggtcgttattgttgctgccgaagatgccgatgcggttcagggtctcttgggtgaacaaggtgaaacagtttaccgtttaggtttgatccgtgagcgtcagggagacgagcatcaaacccaggttgcctgattgcttctatagcgaaatgccgtctcaaacatgggtttggacggcatttttatagaggatggcggattcgcatttgaagtgcaactttccctaacagaaaaaggccagtatgcggtagcatacggcctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacaccctttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggattaacaaaaatcaggacaaggcgacgaagccgcagacagtacagatagtacggcaaggcgaggcaacgccgtaccggtttttgttaatccactatatattgattgatatgagggtgggttacacatgcttaaacgatataagccattgtatatttatgggattcggaatggaacattttaccctgcattagtatttccgctttttattatgccgtctgaaaatatcatgatgatgcgttttcagacggcatagctgatattgcagtatcagataggggcaaacggaaaacactaaaccgaacaatattactgctatgccaagcgtacttatgggggcataaacttacatgcttggtctgttatccgaatgaccgtacggggattaaaacccctaatatgccgtctgaacgcctattccggcacaggttgggggacgttgtgccggatggcgtaaacggcggcctgcacccggctgctgaggttgagtttgcggagcaggttttgaacgtggactttgacggtggattcggcaagatcgaggtggcgggcgatgattttgttgctgtgtcctgcggcgagatagcccaagatttccagttcacgaggggtaagtgaggagagtgcctgcgtcccttgggcaggttggggggaaatcaggcttttgacgagtttggcggtcatctcgggcgagaatacattatcgccttcagcggctttgcgtatgctttcgagcagaaagtcggcgttgatgtttttcagcaggtagccgcgcgcgccgatgcgcatacattcggtcaaatcgtcgctgtcttcggaaacggtcagcataatcactgcctgctgcggattgatgctgatgatttgggagagtgcttcgcgtccgttcataccgggcatatcaaggtcaagcaggacgacatcgggttgcagccgactgatcattttgatacccgagaggccgtctgcggcttcgccgatgacttcaaaaccgtgttggcgcgacaaaagggctttaatgccgctgcggaagagggtatggtcgtctatcagaataattttaatagtcatttcaagctttcttcagatgcaaccgtcaatgagacggtggttccctgttgagcttgggaacggatttctaaaacggcatggatgcgtttggcacgctcctgcatgatgtgcagtccgacatggctgcccgtgggttctcctattttctccgtgtcgaaaccttgtccgttgtcttggatggtcatggtaaagcgtccgccgtgttcggaaagggtgaattttacatgggtggcgcgggcgtgtttgcggatgttggacaggctttcctgcaggataaaaatcatttggagctgcgcttcctgaggcggcaggaacgaaccgttttcccaggcggtttcgaccgttatcccggtttgttgcgtaaagcgggcgaataggtcggcaacggcttcgggaaattctttattgctgattttggtacggaagttgagcagcagttcgcggacatcttcataacattcctgcacgcctgttttgataaagctgatgttttctgcggcttcctcccgtttgttttcggcaaaggcggtttccagcatctgtacctgtaggtttaggaacgttaatgcttgtgcgatgctgtcatgtaatccttgcgcaatcaggttgcgttcctgcaatactgcaagcaggcgtttttcttcctcctgttttgcgccggcaagcgatacgcccaattgcctgcctagtgtttgaagcaggatgcggtcgtcttcatcaagagaaatgccgtttggaaagctgagcaacagcctgcccaatgtttcgttctggtactcaatggggaagatttcctcatggtacttccccaaatccgaagctgctgtgccgcaatccgcatgatgaatggaaacataaacatcggatccgccgtccaaacaaactctgccggaatctgctcctacggcgggcaggatacggtttagaaaatgttctgcagcctgttgcggtatgtaggattggtgcaggtcccgtgtagtttggtacagcagggtcaggttttgattttgtttttcgagactgcgtgtctgctcggcgacttgtccttccaaatcatcatataaaattttcaacctgccgcccatttgattgaaacaacgcccgacctgtttgaattccggcgtaccgccttcgggaaccggaatatcgaaacacctccgtccgatgcgttccgcaccttcccttaacgcctgcagcggccggataacccaaatctggtgccaaaacagcatcagtacagacgacaccagcgtcatcaacataattgcccattgaaaacgcctgagccaccatgtgtttttttcgttggcattttccaatgcctgcaaaaacagttcgatgtttccggcaaagcggtagagatcgacctgagtcggtcgccggtaggactggagcggggggaggatgtgtgcctgccaatctataatcagcatggattgtatcaaatcataagcaagaggggtgtccgaaggaatcagcggatggatggcatcgctttgggcaatgcgttttaaacttttttcaaattcggcaacctgattgtcaatttgcgcacggggcgagccttcacccgccatgtatgccagacggtatgcctgcattctcaagttgcccgcctcttcgatgacggaggccgcgttttccagacgcaaagagagcagcagtgtcaaaacgacagacaatgccgccaacccgacccacagtccggtcaggagtttcaggcgcagggaaaggctgatgccgtctgaaaaacgggctggcagtatcatgctcggcgaaaaattgttccaaataatgcaaacaatatcattctttggaattagatacaactgctcagaaagaattggttaaggaaaacttaatccgcaccgcttcagtgttaaatcatgttatgataaaattcagataatatgaatttatttgccgtctgcttcagacggcattttgagtcattgggaacggcagactgcaatcatgaaaacctcgaacttttccaagagaacatccgcaatgaaaacttttgccctgatactggccggcggtcaggcgagccgtatgggaggcgaggacaaagggcttgctcttttgggggtaaggcactgatagaccatgtcatcgacagggtcaggccgcaggtcagccatatcgccatcagcaccaaccggaatttggaagaatatgctcgaagaagtccgcatatttttcccgatgcgcggcagtggcagcatttcggcccgctttcggcattgtgtaccgcagccaacgatttgcagttggcggctgctgactggcttttggttgtgccgtgcgatatgccgtatctgccggacgatttggtggcgaggtttgaaaccgtgtcgaaacgcacaccgttgtgcaatgcgtattatgtggaaacgccgataacgatgcactacaacattatgtatatccgcccgcagattctgcaaagcgcgattccctatctgttttcgggtatgaaaacattaagaagctggttgcagcagcaaagggcgcggccggtcagattcgagtttgacgggcattttgccgacttgaacacgcaaatcgatttgcaggagggataagggcaagaccgccgaccggcgtggaaaggaaaggtcaagccataccgggcggtttttgcccgaatcggaggcataatgctgtctgaaggcatttcagacggcatttttcgcggggagatgctacaatttgcaccatttttaccgacacagggaaacaggattatgtttacaggcattgttcaaggattgggaaaactgacggcaatccaccgcccgtcggaggcatttcacacttatgtcgtcgagcttccgcaagaggcggcggacaatctgcaacgcggcgcatcggtcgccaataacggctgctgcctgacgattaccgaaatcgaaggaaaccgcgtcagtttcgatttaatggcggaaactttggcaaaaaccaatttggggctgctgaaggaaggcgattgcgtcaacatcgaacgggcggcgcgtttcggagacgaaatcggcggacacgtcatgagcggacacattatggcaaccgtgcctattgtcgaaatcgaacgggacgggttcaaccgcacggtttggttttcgctcccgcatgaactcaaaccctatatcctgaccaaagggttcgtcggcttggacggttgcagcctgaccataggcaaagtcgaagacggccgtttcaatgtccatctgattcccgaaactttggaacggacgctgttcggcagcagaaaggtcggcgacaggatcaacatcgaaatcgatccgaatacgcaggcaatcgtcgataccgtcgaacggctgatggcgcaaagatatgcaaagtgaggcagagatggaattgaacgaatttctcgataaagcctatgccgttttgcggcgtttggatgccgtgcttccgcccgaacccgggcatacggattggaacgcgcttgccttccgctggcagagtgcgggcaaaaaaggttttttggaacacttgcccgatccgcacacctttcccttggtaaggctggcgggagtcggcaggcaaaccgaattgctggtgcgtaataccgaacagttcattgtcggcagacccgcgaacaatgtattgatgagcggcgcgcgcggaacaggcaaatcctcgctggtcaaagccctgctacacgaatatgcggataagggattgcgcctgatcgaagtcgataaaagcgatttaatcggcctgccttacctgttgacgcttttgaaggaatgtccggaaaaatttatcgtattttgcgacgatttgtcgtttgaaagcggcgatgaaacctataaggcattgaaaaccgcgttagacggcggtctgtctcaacgttgcgccaacgttttggtttacgcgacttccaacagacggcacctgatgcccgaatattttgacgagaatgccggtacgacggggatgcggggggaaatccatcagaaagaagcggtggaagaaaaaatatccctgtccgaccgattcggattgtggctcagtttttatccgttcgatcaaaacgattatctggcggcggtgcaaaattggctggaagatttcggcgtgccgtatgatgaaaccgcacagatggcggcattgcagtgggcgcagacgcggggcagccgttcgggacgttccgcgtggcagtttgcctgcgactgggcgggcaggctgccgaaacaacgggcgttgtgagcgtttcggggattatttgaggcaggaagaaagccacatttgctgctgttgcggtgtgaggatatggaagaaccggtgttggatttccaattcgtccaccgcaaaatccataccggacaaatagcggctttcgacataatcgcgcgcctcgttccgattaaaaacatccgaggaaatgatttcgacgacagaccggcggcggctgtgttcggaatgcataaccttcaaacgcgccctgtcgcccgccattttgaaggcggtgcggattttacgcagctcattgtgctgactttgggtcagcccgagtcggcgtatgtcgcagttcggttgaaaatcgttcggggggatataagccgtggcggcgtgggaaagctgacaggaaagcaaagccatacttaaaaaagaggcggcaggtttggcaaaacggcagggagcaggcagtggcacggcttttcctcttgttggaaattttaggaaatatactagattgacgtgtgaaagatggtattatcgcggttaacttttgttaataatgcgtacgtatgtccggcaggcagacataacggcggaatcggaacgtatagtggattaacaaaaaccagtacagcgttgcctcgccttagctcaaagagaacgattctctaaggtgctgaagcaccaagtgaatcggttccgtactatctgtactgtctgcggcttcgtcgccttgtcctgatttttgttaatccactataaaaggatattgaaggaaaaaacatgactacttaccgtatcgcacccagcattttatcggcagactttgcccgcctcggagaagaggtggaaagcgtcattgcggcaggtgcagatctgatccattttgacgtgatggacaaccattatgtgccgaacctgaccttcggccctatggtttgcgcggcgttgaagccttatgcaagcgtgccgattgatgtgcatctgatggtcgaacccgttgacgacctgattcagtcgtttgccaaagcaggagcatcaatcatcacgttccatcccgaggcgagccgccatatcgaccgcagcttgagcctgattcgtgatatgggctgtcaggcggggctggtgttgaatccggcaacgcccgtatatctgttggaaaacgtattggacaggctggatatggttttgctgatgtcggtcaaccccggattcggcggacaaagcttcatcccgcacacccttgaaaaaatccgccgggtgcgggcgatgctggatcggtacgaagcacaaagcgggcggcacatcgccatcgaagtggacggcggcatcaaaaccgacaatattgccgccgttgcccgagctggtgcggatacctttgttgccggttctgcgattttcggcaaaccagactataaggcggtgattgatgcgatgagggcggaactggaaaaaagcggcaggctgaaccttgcgccaatgattgaaatagaaatgccgtctgaaaattagctctgtttcagacggcattgcgttatttttcgacgggcagcccgaaatgcaggtaggcgcgttcggtcgccatcctgccgcgcggggtgcgttgcaggaagccttgttggataaggtagggttcgataacgtcttcgatggtgtctgtagattcgccgatggcggcggcaacattgtccaaaccgaccgggccgccgccgaatttgtgcaaaacggcttcgagaaatttcctgtccatcacgtccagcccctgcgcgtccacgtccagcatacttaaagcggcatcggcgatgccgccgtcgattgtgccgttgtttttcacgtcggcgaaatcgcgcacgcgtcgcaacaggcggttggcgatgcgcggcgtaccgcggctgcgtttggcgatttcttccgcgccttcttcggacatatcgagctgcaacagttgtgccgaacggctgacgatggtggtaaggtctcggttttcgtaaaactcaaggcgggagacgatgccgaagcggtcgcgcaacggattggtcagcataccggcgcgggtggtcgcgccgatgagcgtgaagggcggcaggtcgattttgacggaacgggcggcgggtccttcgcctatcataatgtcgagccggtagtcttcgagcgcgggatagaggatttcttcgacaacagggctgaggcggtggatttcgtcgatgaacaatacatcgtgcggatcaaggttggtcaaaagggcggcgaggtcgcctgcgcgttcgaggacggggccgctggtttggcgcaaatttacgcccaattctttggcgatgatgtgcgccagtgtggttttgcccagtccgggcgggccgaagagcaaaacgtggtcgagtgcttcgccgcgttttttggcggcttggatgaaaatggcaagctgttctttggctttgtcttgcccgatgtagtcgtccagcgttttggggcggagggcgcgttcgagcagttcttcctgtgcggaggcggtttgggcggcaacgatgcgttgcggttgcgcggcggtcaggttgtcggtttgcagcatagtgttccctttgtcgggtatgccgtccgaacggtcggcggcgtttcagacggcattgaaaagataacggtcaaaagcgttttatccgcgggtttcgcgccaaacgagatagtcgcgcaggggcggcataggcgggttgatgcagtgggggcagatgccggtggtgtcttcgtcgtcgctgtcgatgtggtaggcgttggggtcgaagcggatttgctgcatgacggcttgcgccaatgcctgcgcctgaacaacgtcgaaattgaatttttcgaggatttcgttcaacaggcggatttcgccaccgctaaattccgcactgtgtttgaggatgaggcgttgataatcttcgttgttgattttaggcaataaatcggttttcagggtcatgattttatgtcgggggcggaatggctgaagcgtgaattatagcggatatggcggcggctgttgcaaagcttggattgggtatcgtcctcaaaactttatagtggattaacaaaaaccagtacagcgttgcctcgccttgccgtactatctgtactgtctgcggcttcgtcgccttgtcctgatttttgttaatccactataaaagtggctgcattggacgttttaatgtttttctgttttgtcttgcgccgctcgaaacgctttttgcaatggggcgatttgtgccagccgcgcccggtcgatttgttcggcgataaggtgcgcttttccctgtgcgcggcattcggcggcgattttgcccgaatccgcctgattggcggcttcgagtaaggcgagccagtgcgcgcgttgcgggtagggcgtgtgttcgcggttcagacggccttgcgtgtcggcaatgcagacgttcaatgccgtctgaaagcgttcgggtcgtctgaaagcgtcggtttttttcaaaacgttcagaatggtttggcttttaagctgtccgacttggtggaaaataatgtgccaacggcaaaccaattcggcaagctcggcgcaatgtttcggcgcacgcagccgctgattgacttcgcgcacgggttcgacaccggcgaggtcgtgtccgtggtggcgcggcaggatgtcggacggtgttttggctttgcccaagtcgtgcagcagggcggcatagcgttcgggcaggctcaagcccatatcggcggcgcgttgcagcgtcatcagggtatggatgccgctgtcgatttcgggatggtagtcggcgcgttgcggcacgccgaagagggcattgacttcgggcagcaagactttgagcgcgccgcattcgcgcaacacttcaatcattttgcgcggatttttttccatcaaacctttcgcaaactcctgccagacgcgttcggcaaccaatgcgtccgcttcgccgttttccaccatctgccgcatcagctttatggtttcttcggcgatttcaaacttgtaacgcgcggcaaagcgggcagtacgcaggatgcggacggggtcttcggcaaaggctggggaaacgtggcgcaaaatgcctgccgccaaatcccgttgtccgccgaaagggtcgataatcttgccgtccgcatcttgcgccatcgcgttgatggtcaggtcgcggcgcatcaaatcctgctccagcgtaacgtctttgtcggcgtggaaactgaaaccgacgtaacctttggcggttttgcgctcggtgcgggcgagggcgtattcttcgtgtgtttcgggatggagaaacacgggaaaatctttgccgaccggctggaagccttgcgccagcatggtttgtgcgtctgcgccgacgaccacccaatcgcggtctttgacgggcaagcccaaaagataatcgcggacggcaccgccgacgagataagtctgcatatgcttcctattttaaagttatcaacaatgccgtctgaagcggcttcagacggcattgttccaaccggcggttatgctacgccttttttctccaagtaactttcgtaatcgcccaagtagtgttcatatccgcctttgccgtccagttcgatgatttgggttgccaaggaggaaacgaactgacggtcgtgggagacaaaaatcagcgtgccgttgtatttttccagtgccatgttcaaggattcgatgctttccatgtccatatggttggtcggttcgtccatgactaagacattgggtttcaacagcaacagtttgccgtaaagcatacggcctttttcaccaccggagagaaccttcacttttttcacgacatcgttactgccgaagagcaaacgccccaaagtgccgcggatgacttgttcgtcgtcgccttcctgcccccattggcgcatccattcgctcaggtccatatcgacgtcgaagtcgttttcatggtcttgcggatagtagccgacactggctttttccgcccatttgatggtgccttcgtccggcaacaggccgtctgaatattcggggttgtacgcgccggccaagagtttcagcagggtggatttgcccgcgccgttcgggccgatgatggcgaggcgttgtcccgcttcaaggatgaagttcaggtttttaaacaactgggtttcaaagcgtttcgccagtttttcaacttccacagcctgacggtgcagcttggctttttcatcggcttcaaaacggatatacgggttttgacgggtggaaggtttgacttcgaccatctccgatttgattttgtcggcctgtttcagacggctggttgcctgacgggctttggatttgttggcagagaagcgggcgacgaactcttgcagctcttgcagtttctctttggctttggcattgtctttcagggcgcgttcgcgcgattgggcggaggcgagcatgtagtcgtcgtagttgcccggatagatggtgatggtgttgtagtccaaatccgccatatgcgtgcagacttcgttcaaaaagtggcggtcgtggctgatgataatcatcgtggagtcgtattggttcaacacgccttccaaccagcggatggtattaatgtccaagttattggtcggttcgtccaagagcaatacatccggcttggagaacagcgcctgcgccagcaatacgcgcagtttgaagcccggggcgacttccgccattttcgcattgtgcaaatcttcggaaatgcccacgccgctcaacagttcggcggcacgcgcttcggcggtgtagccgtcgtattcggcgaacttggcttccagttcggcggctttcatgtagtcgtcttcggtggcttcgggattggcgtaaatcgcatcacgttcggtcatcgccgcccacatttcggtatgccccatcatcaccacgtccagcacgcgcatgtcttcgtaggcaaactggtcttggcgcaatttacccaaacgcacgccgttttcaatcgccacttcgccggccgtctgttccaaatcgccgccgaggattttcatgaaggtggatttgcctgagccgttggcgccgatcaagccgtaacggttgccttcgccgaatttgacggatacgttttcaaacagcggctttgcgccgaactgcatggtgatgccgttggtagaaatcatgattggtaaagcctttattgaacaagagattaaatttttcgaattttcggattgtaacataaccgccccgccgtctgaaacagacgggcaaattttcagacacttatagtaaaatatccgttttattatttcagacaaaaggtttccaaatgatagtccttcacggcatcccaaattgcgatacggtcaaaaaagccaaaaaccggcttgccggatacggcttggagtttgaatttcgggattttaaaaaacagaggccgtctgaagcggaaatctgctcgtggctggaacaagtgcctttggcaaccctgctcaacaaacgcgggacaagctggcgcaaactcgatgccgaaacacagcaaaaagtgctgtcctcgacggcggaggccgtcaaactgatgtccgaaatgccgagcctgatcaagcgtcccgtattggagtgcggcggcaaggtttacgccggcttcagcgaagaaacctacgacggcatcttcaaccggcaagccccgtgcagacagggataaaaaccgttacaatacccgacttgaatttcccgttcccattctatatcccgatttaaaatatgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctgcaacgcgcctacctgaaacagggcgcgaagctgatgggcatttcggtttcttccgaacaaatcaagcaaattatcgtggacgatcccaatttccacgacgcaaacggcaaattcgaccacgcgcttttaaaccgctacctttcccaacgccatatgtctgaagaccagtttgtcgaagaaatccgcgatcagtttgccttgcagaatttggtaaacctcgtccaaaacggcgtattggtcggcgacgcgcaggcggaacagctgatcaggctgacacaggtcaaccgcaccatccgttcgcacactttcaaccccgacgagttcatcgcccaagtcaaagtgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcatttgaagagcgcgtggcgcgtttgccggcaaatgaagccaaaccttctttcgagcaggaaaaagccgccgtcgaaaacgaattgaaaatgaaaaaggcggttgccgacttcaacaaggcaaaagaaaaattgggcgacgatgcgttcaaccatccttcctcgcttgccgaagccgccaaaaacagcggtttgaaagtcgaaacccaagaaacttggctgagtaggcaggacgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaacttgccgaaaacaaggcaaaagacgtgcttacccaactgaacggcggcaaggctgttgacgtgaaatggtcggaagtgtccgttttgggcgcacagcaggcaaggcagtccatgccgcccgaggcttatgcggaactgctgaaagcaaaaccggcaaacggcaaacccgcctacgtcaggctgatcggtctgccggcacccgtgattgtcgaagtacaggctgtaaccccgccggatgatatcgccgcacagcttccgcttgcaaaacaggctttggcgcaacagcagtctgccaatactttcgacttgttgatacgttatttcaacggcaaaatcaaacagaccaaaggagcgcaatcggtcgacaacggcgacggtcagtaattgacacttttgttgacaaaataacggtcggaatattccggccgttttcccatacggcggaatatgatgagccacaaaaaacaagatgccttccaaggattgatcgacgcgctgaaggttttacccaacgtcgggccgaaatcggcacagcggatagcgtatcatttgctccaacacaagcgcaaagaggctgaaaaactggtggatgccttgcagacggcattgaagcaggtttaccattgcgcgatgtgcaacacgttttgcgaaggcggattgtgcgatatttgtgccgatgaaacacgcgacgggcggcggctgatggtggtgcatatgcctgccgacgtgtcgaatatggaagcggcaaactgccacgacgggctgtatttcgtcctgatggggcaaatcaatacggcattgggaatggacgtatccgccatcgcattggacaggctggcgcaacggctgggcggcggggaagtcgaagaaatcattattgcaaccgcttttaccgcagaaggcaatgcgacggcgtatgtcctgtccgagttttttaaaaacctgccttacaaagtcagcaggctgtcgcagggcattcccttgggcggcgaattggaatatgtcgatgcgggaacgctggcgcaggcggtgtacgaacgccgcctgattaaagaaggcggggcataacgccgccaatgcaaaatgccgtctgaagccttcagacggcatttttccgggcggtttacttgcagtttagcccttgaatctgcaatgcgcctccgttgccgactttgaacacgcactgcgtcgcgctgctgccggacacggtaatgctgccgctgccgccgttcaggctgataggttccttaacacccataccgactgccgttgccgccagcttttgcgcgtcggcttcggaataaggcgtgttgttggcatcgattttgatttctttggcgtaggcagccgcagcggcggataaggcgatggcgcacaaagcaaaagcagttcggatattcattgttttcctcaagaaacggtttttctgaaggaaaggatagggcagtttgacgcgttgtgcaagttttccgcccgctctgccgccccgtcccccgcactcgggcgttcggacgctgcctgggttttacggtacaataaacttttgccgccgcccccaaaccgccgtccggggcggcacgtttgcagacatttttaaggtagcgttatgttttctctagaggcttggataggcttgaggtatctcagggcgaaaaagcgcaacggctttatgtcgtttatcacgatggtttcgattgccggaatcgccttgggcgtaaccgcgctgattgtcgtcttgtcggttatgaacggctttcagaaagaaatacgcgggcagctcctgaatgtcgcgccgcacgccgaaatcggctatatcgataatacggatacggattggcgcaacctgcttcggtttaccgaaaaccgcaaaggtattttggctgccgcgccctatgtttccaatcaggcattgctggccaatgcgggcgaaatcaggggcgtgcagatgcgcggcattttgccgtctgaagaacgcaaagtggtggaatacggcgacaaaatgccggcaggcaaatttgaagatctgattccgggcgagtttgacattatcctcggtgtcggcttggcggaggctttgggggcggaagtcggcaataaagttaccgtcatcacgccggagggcaatgttacgcccgccggagtcgtaccgaggttgaaacagtttaccgtggtcggtctggttaagacgggcgtttacgaagtggacaactcattggcaatgacgcatatccaagacgcgcgcgtgctgtaccgtttggataaggaagttgcggggctgcggctgaagctcgccgatccgcaaaacgctcccgccttgacggcaacactgattccggaggcgcaaagggacgcggtttgggtgcgcgattggacgtacagcaaccgcagctattttgaagcggtcgaactggaaaaacggatgatgttcatcatcctgacgctgattatcgctgtggcggcgttcaaccttgtctcttccctggtgatggcggttacggaaaagcaggcggacattgcgattttgcggactttgggtctttcccctgctggcgtgatgaagatttttatggtgcagggcgcgttttcaggctttttcggcacgctggcgggtgtggtctgcggcgtgcttttgggttggaacgtcggcagggtcgtggcgttttttgaaaacctgctcggtgtccacctcatcaattcgcaggtttattttatcgactacctgcccagcgatgtcgatatgggcgacgttgccctgattgcctgcatttctttgggactgtctttcgttgccacgctctacccgagccggcgcgcgtcaaaaacccaaccggcggaggctttgcgttatgagtgagttgattttgaaatgcgaaggcgtgggcaaacgctatcgggacggcggtttggacgttcgggtgctgcacggcttggatttggaaatccacgcaggggaaagcaccggcatcatcggttcttcgggcagcggcaaatcgacgctgctgcatattttgggcgggctggatatgccgtctgaaggcagggtgctgctgatgggcgaggatttgcgtaccttaaaccagcggcgtttgggcgatttacgtaaccgccatctcggtttcgtgtaccagttccaccatcttctgcctgaattttcggcactggaaaatgtgatgatgccgcttctgatcggcaaaaaaagccgtgaagaggctgcggaggcggcaatggcgatgctggaaaaggtcggactgaaacaccgttcgacgcaccgcgcgggcgaactttcaggcggtgagcggcagcgtgccgccattgcacgcgccttggttacccaacccaaatgcctgcttgccgacgaaccgaccggcaatctcgatcgtgcgaacgccaggaatgttttggatatgatgctggaactgaaaacagaattgggaacggggctggtggtcgtaacgcacgacgacgaactcgccggccgcttcgagcgcgtgatggtcatgaaagacggcagcctgcaccccaaacagggcgcaaacgcctaaacagccgaaacaacaccgcgccgtctgaagccccacgccttcagacggcatttggataaggaataaaatggaacggcagacagatgaatttgcccaagcggcggcaagggcggcaatccgttttttggaacactatgcgggttccggcgacgaagtgcttgcaaactgcaccgaacgcctgtttcaggcattgcaaaacggtcattcgtttatccgtttgagcggtggcgaggctgacgcgctgtcggcactcgcacccgttgtcggaacatccgccgcgcctttgattttggaaggcagaaggctgtttttgggcaggatgtggcagttggaatacgatttggctgccgagataaaacgcttggcggcagccggcacatccgcccccgacgcggcaggcgcgaggcaaaacctcgcaaaatggtttcaaggcacgggcagcgaagggcagcgcgatgccgccgccttggcactgttgcagtcttttatggtgattaccggcgggccgggaacgggcaaaacgacaacggttgccaaactgctggcgctgatttgcggtgaagacgaaaatcttcccaacatcgcgcttgccgcaccgacgggcaaagcggcggcacatatggcgcgcgcgctgcaccgtgcaatcaacggttttgacgcgccggaggccgtccgccgccatttgctcaaactggaagggcaaaccgtccaccgactgctgaagctgcgcccgcccaaaatgcaggcggcgttcaaccctgtttacccgctgccgtttgacgtattggttatcgatgaagcctctatgctggatacggcattgatgctgcaacttttaaaagcggtcaaaaccggcgcgcgcgtgattctgctgggggatgaaaaccagctcccgtccgtcggaataggggcggtgctgtccgttttgtcacaaaaaaccgttttggacggagaaacgcaccaaaggctggccggcttccttccggaacacggtttcagcgtcagcgcaaatccacccgtgttggcgcaaaacaccgcccatctgtcgttcagccaccgcttcggcgacaacagcggcatcggctgccttgcccgtgccgccgtatcgggcgatgaaggggcgtgggcattgtttgaccggtttccggacgaactggaacattcggaatgcagtccgaacgctcgagtcgaaaggttgtaccgggcacacaaagcctattggcaggcggtaaaagacggcaatatcgaagccgcatacgcgggcatttcggatatcgtggttctcctccttgcatcgggatgccgattttaccgcgttcaacccaaagcggaaaacacaccatcagaaacggggcggcgatattgaccaccacgccgaagctggacgctaccggcacgacttccaagacgcccgcagtctgaatcacgggcaatgtaaaa

SEQ ID NO: 76 - DNA, 13574 bp, Neisseria meningitidis
ggcaggcattttggcgtacaccgtcatccaaatctactatatgagccgggacgggcagtcattgggtaagaaaatcatgagaatccgtgtgttgaaaaccgacggccgcaatcccggttttgtcggcacggttttggtacgcgaaatcgcatggtcggttttggttgccattattgccgccgttatcggtcttgcagtawgtgacaacggagaaaacgccatcaacctgctggcattccttgccaactttgtcctgctctttatggtcaaacgcgaccgccgcacgctttacgacatactggcggatacggttgtcgtcaagctgcccaaataaacggacacggcaaaatgccgtctgaaagcctttcagacggcatttttatcttcagaaccgctcaagcatcgtgcagtgaagccgcgtgcagggtgttttccatcaatgtggcaatcgtcatcggacccacgccgccgggaacgggcgtaatcatcgccgcccgttcttttgccgtttcaaattccacgtcgccgcacaggctgccatcgtccaaaggttgatgcccacatcaataacgaccgcgccaggtttgatccattcgcctttgacaaagttcggaatgcctacgccgaccaccaaaatatcggctccggcaacctcgtctgtcagattttcggttgcgctgtggcagaccgttaccgttgcgcgcgccagcagcagttccaaagcctgcgggcggccgacgatattcgacgcgccgaccacgaccgcttttttccccttcggatcaatgccgtaagcttccaaaagcgtcatcacgcccttgggcgtacacgggcgcatcagcggcattttgaccgccagcctgccgacattgtaaggatggaagccgtccacgtccttatccggcgaaatacgttccaaaaccgcctggctgtcgaggtgcttcggcagcggtagctgaaccagaataccgtccacttcggaatcggcattcaggcggtcgaccagtgccagcagttcttcctgcgatgttgattcgggcagctcgtaagacagtgatttgatgccgcatttttggcaggcagttttcttgttgcggacataaaccgcgctggcagggtcgcctccgaccaaaaccacggccaggcaagggtgtgcagattgttctgttggcgttgcgccaccgcttcggcaaccgcctgcaggcgtttttgcgaaacttctttaccattgatcagttgtgccgacatatccgtccttttgttaaacaggtagaaaatgctgaaaattatcgcattttccgtttgtttttacagcaggatgccgaaaataaatttgccctgaaataaaatacggctgtttggacggattaaatattttttcaaatcaaaaaactatatttttcatcttggtgtcttgaaaataaatgttgacgcatctttccctgagttgtatagttcgcttcttcaagtcggggcgtagcgcagcccggttagcgcatctgctttgggagcagagggtcgtgagttcgaatcccaccgccccgaccaatcaatcagcacgaatcggcatgagcgcccgtagctcaaccggatagagcaccgaccttctaagtcgggggttacaggttcgattcctgtcgggcgtgccaagaatttgattgaaaaccgtttttatggtggctgtagctcagttggtagagccccggattgtgattccggttgtcgtgggttcgagccccatcagccaccccagataaaggcccgtacttttcggtacgggtcttttcccgtttgcgcgtactgtccgcgccgccggctttgcctttcgcatatgcttctgtatcatgtgggtttttctgtcttttatggtttttgtcggaggctttgatggttgacgcttggtctgtccctgattttgaatcgaaaatctgtccgcccgaggcgttggcggcgcgtttggcgttgttgccgcgcccgctggtgtttaccaacggctgtttcgacatcctccacagggggcacgttacttatctggcgcaggcgcgttcgatgggggacgcgttggtgctggcgttgaataccgatgcttcggtgcggcgtctgggcaagggcggtgaccgcccggttaatcctttggagaaccgtgccgccgttgccgccgctttggaaagtgtggatttggtaacgtggtttgacggggatacgccggcggcgttgattgaggcggtcaaacctgagattttggtcaagggcggcgattgggctgcggataagattgtcggtgcggcagaaacgttggcgcgcggcggtcaggtgttttcaattccgtttctgcaccagacttcgacaacgaagactttggcaaaaatccgtgcggcagagggcggaaaatgacggttttgaagctttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgtcggcgcgccttgtcgcgtttaggtttggatgtgcagattaagtggcccaatgatttggttgtcggacgcgacaaattgggcggcattctgattgaaacggtcaggacgggcggcaaaacggttgccgtggtcggtatcggcatcaattttgtcctgcccaaggaagtagaaaatgccgcttccgtgcaatcgctgtttcagacggcatcgcggcggggcaatgccgatgccgccgtgctgctggaaacgctgttggtggaactggacgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttttgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacatatttaaggaatacagagatgaaatggctatttatccttttggttgcgattaatattgccgtattcggcggtacggtaggttacaaactgacactgaaacaggccggcagaataccggaggcacagaatgccgcaaacaatttgcaggttcaaccagttgccccaactatgccggttgttcggaatattccagcatccggtcctgtcgttcaggcggcatctgaatcggatacaggcgcactgctcaaacagggcgacattctgagcgaagaacaggcggagcagttgcgcttgaaaaaagaagcggaacagaaaaaactgaaagagaaaaaacagcgtgaagaaaaagcccgccgcgaaaaactcgccgccgaaaaggcgcaggcggaacgcgaaaacggcgcggcggatgccttatgcgccgcgcaggcaagcctcacgatggacgaagatgactaccaccgcatcaaaggacttttgggcaaatggtcgcacgttgccagcaggagcgtcgaaaaacgcaccgcccaagccaaacctgccgacaaaacctaccgcgtcgtcctgcccgtttccgccgatgccgaaaatcaggcggcggagctgtctgccaaaggtttcaaccccataccgtttgacggcgcattgagtttgggtgtcggcaacagccgggaaaacgcccaagccctgcaaaaccggcttgccggcgccggattcggcggggcgcatattgtcgaacactttgccgaagccgacaggcaggacgattctttgagcgtgtcgcgtatgacggttttgtttaccggcgtgaatgccgccgatgcggacgaaattcgtaaaatcacgtccctatacggcaaactgaacctcaagtcttgcaaataggcgcgaaagccggacgataaacgccaaacccaccgcgaaggtgggtttggcgtttcggttttgagtatctgatatataaaaagggaatgtatgtctcgtatatgccgactccaagtgtgaaagtgatgatggggaaatatggtgtttaatggttcggaacggacggcttccgagtggttttgattatacgctaataataataattatcaataaaaatttaaaaataaatgcagattttttgtaatacgatgaaaaataaacaaattaacctgtccgccgatgtttgtgattcgggtcggcaaactttcattgtgtcggacaaatcggggtcggcaggcatagctgagggcttcgtgcctgacggaaataaggttgcccgtgtttgaacatccgtccgatttggcgcggacagggttgtcattcgggggtgtttgagcgtggattcggggatgcgaaagcggtaaaaccgttgcggatgaaggcttacggacggctttaggtatttttaagtgtattcaaacaacaacaaaacgcttcttctattgccgtatttagggcttgcgcggcagcctgcacaccgtggaggccgagtgtttcgttggttgcggcatcgggacgggcggcaaggttttccggccggtttttccattttttccgacaaagccgtgatgccggggaatggcggtttgtccgtttcaggccgccgccgttttggaccgcgatgccgtctgaagccttcagacggcatttttgctgcctttttcaatattccgccgaatgccaaaacggttgtccgactgtcggcgtgctggcttgcgctttgtcgcgtgcttcgaccggtccggcttcaaatgccagccgtccggattcgacggcgagtgcgaaggcgcgtgccatattgaccggatcgccgctgcgggaaacggcagtattcaaaagcacgccgtcaaagccccattccatcacttgtgccgcctgtgagggcaaacccaagcccgcgtcgataatcagcggcgtgtcgggcaggcgttcgcgcaggacgttcaacgcgtaggcgtgaaccgcgcccaaacccgtgccgatcggggccgcccacggcatcaacgcctgacagcccgcgtcgagcaggcggcggcaggcaatcaggtcttcggtgcaataaggcagcactttgaagccgtctttaatcaggatttccgccgcttcgacaagctggaacacatccggctgcaaggtgtcgtcatctccgatgagttccaattttatccaatcggtttcaaacacttcgcgcgccatttgcgccgtcgttaccgcttcctgcacgctttggcagcctgccgtgttcggcaggacgggaacgccggtttcttgaagcagcgaccaaaacccctgaccgtgcgcctcgccgccgcttcccgcgcggcgcagcgagacggtaatcatcgcaggctgggcggtttggatggattgtttgaggatttcgggggtcgggtaggcagccgtgccgagcagcagccgcgaggggaaagtttcgccgtatagggtgagcataatgggttcctttgtatagtggattaacaaaaaccagtacggcgttgcctcgccttagctcaaagaaaacgattctctaaggtgctgaagcactaagtgaatcggttccgtactatccgtactgtctgcggcttcgtcgccttgtcctgatttaaagttaatccaccataacgttgttttggggacaggggtcgtctgaaaaggcaaaaccgcctagccgccgaccaccggccgcacgatatcgattttgtcgttttcgtttaaaaccgtttccgcatacgcgcctttggggacgaaaacggtgttgaccgccacggcaaagggcttttgcggcgcggtttgggcgatgaggtcggcaacggtcgtgccgtgaagttcggcgggtccgccgtttaagatgatgttcatggtttctcgatgtttctgtatttatagtggattaacaaaaaccagtacggtgttgcctcgccttagctcaaagagaacgattctctaaggtgctgaagcaccaagtgaatcggttccgtactatttgtactgtctgcggcttcgtcgccttgtcctgatttttgttaatccactatatctagccgaattactttattttttgatacgcaactgaccggttgccgtcattcccgcacgggcgggaatccatttttgaaattcggaaactgtttttcaaatgatggtttctcaagttttaaggcggattcccgcttacgcgggaatgacggaatttgatgatatgccacatttaaagttaagtatgtttgcgataacgggctaagttttgcctacacggcaattgaattttcttctttcggttttatccatcccacaaagcctgaaacgctttaaccaccgcttcgggatttgccgcttcggttacggcgcggacggcggcgagtgaggaaacgccggtggcgagtacggctcgggcgttgttcaagtcgataccgccgatggcgacgacgggcgtgccgcctgcttgtttgacgtattcgcgcagtttgtccaagccttgcggggcggtgggcatttgtttggtcgtggtcgggaaaatcgcgccgctggcgatgtagctagggtgtacggacagggcgcggtcgagttcggcaacggagtgcgtactcaaacccaagcgcaaaccggcggcggcgatggcggcaaggtcggcggtgtccatgtcttcttgtccgagatgcacgccgtacgcgcccgcttcgattgcttcgcgccagtggtcgttgatgaaaagctgcgtacggctgccctgacaggctgcggcgcagcgggcgatttcgcgtttcaattcatcgccgtgcagggccttgcagcgcagttgcaccgtgtcggcacctgctttgaccatgcgccccacccaatcggcggtggggacgacggcgtagaatttgagcggggattttaggggcgggaaggtcataaggtgtcctttcgggcggctttaatcttgtcttcggatatacgccaaaccgctttctttatcgcgttcgggcgcgtcttttccgtcaaacagtgccactgccaatctggcggcggcggcggttacggcgggggagatcatgaaaccgtggcggaaaaggccgttgatttcaatcaggcgtcgggcgcggttgtaacggatttcggggttgtggtggttgagcgtggggcgcaggccggtggcgatttcgaggatgtcggcttcgccgaaggcggggtggatggcatagagtgcggacaagagttccaaccctgaacgcacgctggcgggggcttggctttcgctttcgatttgggtcgcgccgatgacgaagacgtggttttctttcggggcgatgtagagcggataacgcggatggagcagacgcacggggcggttgagcgtgatttcgggtgtgtaaacccgcgccacttcgccgcgtatgccgcgcagggtgctggtgtgctcgggggattggttccacgcggtttttgcgccgtagccgcggcagtcgatcagccagtcgtattgggcttgcaggccttcggggacgcattcgtgttcccaatggcaggggacgttcagttcgtccaaagcgtcggcaagtgcagacaatatttgccgcccgtcgagctggccttcggtcggcaggtagatgccgtctgaaaaacgtccgccgagttgcggttcgcgttcggcgatgtcgtcggcgcgccaacggacgatttcgtcatccgctacgccgccgcgtttgagatggcggacgaactcgctggataatggcttgtcctgcccgtgccacacaatcaggctgccgttttcctgcatcatcgtgtgcgtgttcagacggcatcggatgccgcgccaaagcgggatgctctgcctgcccagcctgaccacttcgggcgtggcttcgaccgcttccgccgcaggcgcgagcatggcggcggcaacataggcggcggcgtgttcgccccggcggcagcctttatcgaaaagtgcaatctgataaccttgttctgcaagctgcaacgcggtcagccttcccgagaggccgccgccgaggatggcgatacgggtcatgacgggttcctttgtaaagattgggtttttttaaagaaaaggcgtaccgatacggtggcaatggcaacggcagacattacgggggcggtcagaccgatgctgctttcccagccggacgagagcaggaagcggtagaggatgaagcccgcaagccacagaaccagtccggcaaagtcaaagccttcaatctcctcacgccgtttcaagacgaaaaagtcggcaatcaaaaccgccgccatcggcgcaaataccgagccgataagcagcaggaagttttcatattcggtaacgggcagcatgacggcaagtaccgtgccgatcagggtaacgccgacagcgacgggtgtttccgcaaaacgcgcggaaatgttgttcgcactcgcgccggcggaataggcatcgagaaacgttgtggtaacggtggagaggacgaccgccaaaatgcctgccgcacccaaacctgcgcccagcaggatttttgccacgtcggtttctccggtgaacaacgccgctgccaaacccaaggcatacatccagcagccggtcagcgtgtaggcgagcgttgccgtcagggttgccgcaaacgggcggcgcgcgtggcgcgtgtagtcggcggcaagcggcagccaggaaagcggcatcacggcggacagctcgactgccgttccgaaactcatgccgtctgaaacctgtgcggcggtgctgcctgccgtggaaaagacttcggcactcagccacagaaccgccaacagcatcagcagcatcgaaacggttttcagcccgcctgttttgcgtgcgccgaaaaccagccacagcacaatcagcgcgccgtttgccaatgcccaccagacaaaagattcgccgtcccacaacactttgcccaaagcggagctgaccgttgcgccggcgtaaatcatcaccgccgtccagccggccagttgcagcatattcgccacggaaaacagcactgaaccgcgtttgccgaacgacaggcgcacgctttccatcgagctgcgtccggtcagtgcgccgatatacgccgccgcaaaaaacagcgcgccgccgacggcatgacccaaaagtagagccgccagaccgcgctgccagcccaaaggcgcaagcagcgtacccgtgctgatttcggcaatcgataccgccgcgccgaaccaaatcagcccgatggcggaggaagatgaaggagaggaggcattgcccgacatatcaagtccttaaaaaacatgaaaatggggcggggaagtgcggaaaagggaacggaagcctgataaggcatttgacggtttgtttcctacgcaggcattaccccgacaggttctacggattctgctttcgcaatctcagccgcccggcggcggcactccgacaaggagctttaagtgtacacaaaagcagggggcgttggcaaaaatcttacatttcaggcggcacggcgcatttctatagtggattaacaaaaatcaggacaaggcgacgaagccgcagacagtacaaatagtacggcaaggcgaggcaacaccgtactgttttttgttaatccactatataacaaatgccgtataatcaagcccctgattttttatgcgccgacactatgcatccgacctattccgccgtacaggcgcggctgctcgaagccaaccgcctttcccccgaactgctcgccaaaagcctgtgcatcatcggcgcgcaccacgtcgattacgccgacatctactgccagcgcaccgcttatgaaagctggcatttggaagagggcatcgtcaaatcgggcagcttccaaatcaatcagggcgtgggcgtgcgcgccgtttcgggcgacaaaaccgcctttgcctacgccgacagcctgtgcatcgattcgataaaccgttccgcccgcgccgtccgcgcgattggggcggcaggcggcaaggtgtccgccaaaatgccgtctgaaacgcgcggcaagccggtttgttccgcgtccgaccccattgccggcctcgattccgccgccaaagtcgcgctgttgaacaaagtggaagcaatcgccaaagccgccgatccgcgcatcgtgcaagtgatggccggtttgacctgcgaatacgatatggtttacctcgcccgtctggacggcaaacacgccgccgacatccgcccgatggtgcgcctgaacgttaccgttatcgccaaacagggcgaacgccgcgaacagggcagcgcgggcggcggcggacgctacgacttggcttatttcgatgaaaacttggttcatcggtttgtcgatgccgccgtcaaacaggcactcaccaacctcgaatcccgccccgcgcccgccggcgaaatgaccgtcgttttgggcaacggctggccgggcgtgttgctgcacgaagcggtcggacacggtttggaaggcgatttcaaccgcaagggaaccagcgtcttttccggcagaataggcgagcgcgtcgccgccaaaggcgttaccgtcgtcgatcagggtgatattgccggccggcgcggttcgctcaacatcgacgacgaaggcaacgaaacccgccgcaccgtattgattgaagacggcattttagtcggctatatgcaggacgaaaccaatgcccgcctgacgggtacgcagtccaccggcaacggccgccgcgaaagttacgcttccgcccctatgccgcgcatgaccaatacctttatggaaaacggcagctatgagccggaagaaatcatcgcgtccatcgacaagggcatttacgccgtcaactttggcggcggacaagtggacattaccagcggcaagttcgtgttcagtgcgtccgaagcgtggtgggtggaaggcggcaggctgcaatatcccgtcaaaggcgcgaccatcatcggcaacggccccgaagtgctgaaacacgtttccatgataggcaacgatactgcgctcgacagcggtgtcggcgtgtgcggcaaagaagggcagagcgtccccgtcggcgtggggcaaccgactttgcggattgatgccggactgaccgtcggcggcagcgcaatctgacgcggaatccggcacgatgccgtctgaaaggttttcaggcggccttttacattaggataaaaccatgcaggaacagaatcggaaaccaagttttcccatagtgatgttgctggtgtcggttgccctgtggatagcgtctttatccaatgttgcattttatttgggcaatcatggaagcatggagggtttgaccgttttgattttggggtcgatatttgcttctttggatatcaggtattgtgcggtctatgcgaattatgtttggttggcggccattgttttgctggcgttgcggaagaaggtcgtgcctgtccatgcggcactttggggcttggcgttggtggctttcagtgtgaaagccgtatacgtcgatgaagcagggaatacatcggatattgtgcgctacggtgcaggattttatttgtggtatgccgcatttgcggttgccaccatcggtacgtttgccggaaagaataaggaaagaaaagccgcatcagcggcagacgggataaaaatgacgtttgataaatggttgggcttgtcaaaactgcctaaaaatgaagcaagaatgctgctacaatatgtttcggaatatacgcgcgtgcagttgttgacgcggggcggggaagaaatgccggacgaagtccgacagcgggcggacaggctggcgcaacgccgtctgaacggcgagccggttgcctatattttaggtgtgcgcgaattttatggcagacgctttacagtcaatccgagcgtgctgattccgcgccccgaaaccgaacatttggtcgaagccgtattggcgcgcctgcccgaaaacgggcgcgtgtgggatttggggacgggcagcggcgcggttgccgtaaccgtcgcgctcgaacgccccgatgcgtttgtgcgcgcatccgacatcagcccgcccgcccttgaaacggcgcggaaaaatgcggcggatttgggcgcgcgggtcgaatttgcacacggttcgtggttcgacaccgatatgccgtctgaagggaaatgggacatcatcgtgtccaacccgccctatatcgaaaacggcgataaacatttgttgcaaggcgatttgcggtttgagccgcaaatcgcgctgaccgacttttcagacggcctaagctgcatccgcaccttggcgcaaggcgcgcccgaccgtttggcggaaggcggttttttattgctggaacacggtttcgatcagggcgcggcggtgcgcggcgtgttggcggagaatggtttttcaggagtggaaaccctgccggatttggcgggtttggacagggttacgctggggaagtatatgaagcatttgaaataattgtttgcaaaattggcgg

SEQ ID NO: 77 - DNA, 17782 bp, Neisseria meningitidis
gaatcaaaaattaacttggggagcggaaatggttccgcgtcttacccgtttttaggagttcgttaagtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagatcctgatttgactgctgctgacttggatgcggctgtccgtactatagcaggttctgctcgctcaatgggcttggatgtggagggtgttgtataatggctaaagtatctaaacgcttgaaagctcttcgctcttctgtggaagccaataaattatatgcaattgatgaagcaattgctttggtaaaaaaagcagcgactgctaaatttgacgagtctgttgacgtatctttcaacttgggcgttgatccgcgtaaatctgaccaagttatccgtggttcggtcgttctgcctaaaggcaccggtaagataacccgtgtggctgtatttactcaaggtgcaaatgcagaagctgctaaagaagctggtgcagatatcgtcggtttcgaagatttggctgctgaaatcaaagcaggcaatctgaactttgatgtcgttattgcttctcccgatgcaatgcgtattgttggtcagttgggtactattttgggtcctcgaggcttgatgccaaaccctaaagtaggtacggttactcctaacgttgctgaagcagttaagaatgcaaaagcaggtcaagtacaataccgtacagataaagcaggtatcgttcatgcaacgattggtcgtgcttctttcgctgaagctgatttgaaagagaactttgatgcgttgctggatgctatcgttaaagccaagcctgctgccgctaaaggtcagtatctgaaaaaagttgctgtgtctagcaccatgggtttgggtattcgcgttgatacatcaagcgtaaataactaatcttaaggaattttcaagcagtttggttttctgggctgcttgaatttgggctacttaaaattaagtagatgtccaagaccgtagggatcgtaagatttaatcgtaactgccctacgcagacggtagtcctgaaacacattgcaagattgcttgtaagatgtctttttaggttaccgcgctggtgggatatcgttttggtatcctgtttataaacagtgggaggtagaccttgagtctcaatattgaaaccaagaaagtggcggtcgaggaaattagcgcggcaattgctaatgctcaaaccctcgtagtcgctgaatatcgcggtatcagtgtttccagtatgactgagcttcgtgcgaatgcacgtaaagaaggcgtttatttgcgcgttctgaaaaatactttggctcgtcgtgcagtgcaaggtacttcatttgcagaattggccgatcaaatggttggtccgttggtttacgctgcttctgaagatgctgttgctgctgctaaagtgttgcaccaattcgcgaaaaaagatgacaaaattgtcgttaaagccggttcttacaatggcgaagtaatgaatgctgctcaggttgctgagttggcttctattccgagccgcgaagagctgttgtccaaactgttgttcgttatgcaagctcctgtatcgggctttgcgcgcggtttggctgctttggcagagaaaaaagccggcgaagaagccgcttaatcgattttgtttctgttaatcaattattttttaatacaatatttggagtaaaatagcatggctattactaaagaagacattttggaagcagttggttctttgaccgtaatggaattgaacgacttggttaaagcttttgaagaaaaattcggtgtttctgctgctgctgttgcagttgcaggtcctgctggtgccggtgctgccgatgctgaagaaaaaaccgaatttgatgtcgttttggcttctgccggcgatcaaaaagtcggcgtgattaaagttgtccgtgcaattaccggtttgggtctgaaagaagctaaagacatcgttgacggcgcacctaaaaccattaaagagggtgtttctaaagctgaagccgaagacatccaaaaacaactggaagaagcaggcgctaaagtcgaaatcaaataatttgatgcttcttatgaaggctggcagttttctgccagccttattttgcttcttaaaataaacatcaagtattgtttacatttatttgcatagtttttatcaagtcattgcaaataaatgtaaatatcagattgatgcgtaccgttgtttcagacggcctattattgaaaattacttttcggagtgtgtatgaactattcgtttaccgagaaaaaacgtatccgtaagagttttgcaaagcgggaaaatgttttggaagttcctttcttgctagcaacccaaattgattcttatgcgaagtttttgcagctggaaaatgcttttgacaaacgtaccgatgacggtctgcaggcggcatttaattctattttcccgattgtgagccataacggttatgcgcgattggagtttgtgcattacacattgggcgagcctttgttcgatattcccgaatgtcagttgcgcggaatcacttatgcagcccccttgcgcgcgcgtatccgtttggtgattttggataaggaagcatctaaaccgacggtaaaagaagttcgtgaaaacgaagtgtatatgggcgaaattccgttgatgaccccgagcggttcttttgtgattaacggcacagagcgtgtgattgtctcccagttgcaccgttcgcccggcgtattcttcgagcatgacaaaggtaagacgcactcttccggcaaattgttattctccgcccgcatcattccctaccgtggttcatggttggattttgaatttgatccgaaagatttgctgtatttccgtatcgaccgccgccgtaaaatgccggtaacgattttgttgaaggctttaggctacaacaatgagcaaatcttggatattttctacgacaaagaaacgttctatttgtcttcaaacggtgttcaaaccgatttggttgcagaccgtctgaaaggcgaaactgccaaggtcgatatcttggataaagaaggcaatgtattggttgccaaaggtaagcgcattactgcgaaaaatatccgtgatattaccaatgcaggcctgacccgtttggatgtagaaccggaaagcctgctgggcaaagcattggctgccgatctgattgattcggaaaccggcgaggtattggcttctgccaatgatgaaattacagaagagttgttggccaaatttgatatcaacggcgtaaaagaaattacgaccctttatatcaatgagctggatcagggtgcttatatctccaataccttgcgtacggatgagactgccggccggcaggcggctcgtgttgcgatttaccgtatgatgcgtccgggcgaaccgcccaccgaagaggcggtcgagcaattgtttaaccgcttgttcttcagtgaagacagctacgatctgtcccgcgtaggccgtatgaaatttaatacgcgcacatacgaacaaaaactgtccgaagcccaacaaaactcttggtacggccgcctgctgaacgaaacgtttgccggtgctgccgacaaaggcggttatgtcctgagcgtcgaagatattgtcgcctcgattgcgactttggtcgagttgcgtaacggccatggcgaagtggacgatatcgatcacttgggcaaccgccgagtacgttcggtaggcgagctgactgaaaaccaattccgtagcggtttggcccgtgtggaacgtgccgtaaaagaacgtttgaatcaggcggaatcagaaaacttgatgccgcacgatttgattaatgcaaaacctgtttctgccgctattaaagaattcttcggctccagccaattgagtcagtttatggatcagaccaaccccttgtctgaagtaacccataaacgccgtgtatctgcattgggtccgggcggtttgacccgcgaacgtgcaggatttgaggtgcgggacgtgcatccgacccactacggtcgcgtatgtccgattgaaacgcctgaaggtccgaacatcggtttgatcaactcattgtccgtttatgcgcgcaccaatgattacggtttcttggaaacgccttaccgccgcgttatcgacggcaaagtaaccgaggaaatcgattacttgtctgccatcgaagaaggccgctatgtgattgcacaggcgaatgccgattggattcagatggcaatctgattggcgatttggttacctgtcgtgaaaaaggcgaaaccattatggcaacgcccgaccgcgtccaatatatggacgtggcaactggtcaagtggtatccgttgcagcatccctgattccattcttggaacatgatgacgcgaaccgcgcattgatgggtgccaacatgcaacgtcaggcagtgccttgcttgcgtcctgaaaaaccgatggtcggtaccggtatcgagcgttccgttgccgttgactctgctactgcaatcgttgcccgccgaggcggcgtggtcgagtatgtcgatgccaaccgcgttgtgatccgtgtccatgacgacgaagcgactgccggtgaagtgggtgtcgatatttacaacttggttaaattcacccgttccaaccagtctaccaatatcaatcagcgtcctgccgtcaaagccggcgatgttttgcaacgcggcgatttggtggccgacggcgcgtccaccgattttggcgaattggctttgggtcaaaatatgaccatcgccttcatgccgtggaacggttacaactacgaagactcgattctgatttccgaaaaagtggctgcggacgaccgctatacttcgattcacattgaggaattgaatgtcgttgcccgcgatactaagctgggtgcggaagacattacccgcgatattccgaacttgtccgagcgtatgcaaaaccgtttggacgaatccggtatcgtttacatcggtgcggaagtagaagccggcgatgtgttggtaggcaaggtaacgcctaaaggcgaaacccaactgacgccggaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccattatcgattccgaattgaaacgctaccgtttggatttgaacgaccaattgcgtattttcgacaacgacgcattcgaccgtatcgagcgtatgattgtcggtcagaaagccaacggtggtccgatgaagctggccaaaggcagcgaaatcacgaccgaatatctggcgggtctgccgagcaggcacgattggttcgatatccgtctgaccgatgaagatttggccaagcagttggaactgattaaagtgagcctgcaacaaaaacgcgaagaagcggacgagttatacgaaatcaagaagaaaaaactgacccaaggcgacgaattgcaacccggcgtacaaaaaatggtgaaagtttttatcgccatcaaacgccgtctgcaagccggcgacaaaatggcgggccgccacggtaacaaaggcgtggtatcgcgcattctgccagtggaagacatgccttacatggcggacggccgtccggtagacatcgtactgaacccattgggcgtaccttcccgtatgaacatcggtcagattttggaagttcacttgggttgggcagcaaaaggtatcggcgagcgtatcgaccgtatgctgaaagagcaacgcaaagcaggcgagttgcgcgagttcttgaacagactctacaacggcagcggtaagaaagaagatttggatgccctgactgatgaagaaatcatcgaactggcctccaacctgcgcaaaggtgcatctttcgcctctcctgtattcgacggtgcgaaagagtctgaaatccgcgaaatgctgaacttggcttatccgagcgacgatcctgaggttgaaaaactgggcttcaacgacagtaaaacccaaatcacgctgtatgacggccgttcaggcgaagcatttgaccgcaaggttacagtaggtgtgatgcactatctgaaactgcaccacttggttgacgaaaaaatgcacgcgcgttctaccggtccgtacagtctggttacccagcagcctttgggcggtaaagcccagttcggcggccaacgtttcggcgagatggaggtttgggcattggaagcatacggcgcggcatacacgctgcaagagatgctgactgtgaagtctgacgacgtgaacggccgtaccaaaatgtacgaaaacatcgtcaaaggcgaacacaaaatcgatgccggtatgcccgagtccttcaacgtattggtcaaagagattcgctcactgggcttggatatcgatttggaacgttactaaacaaaagttttcagacggcctttcagggtcgtctgaaaaagtggtttcagaataagaatgaagcaatcggcatttaggccgtctgaaatcaaaagtaccgtttcccaatatcgaaaatccgccatgcggtaaaaatacttccttcaaggagcaaaaatgaatttgttgaacttatttaatccgttgcaaactgccggcatggaagaagagtttgatgccattaaaatcggtattgcctctcccgaaaccatccgctcatggtcttatggcgaagtcaaaaaacctgaaaccatcaactaccgtacgttcaaacctgagcgtgacggtttgttctgtgccaaaatctttggcccggtcaaagactacgaatgcttgtgcggaaaatacaaacgcttgaaatttaaaggcgtaacgtgtgaaaaatgcggcgtggaagtaaccctgtccaaagtgcgccgcgaacgcatgggtcatatcgaattggctgcgcccgtcgcacatatttggttcttaaaatccctgccttcccgcttgggtatggtgttagacatgactttgcgcgacatcgagcgcgtattgtactttgaagcatttgtggtaaccgatcccggtatgactccgctgcaacgccgccaattgctgactgaagacgattactacaacaagctggacgaatacggcgacgatttcgatgccaaaatgggtgcggaaggtatccgcgaattgctgcgtaccctgaatgtagcgggcgaaatcgaaatcctgcgccaagagttggaatcgaccggttccgacaccaaaatcaaaaaaatcgccaaacgcttgaaagtattggaagccttccatcgttccggtatgaaactggaatggatgattatggatgtgctgccggtattgccgcctgatttgcgtccgttggttccattggatggtggtcgttttgccacttccgatttgaacgatttgtaccgccgcgttattaaccgtaacaaccgtctgaaacgtctgttggaactgcatgcgcctgacatcatcgtccgcaacgaaaaacgtatgttgcaagaagcagttgactcgctgttggataacggccgtcgcggtaaagccatgaccggcgccaacaaacgcccgctgaaatcattggcagacatgattaaaggtaaaggcggtcgcttccgtcaaaacctgttgggcaaacgtgtggactactccggccgttccgtgattaccgtaggcccgtacctgcgtctgcaccaatgcggtttgccgaaaaaaatggctttggaactgttcaaaccgttcattttccacaaattggaaaaacaaggtttggcctctaccgttaaagcagcgaaaaaattggtagagcaagaagtaccggaagtatgggacatcttggaagaagtcatccgcgaacatccgattatgctgaaccgtgcgccgaccctgcaccgtttgggtattcaagcgttcgaacctatcttgattgaaggtaaagcgattcagttgcacccattggtgtgtgctgcgttcaacgccgactttgacggcgaccaaatggcggtacacgttccattgagcttggaagcacaaatggaagcacgcacgctgatgctggcttcaaacaacgtattgtctccggccaacggcgaaccgattatcgtaccttcccaagacatcgtattgggcctgtactatatgactcgcgatcgtatcaatgccaaaggcgaaggcagcctgtttgccgatgtgaaagaagtgcatcgcgcataccataccaaacaggtcgagctgggtacgaaaatcaccgtacgtctgcgcgaatgggtgaaaaacgaagcaggtgagtttgagcctgtcgttaaccgttacgaaacaaccgtcggccgtgcattgttgagcgaaatcctgccgaaaggcctgccgtttgaatatgtcaacaaagcgttgaagaaaaaagaaatttctaaactgattaacgcatcgttccgcctgtgcggcttgcgcgatacggttatctttgctgaccacctgatgtacaccggtttcggatttgcggcaaaaggcggtatttccattgccgttgacgatatggaaattccaaaagaaaaagcggccttgctggctgaagccaatgccgaggttaaagaaatcgaagaccaataccgtcaaggtttggttaccaacggcgaacgctacaacaaggtggtcgatatttggggtcgtgccggcgataagattgctaaagcgatgatggacaacttgtccaaacaaaaagttatcgaccgtgccggcaacgaagtcgatcaagagtcattcaactccatttatatgatggcggactccggtgcccgtggttctgcagctcagattaaacagttgtccggtatgcgtggcttgatggcaaaacctgacggctcgattattgaaacgccgattacctcaaacttccgtgaaggtctgaccgtattgcaatactttattgcgacccacggtgcgcgtaagggtttggcggataccgcattgaaaaccgcgaactccggttacctgactcgtcgtctggtagacgtaactcaagatttggtcgttgttgaagacgattgcggtacttcagacggctttgtcatgaaggcagtggtacaaggcggtgatgtgattgaagcattgcgcgatcgtattttgggtcgtgttaccgcgtctgacgttgtcgatccgtcaagtggcgaaaccttggttgaagccggtacgttgctgactgaaaaactggtggatatgatcgaccaatccggtgtcgatgaagtcaaagtccgtacgccgattacttgtaaaacccgtcacggcctgtgtgcacactgttacggtcgtgacttggcacgcggcaaactggttaacgccggtgaggcagtcggtgtgattgctgcacaatccattggcgaaccgggtacccagttgaccatgcgtacgttccacatcggtggtgcggcatcccgtgcggcagcagccagccaagtggaagccaaatccaacggtacggcacgattcagcagccagatgcgctacgttgccaacaacaaaggcgagttggttgtcatcggccgttcttgtgaagtcgtgattcacgacgatatcggccgtgaacgcgaacgccacaaagtaccttacggtgccatcctgctggtacaagacggtatggccattaaagccggtcaaaccttggcaacctgggatccgcatacccgtccgatgattaccgaacacgcaggtatggtgaaattcgaaaacgtggaagagggcgttaccgttgccaaacaaaccgatgatgtaaccggtttgtccactttggtggtgattgacggtaaacgtcgttcctctagtgcttccaaactgctgcgtccgactgtgaaactcttggacgaaaacggcgtggaaatctgtattcccggtacttctactccggtatccatggcattccccgttggtgcggtgattaccgtacgcgaaggtcaggaaatcggtaaaggcgacgtattggcgcgtattccgcaagcctcttccaaaacccgcgacattaccggcggcctgccgcgcgttgccgaattgtttgaagcacgcgtgccgaaagatgccggtatgttggcggaaattaccggtaccgtttccttcggcaaagagaccaaaggcaagcaacgtctgattgttactgacgtggacggtgtagcatacgagaccttgatttccaaagagaaacaaattctggtacacgacggtcaagtggtaaaccgcggtgaaaccatcgtggacggcgcggtcgatccgcacgatattctgcgtttgcaaggtatcgaagcactggcacgctacattgtccaagaggtgcaagaggtttaccgtctgcaaggtgtgaagatttctgataaacacatcgaagtcatcatccgtcaaatgttgcgccgtgtgaacattgcggatgccggcgaaaccgggttcattaccggagagcaggtcgaacgcggcgatgtgatggcggccaatgaaaaagctttggaagaaggcaaagaaccggcgcgttacgaaaacgtattgctgggtattaccaaagcttccctgtccaccgacagcttcatttctgccgcatcgttccaagaaacgacccgcgttctgaccgaagccgcgattatgggcaaacaagacgagttgcgtggtttgaaagaaaacgtcatcgtcggtcgcttgattcctgccggtaccggtttgacttaccaccgcagccgtcatcaacaatggcaagaggtggaacaggagactgccgaaacccaagtaacggatgaataatctttggtgcatccattcaataaaaaaccgcaagccttgagcttgcggtttttctttgtccgattaaggcaaaaacaagcgttttcgtcattttgaggcgtgtggattattccttaggtattttcgggccggagaccaacgaggtggcgggtgtcgtcggtacgtccggagaccaaaataactttgccagggatgttggtttcggcggtcaaaaaaagtagcgtcttaatgttttccatttaaacaaatgtcgtctgaaacttcagacggcatttcctttaagaaataaatatgaaacccagaaatctcttttttgcaggctgcctgctgacttcggcgacgtttgccgaggatatcggcgtacctgtcgaactgattaacgtcggtaatcggattgcgatgccgtctgaaggggaaagcctcgccctcctgccgtttgccgaggatgtaccgccggttcgcgatgcaatgccgtctgaagttcctaaaagcgcggcaggcggcgatgttcggggtgaccggatgagaatgccgattaacatcggatgagcgcggctttatggcataaaaaactgtcgtggaaaggatttacaccccaaataaatttccgttacaacaagatcaacagcaatatgcccgccttttattcgcgcagcggcaaggaacggtttgtcagtatagaaaaaacgtattgacagtattttcttcagtcgtccgactgattgtgagggatgtcggtaaatatttatcggcaaacaagaaaatcatctttcttcttgtcgttatgcttgactgtctgcttgcaataaaaatataattccactcttgccgacatggtgtcggcaagtatttaactcaacaggacgagaaaatatgccaactatcaaccaattagtacgcaaaggccgtcaaaagcccgtgtacgtaaacaaagtgcccgcactggaagcttgcccgcaaaaacgtggcgtgtgcacccgtgtatacacaactacccctaaaaaacctaactctgcattgcgtaaagtatgtaaagtccgcctgaccaacggttttgaagtcatttcatacatcggcggcgaaggtcacaacctgcaagagcacagtgtcgtattgattcgcggcggtcgtgtaaaagacttgccaggtgtgcgttaccacactgtacgcggttctttggatactgcaggtgttaaagaccgtaaacaagcccgttccaaatacggtgctaagcgtcctaaataattactgggacttaaataggcacgtcggccgcctaagctgaacaacggccgagtaagtgaatactcaattgggtattcatgggaatagacccgactgaatagattaaaggaaattaaaatgccaagacgtagagaagtccccaagcgcgacgtactgccagatcctaaattcggcagcgtcgagttgaccaaattcatgaacgtattgatgattgacggtaaaaaatccgttgccgagcgtatcgtttacggtgcgttggaacagattgagaaaaaaaccggcaaagtagcaatcgaagtatttaacgaagccattgcaaacgccaaacctatcgtggaagtgaaaagccgccgtgtaggtggtgcaaactaccaagttcctgttgaagttcgtccttcacgccgtttggctttggcaatgcgctgggttcgcgatgcggcccgcaaacgtggtgagaaatccatggacctgcgtttggcaggcgaattgattgatgcgtccgaaggccgtggcggtgcgttgaaaaaacgtgaagaagtacaccgtatggctgaagccaacaaagcattctctcacttccgtttctaattttgaaaggctaataaaatggctcgtaagaccccgatcagcctgtaccgtaacatcggtatttccgcccatattgacgcgggtaaaaccacgacgacagaacgtattttgttctataccggtttgacccacaagctgggcgaagtgcatgacggtgcggctactaccgactacatggaacaagagcaagagcgcggtattaccattacctccgctgccgttacttcctactggtccggtatggcgaaacaattccccgagcaccgcttcaacatcatcgacaccccgggacacgttgactttaccgtagaggtagagcgttctatgcgtgtattggacggcgcggtaatggtttactgcgcggtgggcggtgttcaaccccaatctgaaaccgtatggcggcaagccaacaaataccaagtgccgcgcttggcgtttgtcaataaaatggaccgtcagggtgccaacttcttccgtgttgtcgagcaaatgaaaacccgtttgcgcgcaaaccctgtacctatcgtcattccggttggtgcggaagacaacttcagcggtgtggttgatttgttgaaaatgaaatccatcatttggaatgaagtcgataaaggtacaacctttacctatggcgatattcctgccgaattggtcgaaactgccgaagaatggcgtcaaaatatgattgaagccgcagccgaagccagcgaagaactgatggacaaatacttaggcggcgacgagctgaccgaagaagaaatcgtaggcgcgttgcgtcaacgtactttggcaggcgaaattcagcctatgctgtgtggttctgcatttaaaaacaaaggtgttcaacgtatgttggacgcagttgtagaattgctgccagctcctaccgatattcctccggttcaaggtgtcaacccgaataccgaggaagccgacagccgtcaagccagcgatgaagagaaattctctgcattggcgttcaaaatgttgaacgacaaatacgtcggtcagctgacctttatccgcgtttactcaggcgtagtaaaatccggcgataccgtattgaactccgtaaaaggcactcgcgaacgtatcggtcgtttggtacaaatgactgccgcagaccgtactgaaatcgaagaagtacgcgccggcgacatcgcagccgctattggtctgaaagacgttactaccggtgaaaccttgtgtgcggaaagcgcgccgattatcttggaacgtatggaattccccgagccggtaatccatattgccgttgagccgaaaaccaaagccgaccaagagaaaatgggtatcgccctgaaccgcttggctaaagaagacccttctttccgtgtccgtacagacgaagaatccggtcaaaccattatttccggtatgggtgagctgcacttggaaattattgttgaccgtatgaaacgcgaattcggtgtggaagcaaatatcggtgcgcctcaagtggcttaccgtgaaactatccgcaaagccgttaaagccgaatacaaacatgcaaaacaatccggtggtaaaggtcaatacggtcacgttgtgattgaaatggaacctatggaaccgggtggtgaaggttacgagtttatcgatgaaattaaaggtggtgtgattcctcgcgaatttattccgtctgtcgataaaggtatccgcgatacgttgcctaacggtatcgttgccggctatcctgtagttgacgtacgtatccgtctggtattcggttcttaccatgatgtcgactcttcccaattggcatttgaattggctgcttctcaagcgtttaaagaaggtatgcgtcaagcatctcctgccctgcttgagccaatcatggcagttgaagtggaaaccccggaagaatacatgggcgacgtaatgggcgacttgaaccgccgtcgcggtgttgtattgggtatggatgatgacggtatcggcggtaaaaaagtccgtgccgaagtacctttggcagaaatgttcggttactcgaccgacctgcgttctgcaacccaaggccgcgctacttactctatggagttcaagaaatattctgaagctcctgcccacatagctgctgctgtaactgaagcccgtaaaggctaatcagaaaaggccgtctgaaactgaaaataaattttcagacggccattgttctttaatcgatctttatatgtaaaggaattagctcatggctaaggaaaaatttgaacgtagcaaaccgcacgtaaacgttggcaccatcggtcacgttgaccatggtaaaaccactctgactgctgctttgactactattttgtctaaaaaattcggtggcgctgcaaaagcttatgaccaaatcgacaacgctcctgaagaaaaagctcgtggtattaccattaatacctcacacgtagaatacgaaactgaaacccgtcactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtggaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaattgaaggatattgataaatggcaaaccaaaaaatccgtatccgcctgaaagcttatgattacgccctgattgaccgttctgcacaagaaatcgttgaaactgcaaaacgtaccggtgcagttgtaaaaggcccgattcctttgccgaccaaaatcgagcgtttcaacattttgcgttctccgcacgtgaacaaaacttcccgtgagcaattggaaatccgcacccacttgcgcctgatggacatcgtggattggaccgataaaactaccgatgcgctgatgaagctggatttgccggccggtgttgatgtagaaatcaaagtccaataattcggactataaaaaatccccaagcaatcaatgcttggggattttttatgttatgccgagacctttgcaaaattccccaaaatcccctaaattcccaccaagacatttaggagcaccttcttccagcaaaccgcccaagccatgattgccaaacacatcgaccggttcccactattgaagttggaccgggtaattgattggcagccgatcgaacagtacctgaatcgtcaaagaacccgttaccttagagaccaccgcggccgtcccgcctatcccctgttgtccatgttcaaagccgtcctgctcggacaatggcacagcctctccgatcccgaactcgagcacagcctcatcacccgcatcgatttcaacctgttttgccgctttgacgaactgagcatccccgattacagtcatcaaccatattccggtttgtcggagaaagatgcatacgctgtgatgaccggataccgacccgttaaaagagtccgaccctatgccgtctgaaaattcaaaacgcttcagacggcatattgaagatatttctgatatttctgttgatatttctttgacttgtcagatataatgccgagcttggtacatttgtgccaagtttaactttgtctgaaagacaggccaatcgtagcctgtccctttactttaaaaggaaaataatcatgactttaggtctggttggacgcaaagttggtatgacccgcgtgttcgacgaacagggtgtttctgttccggtaaccgttttggatatgtctgccaaccgcgttacacaagtaaaatccaaagatactgacggctatactgccgttcaagttacctttggtcagaaaaaagccaatcgtgtcaacaaagccgaagccgggcactttgcaaaagcaggtgttgaagccggtcgcggtttgattgagtttgctttgactgaagaaaaactggctgaattgaaagctggtgacgaaatcaccgtttctatgtttgaagtcggtcaactggtcgatgtaaccggtacctctaaaggtaaaggtttctccggcacgattaaacgtcataacttcggtgcccaacttattccgcttgcagcttgccgctgaagcgtaccaatacagactcgggcatatcgagcggcattacgcccgttgcggcggcaaatgcaacgggta

SEQ ID NO: 78 - DNA, 5880 bp, Neisseria meningitidis
  misc_feature (6)..(6): N is any nucleotide
ttttcntagcaggcatcaaactgcccggcagcatcgtcggcatgggcgtgctgtttgcgcttttgcaggcgggttgggtcaaaacgtcttggctgcaacagcttaccgacgcgctgatgtcgaacctgacgctgttcctcgtgccgccctgcgtggcggtcatcagctatttggatttgattgccgacgattggttttcgatactggtttccgcctccgccagcactttgtgcgtactgctggttacgggcaaagtccaccggtggatacggggtattatccgatgaacgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgatttttggctgaaacccgccgtcgtcgtgcttgccgtgccgctctaccaaaaccgccgtaaaatcttcaaccagtggctgcccgtcatcgtttcacagcttgcgggcagcgttacgggcattgttacagggatgtattttgccaaatggctgggcgcggaacgcgaagtcgtcctctcgctcgcgtccaaatctgttaccaaccccatcgctattgaaatcacccgctccatcggcggcattcccgccattaccgccgccaccgtcatcattgccggtctggtcggacagattgccggttacaaaatgctgaagaacacggtcgtcatgccctcgtccgtgggtatgtcgctcggcacggcttcgcacgcgatggggattgccgcctcgctcgaacgcagccgccgtatggcggcatacgcggggctggggctgacgttcaacggcgtactgaccgcgctgattgcgccgctgctcatccccgttttgggattttgaacccgtttcagacggcatttcagcccatgctgtctgaacgccgacacactcgcaaggagaaccgttatggctgtcaacctgaccgaaaaaaccgccgaacaactgcccgacatcgacggcattgccctctacaccgcccaagcaggcgtgaagaagcccgggcataccgacctgacactgattgccgtagccgccggcagcaccgtcggtgcagtcttcacgaccaaccgtttctgtgccgcgcccgtccacatcgccaaatcgcaccttttcgacgaagacggcgtgcgcgccctcgtcatcaacacgggcaacgccaacgcgggtacgggcgcacagggcagaatcgatgctttggcagtgtgtgccgccgccgcccggcaaatcggctgcaaaccgaaccaggtgctgcccttctccaccggcgtgattctcgaaccgctgcccgcagacaaaatcatcgccgccctgcccaaaatgcagcctgccttctggaacgaagcggcacgcgccatcatgaccaccgacaccgtgcccaaagccgcctcgcgcgaaggcaaggtcggcgacaaacacaccgtccgcgccacgggcatcgccaaaggctcgggcatgattcatcccaatatggcgaccatgctcggtttcatcgccaccgatgccaaagtttcccaacccgtcctccaactgatgacgcaggaaatcgccgacgaaaccttcaacaccatcaccgttgacggcgacaccagcaccaacgacagcttcgtcatcatcgccaccggcaaaaacagccaaagcgaaatcgacaacatcgccgacccgcgttacgcccaactcaaagaattgttgtgcagcctcgcgctcgaactcgcccaagccatcgtccgcgacggcgaaggtgcgaccaagttcatcaccgtccgcgtcgaaaacgccaaaacccgcgacgaagcccgccaagccgcctacgccgtggcacgttcgccgctggtcaaaaccgcctttttcgcctccgaccccaacctcggcaggctgctcgccgccatcggttatgccggcgttgccgacctcgataccgacctcgtggaaatgtatctcgacgatattttggttgccgaacacggcggacgcgccgcaagctacaccgaagcacaagggcaggcggtgatgtcgaaggccgaaatcaccgtccgcatcaagctgcatcgcggacaagccgccgccaccgtctatacctgcgacctgtcgcacggatacgtttccatcaacgccgattaccgttcctgacccgacacggcttcagacggcatacataaaatgccgtctgaaccgccggacaacataccatgacctccacattcccccgccgcctcgcccgcaaaatccgccaaacccgccgcctgtcgcgcaaaagcatcgcctttctgttccttttggcaggttcggcactcgtcgccctgaccgcgctgttttttgcccatcttgccgattttgcgctggaactgaacgccaaactggttcaacaatacccgtggttcgcgtgggtcgcgcttcctttgggtttaccgcttattgcgtggctcacacgcaaattcgcccccttcaccgccggcagcggcatcccgcaggtcatcgcctcactgtcgctgccctacggcgcacagaaaacgcggctgatccgcctcgggcagacgctgctgaagattccgctaacctttttgggtatgctgttcggcgcgtccatcggacgcgaaggtccgtccgtgcaggtcggcgcggcagtgatgggcgcgtggggcgcgtggtgcaagaaacacggcttggcattcaaagggatgcaggaaaacgatttgatggcggcgggcgcggcgggcggtttggcagccgcgttcaacgcgccgctggcgggcgtgattttcgccattgaggaactcgggcgcggcatcatgttgcgctgggagaggcaaattcttttgggcgtgctcgcctccggtttcatacaggtcgccattcagggcaacaacccgtatttttccggcttcaacggcggcgtattggaacatatctttctgtgggtcgcactgtccggcctggtttgcggcgcggcgggcgggctgttcggacgtttgctctatcgcggtgcggcggcgtttgcaccgcgcaagatacgcggcttcatccgcaaccgtccgctgctgctggcggcactgatggggctgctgctcgccctgctcggcacgttctaccaaggcaaaacctacggcaccggctaccacgaagccgcccaagccctgcacggcatctacgaagcccccttcggactcgccgccgccaaatggctcgccaccgtattcagctattgggcaggcgttccgggcggcattttcactccctcgctgaccataggcgcggttttgggcgagcatatcgccgccatcgccgacatatcgcagggtgcaaacatcatcgtcctcatctgcatggcggcatttctggcgggcgcgacacaatccccgattacttccgccgtcgtcgtcatggaaatgacgggcggacaaagcctgctgttttggatgctaattgcctgcattttcgcctcgcaggtttcgcgccagttttcgccgcgtccgttctaccacgcatcgggaatgcgcttccgccagcgcgtgcttcaagaaaccgccgcccaaaccggcaatgcgcccgcaagaccgcaaacagcaaacagcaaaacgggaatgccgtctgaaaattaaaacgcccccgatcaaacgccggcagccgccttgatttgaataccgttccgccgccgcttgaaatttcagcaacaatgccgtctgaacgacagaatgcggttttcagacggcatttccccatcccgatattgcctaaacaaaaccgaagcgtttgctataattctattttttaccgcatacgcaccaatcatgtttcccgatttctcccaaaccctctccaaagaccgccacttcctgcgttccgccttcaaaaatcccaacaaatacggcggtttgtccaaaatcgaagaaaaataccgaaaatcgcacgaaatctttttgaagcgtttggcagccttgccaaaacccgaattcgacaacaccctgcccgttcacgagaagctcgaagaaatcaaaaaagccattgccaagaatcaggtaacgattatttgcggcgaaaccggttcgggcaaaaccacgcagttgcccaagatttgcttggaactcgggcgtggggcggcaggattgatcgggcatacccagccgcgccgtttggccgcgcgctccgtagcagagcggattgccgaagagctgaaatccgaaatcggcagcgcggtcggctataaagtacgcttcaccgaccacacctcgcgcgatgcctgcgtcaagctgatgaccgacggcatcctgctggcggaaacgcagaccgaccgttatctcgccgcctacgacacgattatcatcgacgaagcgcacgagcgcagcctgaacatcgacttccttttgggctatttgaaacaactcctgccgcgccgccccgatttgaaagtcatcatcacctcggcaacgatagacgcagaacgcttctcccgacacttcaacggcgcgcccgttttagaagtgagcggacggacgtatcccgtcgaaatcctctaccgaccgctgaccggcaaagacgaagacgacgcagaagtggagttgaccgacgcgattgtcgatgcggcggacgaattagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctgaaaacaggcagacataaaagaaaatccgcgtagagtgatgtaaacttacccttgctttaataagtagaaaatggtgggtttacgtccccccctgcggctactaaaaaaatataagagtaaacaacctttttgaaagaaaaatgtatggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccg

SEQ ID NO: 79 - DNA, 24158 bp, Neisseria meningitidis
gcccctggcttcttaaaggttgtccgcccaaatgctcaatgacaaggacttgccgttaaagcggtaagaaaacgtgtactcattcataggagaaaccttatgtattttgaaatctataaagacgcaaaaggcgaataccgttggcgtttgaaagcagccaaccatgaaatcatcgctcagggcgaaggctacaccagcaagcaaaactgtcagcacgcagtcgatttgctgaaaagcactaccgccgctacccctgtaaaagaggtataaaatccgctttcaccctcagcccgcgccctacgcgggcttttttgtcagtttccgactttgcgggagtgattgcccgcccagtcgcgccaagcctgattttgattttccaactccgccacatagccaccaaactcagcggcgtgttccaacagcgtggccgtcttgccgtctttcggcggattcgggcgtaccggcgcgaccatcaatgcagcaggcggggtcggcatgactgccttttcgacaaccttaatttccgtagccgagggcgcggttgtagagctgcaggccgtgagagccaaagccgtcaatgcaaccgccgcttgcatttttacggtcttgagtaaggacattttcgatttcctttttattttccgttttcagacggctgacttccgcctgttttttcgccaaagccatgccgacagcgtgcgccttgacttcatattttttagcttccgcgcgtgccagttccagttcgcgcgcatagttttgagccgacaacagcagggcttgcgccttgtcgcgctccatcttgtcgatgaccgcctgctgcttcgcaaatgccgacttgtagccttgatggtgcgacacagccaagcccgtgccgacaagcgcgataatggcaatcggttgccagttattcgccagcagtttcacgagattcattctcgacctcctgacgcttcacgctgacaaatgaacgcgccaccgcatagccgccgacaatgcccaaatacaccgcccaaatttccgccgacggatcgggcaacatcacaaacttaaacgtcccagccgcgcaggcaacgtttgcccacagtttcgagtgcgacacattgcctgtcgccgggtttttaaaaatatccaaaatacgcattgctattccacacttttggtttgcaggtgccgtttcagcatttcccgataattggccagttcgccctccgcaaattcaaacgcagccaagtccgcctgttcgcttgcctcacggcttttggccgaccacagcccaatcatcttttcgtaaaacgcaacctgtcccatgattaacgacgattcttgcgtttgcgcgccgcacgtttagcagccgccacgcctgatttacccaagcgcaggctcggatgttgtttcaaagagcctacccgaacagggcttggcgtgattttgatttcaggtaacggtggtacgccaaaatcgtttttcaactttgcacaatgggcaacacataaagcaatcaaagactttttcataccttcgccgctcccaattccatcgcaatcgcgtccgcaatcgcgcggcagatgccccatttggtcgtcttaaacaaggccaaatcagtgtcgttgctgatgaaaaaaggctcaaacacaatgccgcctgcctgcgcataagccaggcgcgaatgttgccctgcgttatccggcttaaagccgtcttcgccgcgcagtttccagccggttttcttggcaacggctttgcccagcacctgacaccagcgtttatttttcggcgtggacaaggcttcgatgcctgtcgccgttttgttcgccgccgcattggtgtggaactcaatcgccacatccgagccgcgaatcagcttgaccgcatcgcgcagcggcatattgcctttgcccgtgccgtcggttttaacggtcaggccgtaatcgttacgcaggattgaagccacaatgttgcgcatatcctgcgccaagtccgcctcacggtcgcttccgttgaccgcacccgggtcggtgttgctgtgtccagcggttaaggttacggttttgcccattcatcatctccaaaaaatattgattgcatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactataacatttgaaaaccccattaaaccgtctttaacccatcgtcccgaacggtagatgtttcacccctgcaaaccaaaaaaaagaccgtctgaatacagacggccaaagcctggtcacacatcactgcctaaaataaagctgcctgctgtgccgcaggtcggctcatttcattgataatcgtatatcccgttcgtgaagagatgccgtatttagggcatagcttcgtcatcgccataagcccgctcttcttatcaatatcgcgcaatttgacaaactcctgataaaacctatggtttctcaactgtattaacgccttgccgcaccgtgggacatacaattcctcgccaccatatacctgcaacagctcatgtgttttcacttcgccgatggcttcgaccaaaattgccaaacgctcggtgtccaccttgcccttaccaaatttaaaccgcgccccgccaatcgccttgaccagctgttccgtcgctgccagtccgatgacatccacaatgtccaacacggtatccggcaataaatgttcaactttttcgaaccccatcatccccacccgctttttccgttttcctgttttccgcaatctgcaacgcagcaaccagtttatgtagctgcgtatcgtctaaatattcgaccttatccttaccaaacatccgccgcgccattgcgtgtgcatagttccaatgtttgccgccgacggtcagcagggcttcgactttgtccaacattgccgctgatgatgtccgacgcagatgcggtttgccgtgtgggttaccttttgctttaggcttaaatccgtgcgaccgcatatcagcgacaacagactcaagttcggaaacatccatatccgcacacgaccgcttgcccgtcacacgctccaacaccgcgcgataggtaccgtcatccaagcccagctccttttgagcaatcttaattttcgcaatcaacgcccggcgcatctcaaacccataaaacacaatatatagtattaagccgatgttttttgcgaaacggacagacataaaaaagcaactgtatttttcaccccgtcgggcaaaaataccaaaactcaaatcaagccgtttagataccgttttcggcggtatcgttttcggcaaaataatcacgcatccgggcattcgatatcgtcagcagtttgcgcatacatgccgtaacggcaaccttatacggcttaccctcggacggcaggcgttggtagaaatcccgaataagcggttcaaaacgtgtcgctgccacggtagccatatacagtgccttacgcaccgcagaccttccgccaaagcagcggcttttgaatttggtttccccgctctccctcgggtgtggggcaatgccgactagactcgctatccgtttgtgcgacagccgccccaattcgggcaacatcgccatcagcgtagccgtcgttatcgaaccgatgcctttgatttgctctgccacttgggctttgccgtcaaaatgcgtgtgggtgtggttgtcgatttgtttgtccaattcgtcaatcagccggtcaaaatgggcaatcagttgtttgacgctttcgacttgcgtttcatgaacctaatgcagacggtttttctcggcagtccgcatatccaccagttggttgcggcggttaaccaaggcttccaacacttcttccacttcggtgggcgggtggtagggcatggtttgcgaatcttctttctgtgccgtcatctgtgcgaagaaggcgggcattttggcatctttggcgtcggttttggtcagcggctgcgattgggcaaactgatgcgtctgacgcgggttggcgataatcacggccctgctcggcggatggctttggcggcggggatttcgagaccgccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacaaatagtacgaaaccgattcacttggtgcttcagcaccttagagaatcgttctctttgagctaaggcgaaccaacgctgtactggtttagatttaattcactatacctgcgtaatggtattgggtactcatcataaacctgccttgcattcggttgtgttgtccggcaactgtccggttgtgtcgatgggttgccctgccgctccctgagctacgcaacggttgtgtgccttgggtgggcgcgggtggcggctgggcggtttgttgctatgatacggtgattccaatatacaagggtgggcttcagtccaccgcttccgtcgattccgtcaatgttacccatttccaccgtccccgccgaaaccaaaaccgccgactcccgccggttctccaaaaatttttgatgcagcgggctgaagcacaccctgcatcccaccttttacgaatcctcctacaccctatacaacaccttgaaaatccaccctgtcaggaatacccgaaccgtcatccctaccttcgcaaaatagcgcaaaataccgtctgaaagcccttcagacggcattaccttgtttatctgcatcaatggcggaaatggcggatgccggttacgaccatggcgatgccgtgttcgtcggctgcgtcgaaaacttcctgatcgcgcatcgagcctgccggatggatgatggctttgatgccctgttcggcaatcacgtccacgccgtcgcggaaggggaagaaggcatcggatgcggcacacgcgccgttgaggtcgagaccggcatcttgcgctttgcgggcggcgatgcgggtgctgtccacgcggctcatttggcctgcgccgatgccgtaggtttgaccgcctttgccgaatacgatggcgttggatttgacgtatttggcgacgttccagacgaacagcaaatcgttccattcctgctcggtcggttggcgtttggagacgactttcaaatcggcgcggctgatgcggtggatgtcgggcgtttgcaccaacagtccgccgccgacgcgtttgagttcgaagcggtttgcgcctgcctcaagcggcacttccaatacgcgcacgtttttcttggcggcggcgatttcgagggcttcggcggtgaacttaggcgccatgaggacttccataaactggttgtcggtaatttgtttgacggttgcgccgtcaacttcgcggttgaaagcgatgatgccgccgaacgcgctggtggtgtcggtggcgtaggcgagtttgtaggcatccaaggtattggaggcgatggctacgccgcacggattggcgtgtttcacaatcacgcaggcgggcacgtcgaaggatttgacggcttcccatgcggcatcggcatcggcgatgttgttgtaagacaattctttgccttgcagttgtttgtatgcagcgaggctgcctgcggcggggtcaatatcgcggtagaacgcggcgcgctgatgcgggttttcgccgtagcgcatgtcttgcactttaatccagctttgattgaaccggccggggaatccggcgatttcgggcgtgccgctcaagacgtcgtctgaaagcgaggtcaggtaattggaaatcataccgtcgtattgggcggtatggctgaatgctttgcgcgagaggttgaaacgggttttgtcgctcaatgcgccgttgttggcttcgagttcggcagctatggccgggaaatcggcggtgtcggtaacgatggcgacgtgtttccagtttttcgcggcagagcgcaccatggtcgggccgccgatgtcgatgttttcaatcgcgtcttccagcgtgcagtttggtttggcgatggtggcagcgaagaggtagaggttgacgcacacgaggtcgatattgccgatgccgtgttcttccatcttggcgacgtgttcgtccaaatcgcgacgaccgagaataccgccgtggattttcggatgcagggttttcacgcggccgtcgagcatttcgggaaaaccggtatagtcggcaacttcgataacgggaacgcctgcatcagccaagagttttgctgtaccgccggtagaaagaatttcgacaccgagtttgtgcagggtttgggcaaattcgactgcgcctgtcttgtcggataggctgatcagggcgcgtttgatggaagacatttggatttcctttgttgaaggtttaatcagtatgggatgaattttcagggcggtattatcccccagtttcgcatttttggcagtaggtttttgcaaatattgttaacaattttattgtaaaaggccgtctgaaacttggtttcagacggccttttgcttttgcctatttaaatcccattttctttgccacccatactgcacctgccatgcctgtacataatggcatgagcaaggcaacaggggcgtaggtgagctccaaaataaaggctatggcggtcaggggcattttaagggaaacaccgaggaaaactgcggcgccgacaatggctgcgctttcagaggacatttcaggaaaaacactgttccacgcggtggcagcagcaaaggcgatggtactgccgagcatcatggacggggtaatcagaccgccgtatgcgccgacggcaagcgccattaagacgaccagccatttgacggcggtcagcccaaggctgtgttgccaatcggtcaatccgccaaaggtcagttgattgcctgctttgccattgcccaaaatttcgggaaaccaaacggaaatcacgccgatgagtgcaaacatacagacggccaagggaataattttgatattgtcgcgcttgataaaggggaacttttgggcggtacgctggaaaaagacggcggctacgcccagtatcgggccgatgacggcggaaaaccaaagtaatgaagtattgacggtaaggttggccggatgatattgctgcacgtcgcccaagccgatgcgcgcgacggcggtggcgatgactgaagttaacaatgcagcggcgacggcttgctgcgtccacacgcccagcatggcttcgagaatgaaaagtgtggaggcgagcggcacgttatacacggccgccaaacccgcacccgaagcgcaagcaatcagtagccgcatttcgccttcatccaaacccaagcgtttgccgccggcaaaagcaaacgcggcggtcatttcgcgcggggcgacttcgcgtccgagcggcgaaccgagtccgaccgttatgatttgcagcagaacatggaaaaccgtcgtcagaaacggcagcccctgcaacggctgtttcaaggcggctttgatttcgatttgcggcttgccgaaacgtttcagcaaccaccagccgctgcctgcgaccgcgccgcacagcgtcagcacggcaacgcgccgcataccggaagcctgtgccacgccttcgcggaacgaagtgtacacgccgtccgcgccataaccgtatgccgtatgctgtatgaagtgcatcagttccgtcagcacaatgccgaccaaaccgccgataacgcccgctgctgccagggcaaaccaaagttttctgcgtcccactgtcgttcctgccgttcaaatgccgtctgaaaacctttcggacgacatccgtttcctatccgcctatccgaacaggccgcgtacacgctccaaaccgccgaagttgatacaggcatcggcggcggcccgcgctttcggtttggcacggtaagccacgcctatgcccgcttctttgagcatcggaatatcgttcgcaccgtcgcccaccgccaacacctgatgcggctgcaatccgaggcggctgcggtattcgcgcaacaaatctgcctttgcctgcgcgtcgatgattctgcctttcagacggccggtcagcctgccgttttcaatttccaaaacattggcgtgttggtattcgaagccgaggcgttgttgcagcctttcggtaaaaaacgtgaagccgcccgacaccagcaggaatttcacatcgtgccttttgcattcgtccaacaaaaattccgcaccgggcgagagcttcaaaacgttttcataaacgtccgccaaaacccgttcgtccaatcccgccaacagcgcgacgcggctgcgtaaagactgttcgaaatcgagttcgccgcgcatcgaacgctcggtaatttccgctactttgttttttaaacccacgcctgccgcaatttcatcgacgcattcgatggtaatcagcgtcgaatccatatcgctgacaatcaaaccgagttcgtcgaaatccatatccggcaacacggcgtggtcgatttgacggctgccaagcaacgccgcgtctttttcgcttaaagaaaacccttcttcaacgataaaacgcatacgcttttcatcggcgcaatcaggttcgggcaggcgtaaggggaagtcggaaggcagggctgcggcggagggaaattggaggacgagggcgtgcggcataacggcggctcaaaaaatgcggattatatagtgaaacggcaaagaatgttacggcgggcgggactgcaatcggaaaacgatttcaaacacaaacggcagtatgtgtcggacaacacgggaaaatgccgcaactattgccagcctgatgaaaattcgttataaggggattatctaaaatatattaacatttgaagtgagtcggctttaaaccggtacggcgttgctccgccccgccccgatttaaatttaacccacgatacatataaacaacccgaaaaaggattcagagatgaaaatcggtatcccacgcgagtcattatccggcgaaacccgcgtcgcctgtacgcccgccaccgtcgccctgctgggcaaactgggctttgaaaccgttgtcgaaagcggtgcaggtttggcggcaagtttggacgatgccgcttaccaaacagcaggcgcaaccgttgccgacaaagcggcggtttgggtctgccctttgatttataaggtcaacgcgccgtccgaacaggaactgccgcttttgaacgaaggtcaaaccatcgtcagcttcctgtggccgcgccaaaacgaggctttggtcgaagccttgcgcgccaagaaagtgaacgcgctggcgatggatatggtgccccgcatttcgcgcgcgcaggctttggacgctttgtcttcgatggcaaacatcagcggctaccgcgccgtaattgaagccgccaacgccttcggccgtttcttcaccggtcaaattaccgccgccggcaaagtgccgcccgcgcaggttttggtgattggtgcaggtgtggcaggtttggcggcgatcggtacggcaaactcgctcggcgcagtggtacgcgcgttcgatacccgcttggaagtggcggaacaaatcgaatcgatgggcggcaagttcctgaaactcgacttcccacaagaatcgggcggcagcggagacggctacgccaaagtgatgagcgacgaatttatcgcagccgagatgaagctctttgccgagcaggcgaaagaagtggacatcatcatcaccaccgccgccattccgggcaaacccgcgcccaagctgattaccaaagaaatggtggaaagcatgaaatccggctccgtcatcgtcgatttggcggcggcgacgggcggcaactgcgaactcacccgcccgggcgaattgtccgtaaccggcaacggcgtgaaaatcatcggctacaccgacatggcaaaccgccttgccggacagtcttcccagctttacgccaccaacttggtcaacctgaccaagctgttaagcccgaacaaagacggcgaaatcacgttggacttcgaagacgtgattatccgcaacatgaccgttacccacgacggcgaaatcaccttcccgcctccgccgattcaagtttccgcccagccgcagcaaacgccgtctgaaaaagccgtgcctgccgccaagcccgagccaaaacccgttcccctgtggaaaaaactcgcgcccgccgtcatcgccgccgtcttggtactgtgggtcggcgcggtcgcacccgcagcattcctgaaccactttatcgtgttcgttctcgcctgcgtcatcggctactacgtcgtctggaacgtcagccactcgctgcacacaccgctgatgtcggtaaccaacgccatctccggcatcatcgtcgtcggcgcgctgctgcaaatcggtcagggcaacggcttcgtttcgctgctgtcgtttgttgccatcctgattgccggcatcaacatcttcggcggctttgcggtaacacggcgtatgctgaatatgtttaagaaagggtaagccatgactttcgcctattggtgtattctgattgcctgcctattgccgcttttttgtgcggcgtatgccaaaaaagcgggcggattccggtttaaagacaaccacaatccgcgcggttttctagcgcacacgcaaggcgcagccgcccgtgcccacgccgcacagcaaaacggttttgaagcctttgcaccgtttgccgccgccgttttgacggcacacgcaaccggcaatgcggcgcaatcgaccatcaacacgcttgcctgcctgttcatcctgttccgcctcgcctttatctggtgctatatcgccgacaaagccgctatgcgctcactgatgtgggcaggcggatttgcctgcaccgtcgggctgtttgtcgcggctgcttgaaacagatgccgtctgaaaacacgaacgtcaatttttcagacggcattgaaaacaaatcatcgaaaatcggagaatttctatgtcttcaggactcgtaacagcggcgtatatcgttgccgcaattttattcatcttctcactggcggggctgtccaaacaggaaaccgccaaacagggctgctattccggtatcgccggtatggcggtcgccctttttgtaactgttttttccgacaatacccacggactgggctggatcatcatcgccatgctcatcggcgcggcaatcggcatctacaaagccaaaaaggtggaaatgaccgaaatgcccgaactgattgccctgctgcacagcttcgtcggcctagcggcggttttggtcggcttcaacagctatatcgcgccgggcaacgtttcgcacgatatgcacaccatccatctggtcgaagtgtatttaggcatcttcatcggcgcggtaacctttaccggctcgctggtcgcattcggcaaactcaacggcaaaatcagcagcagcccgctgcaactgcccgccaaacacaagctcaacgcactggcacttgccgtatcgtttgtgttgctgctcgtatttgtcggcattgacggcagcggcttcatcctgctgattatgaccctgattgccctcgcattcggctggcacttggttgcctccatcggcggcgcagatatgcccgtggtcgtgtccatgctcaactcctactccggctgggcggccgcagcggcaggcttcatgctctccaacgacctgctcatcgttaccggcgcgctggtcggctcaagcggcgcgattctgtcctacattatgtgcaaagccatgaaccgctcgtttgtctcggtaattgccggtggtttcggcagcgacagcggcacattatcttccggcagccaagagataggggaataccgagaagtcaaagctgccgatattgccgaaatgctgaaaggcgcaaacaatgtcatcattaccccgggctacggtatggcagtcgcacaagcgcaataccccgttgccgaaatcaccgagcttttacgtaaaaacggcaccgaagtacgcttcggcatccaccccgtcgccggccgcctgcccggtcatatgaacgtactgctcgccgaagccaaagtcccctacgacatcgttttggaaatggacgaaatcaacgacgacttccccgaaaccgatgtggtcttggtcatcggtgcgaacgacaccgtcaaccccgccgcccaaaccgacccgaacagcccgattgcgggtatgcccgtgttggaagtgtggaaggcaaaagaagtcgtcgtcttcaaacgctcgatgaataccggctacgcaggtgtacaaaacccactgttcttcaacgaaaacagcgtgatgtgtttcggagatgcgaagaaaaccgtagatgacattctgtccgaactgaaaaaataatgccgtctgaacaattcggcgcaggttttcaatctgtttgatttgaaaaaatcactgcaaaccccgtttatgaaggtttgcagtgatttttttgcattggggcaaacattttcagacggcccgtccgaataagcacctacatctgaaactgacacaaaatcaacgaaacaaacaaaatccatctccgtgttgaagatggatttttaattagccgaacactttttccaagtgtgcctgataatctgccaagtatttttccacttgcggatttttaaccacatcgttacataagaatgtcggcaggcgggtcatacccaaaaactcgttggctttgtggaagtgcatatacaaaacatcaacgcctttgccttcaaagaaatcgccttcgcgggtaaacgcctcaatcggcgcattccaagtcagtgaaagcatatgttttttgccttgcaacaagccgcctgtgccgtagccctcagtcggattgacgctgtgtctgccgtcgctttggtagagtttgccgtgtccagcggttaatactccgtctatgtattttttcactgtccaaggctcgtgcatccaccagcccggcatctgccaaatcacagcatccatccaaacgaatttttcgatttctgcctcaacatcatagccgggaatcgtcagaaatacctgcatcgtcattcccgcgcaggcgggaatctagaccttagaacaacagcaatattcaaagattatctgaaagtccgagattctagattcccgctttcgcgggaatgacgaaaagtggcgggaatgacgaaaagagacctttgcaaaattcctttccctcccgacagccgaaaccccaacacaggttttcggctgttttcaccccaaatacctcctaattttacccaaatacccccttaatcctccccggatacccgataatcaggcatccggggtaccttttaggcggcaacaggcgcacttagcctgagacctttgcaaatttgtcggtttcggggtcgtattggtagcctcgtgcctgtatgtcttctttgaaagtttcgtatacgtcgtgggctaaaagggctgttccgacatagggaaccgcccttgtgctgaatttcgcgcctaagcgggcaagtttgccgacccccgccaatacgccggcgcgggatacgctggcggttattttggcgttgattcgggcttttgcgcccgtagggatgtgtgttaaatctaccgtttttattaaatcagatgaataagttttactatttttaggtacaaacttatgaattttcgcaccttgtccggtatcaactgaaacagtttcagatatttttactgcatttgcattcgcttcaaacgaatacatcatcaaaattgcaattatcgacaatttcgcaaaattcaaatttgtatattttatgaccatctttcagggattctttaattaccatttctgaattatcagaaaatgagattagccaaatatcatgtttaattcttctattccagaaaaaagagaaacaatcaataacattttcagacttattaatcttcgcaaattcaacaaattcagattgcgctataaccgccatcgattgcccaaaatacttgctggacggctgatatttataaagtgccaactgcgcctgagtgataaacggcttgttcatggttctgcctttcaatgattgttttgaaagcctgattttgacaccataacttcatgcgctcaattcttaaacagaaccgccccgattaatacgggtacggaaacgccgagataaaaataaaaatccatcatttcaaaacctttttcagcagggaaacaaagtaaacggacgcgaggatgccgaatactatccagcctgtttcaagaccgctttgcaggttgtctttcggactgcattccgccaataaaagccttagcggctgaccgtccgacatcttccacaggctgccgttatattccggcctgacaatctgtccgttttctttgattcttggtactaccaagctgaaataaaggttttcagcctggtgcttctcaagacatttatttccgacttggtagtacatgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtttcaggagagagatacagaaagtcccctgttgatacggactggacaacatagactttctgcattcaatcagcctttcttcacgagttgaaaaccgatgactttcagtttttgggttttgcccgtagtgacgatttctacgttcaggtttgcttcgatcggaaattgggcgtttcggaactgctcgaaattggcagagccgccgaaatcgtattcagtagtagagctgcccaatgcgttgccttgggagctgtctaagggtgtggcgacaatcaggcagcaatagtcgaagctcttgccttcgatttgtccgttgatttttttaacgccgacgatgtggccttgaagttggatgttcattttttggtttccttgtgtgattaaacgtctttcgggcagacactttaagcccatgaaatcggtagtcttgcgaatttgtcgtaaatgaagttgttatagctttcttcattgttgacgtgtttttgctgttcaagctgtttttcaagattctcgtaatattcgtacatatagtaagggtctttgtacggtttgaatgcgggctgttcatgaatggcttgagctttcaaaaaggcgcagtcgtaggcttcgggagccaaagacttgggcagcttgtgatgactcggctcaatcagttcaaacagtttggctttgtccaattcgggaaaaatgaatttcagaccgtttgccgcacgtccgaactgtttttttacccattcaaggtagcggtcggctgaaatgaccttatcttccttaaccgcgtgtatgcgcgttgccttttgggcgaatcgttcgcaaatcggatatgcgccgccgaaatattcgcccggattctgcaaaacttcgaaagggataacgatgtcttttgctttgaattcaatttcaaatcgcgtccatgtgcttgttttatcgcccaactgcttgcctttttcatagacgcggacatatttggacgattcacgggagccgataccataggtcttgcctttggtcattttggcttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgcgaaaagtcgtgattcccagccttcttttgcgacgccgcaaccggtgccggtcagttcgaaaagaatggtattttgttggccgccaaaatggacgcgaccgtatagggcgtcttccgaacccatcaaccaacagcgctcatagaaacgaccgcccgaacctttggattctttgtagataccgaaaccgaaaacttcttcggcgagcatggacgcggcgcgaataaaatcttcgtcttccaaaagacttacacgaacgccgtatttatcgaaaaaggttttttcatgaaatgaaaagctaatttgatcaatgaaagccgaatctgatacaccgcgccgaagaggaacgcctaacaggtttcctttaccgtccgttatgtacgtttcgtaacattcgaagacttcctgaaccctgcctgccgtttcggtttctgtccccccctgttagataaggggggaagatttgaagcggttgtcggcttcctgccgtccgctagcgcgtccgtcatcacgccggcaaccgcctttgtcatcccttgcttatcttccatggtgcgaatcctcaaaaacgggcaaaaaaaagccctgttacttgtagaaagtaaaggacgttaatttttgttaatcgtcccttcttagggacgcaatatataagggacgcaatatataaggttttaaaacgctaagaacaaaatccgataacggctctgaagaagtaagtctttctttattgcacaagatagcaaacttccacggcattctcgccccacccgtgccgtccaagcctttttcaaagacatagatggttttcttggcaatcacttcgtcagtttggcggtcgataatccgtatggtcgcacctgccacccagtgcctgcgcagcttggaatcgacattgttttcgaacgttaccgcataacgggcggggtgtatatgattaaatatttgatttagcggaaaaatctttacctgaataccgaataatatcggaatggttgggttgcaggacatccacatagcggtattccccatcgctaaaaaatcctaggaaacgagcaataaaatttacgccttcgctggtctgtaaagccgcattgtcccacatcgggtctctggtttttgcatctgccgaaacggtacgctcaggtactaccttcaacagcataatcccttccacattgtccgccgtctggtaaatctttcccccgccgttttgcattgttcgttaaacacggcttcggcttctttgtattttctgtcccactcttcttgtgcctgtatttcttctttgatcgggccgaattgtttgggaataatccaaacaaacagcatcaggatagcggcggcggtcaggctgcctgaaaggattttgccggggttccgtttgggctttttataggcaaagcggacgagaaaccaaagcaacagcagcatggtgccccaatagccgattgagaataggatggccaaaccttctaggaaatggcgtaaatcgtttgtggtaaacatgggttgttcctgtggttaaatgtgcaggctgctttttgccgaaccttgccgcatctcaaaagcagcctgcgcttcagcgttgcgttacgcagtaaaataatgaatatttgtaacgacttgggtattttttgtcaatattcccgcctttcccttaacagctgccgcgctttccgttaaaattcctttacatatttatattgtttcctgtttctatattgccaaggttatacccgttatgtttttctccgccctgaaatcctttctttctcgatacattactgtatggcgcaatgtttgggcggtgcgcgaccagttgaaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggcggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggctacctatacggtgggcggtgtggtgcaggctgcccaaaaaatgatggtgattgcgcccgatgacgacaaaatggacgtggaagttttggtattgaacaaagacatcggttttgtggaacagggacaggatgcggtggtgaagattgagagctttccctatacgcgctacggttatctgacgggcaaggtgaaaagtgtcagccatgatgcggtaagccacgaacagttgggcttggtttatacggcggtggtgtcgctggacaaacataccttgaatattgacggcaaagcagtgaatctgacggcgggcatgaatgtcacggcggagattaaaacgggtaaacggcgggtgctggattatctgttaagcccgctgcaaaccaaattggacgaaagctttagggagcgataggcggatccgtactgggcatttgttatccgccggttcggacatgcagactgcctgaaaccattgcccggatgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccgacctggatagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggccgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataaagcaggctgaaacggttatgaaattcccaaagcagcctgcaccccgtttcgaaagtgcaggctgctttgggattgatccgatattttcacattctcattgcctttaaataaagcacagttaaaaacacatttaaattaagtgcgaattaattcaaatgtatattcaattaaaatcaaaataggacagtagtgcatcgttaaatcgggcgtaatcagacaatacggttcgcagataccgcttaatattcgcccaaaccttctcaatcgggttgagctcaggtgaataaggtgcaagaggcaataccttatgtcccaatttttccgccatttcccgtaagacacccatacggtgaaatcgtgcattatctaaaataatcaccgatttttgagtcaatgcgggcagtaggcattgctgaaaccacgcttcaaaaaagactccggtcatcgtattttgataaaccatcggagcaatcagccggttgccgacttgtgcggacaccagagataagcgtcggtatctttttccacttatctgcgctttcactatttgccctttcaggctgcgggcatagggacggaacaggtggcggtcaaatcctgtttcatccaaataaacgcgttggtagtcagaaaattcggccggctgtgtcaaataatgcgttactttggccgggtcttgttctttgtaagtggtggtctttttttgcgcgttatccccatctgtttgagtgcatagcaaacggtggctgccgtacaatcaaaatgtttggcgatttcatgcagataggcatcctggtgttgcccaacatattgagccggtttttgcctatccgatttgacggcatttagaccggtaacttgatgttttaggctgcctgtttgttttttaaggcgaatccacaggtaaagtgtgtttcttgacaagttaaacgttgctgcggtttggctgatgtttttgcattgttcgtaatatagtggattaaatttaaaccagtacggtgttgcctcgccttgccgtactatttgtactgtctgcggcttcgtcgccttgtcctgatttttgttaatccactatagtttaaagctttgtttcttaagtccgcagagtatgccatggttagaccttcaaagttgagtattgtactattttgtttttaattgactatgcaacaaaaaatagcaaaccccggcaatcaaaatgccgtctgaagcgttattcggctttcagacggcatttttgtatttaaagccgggtaacgctcaatacgcctttgacgtcgccgaggctggcgaggacgcgcgggaggtcgttgacttgtttgacttcgagcgtgaacctcatgctggcttccaagtcgcgggactgggtttgcacggcggtaacgttgagtttgtggcgggcgagcgcgtcggatacgtcgcgcaaaagcccggagcggtcttgggcgcggatttcgatatcgacggcgaatacttgtccttcctgcaatgccgcccagcttgcgtccagcactttttcgggcgcgtgttcggcgaggtgttggaaagacgggcaggttttgcggtgcactgaaatgccgcgctcgcgggtaacgaagccgataatatcgtcgggcggcgcgggtttgcagcatttggcaagcgtggtcatcagaccgtcttcgccgtcgatgagcacgccgtttttgccgccttttttgattttggactgtttgacgatggtggtttcgctgacgggtacgggcggcggttcgttcagcgtgccgcaggctttttggatggcgcggttggaaatttcgccttgtccgacggcggtgtagaggtcttctggctttttgtagccgagattttcggcaagctcttgcaggttgggtttgggcgtgagtttggcaagctgtttgtcgagttggacgcggccttcttcgcgcacggtgtcggcgttttgctggcggatgtaggcgcggattttgccgattgccttgttggatttgacccagccttcgtaaagccagttgacggaaggatgcccttctttggcggtaatgatttcgacgcgctgtccgttttcgagcggggtggacagcggcacaatctgcccttcgactttcgcaccgcggcaacggtcgccgatgctgctgtgcagggcgtaggcgaagtcgatgggggtcgcgcccgtgggcagggagaggactttgccgtgcggggtcaaaacataaatcgtgtcgttgaaaagctcggttttgaaggcggcggcgaggtcttccttgccgctttccgccatgttttcgcgccagtccaagagttggcgcaaccaggcgattttctgttcgtaggcggaatcgcccttgccgccctctttgtaacgccagtgggcggcgacaccgaattcgttgaattggtgcatatcgaaggtgcggatttgtacttccacgcctttgtcttccgggccgacgatgacggtgtgcaaacttttatagccgttgcctttgggattggcgatgtagtcgtcgaactcgccgggaatgggctgccagaggctgtggacgatacccagcgtggtgtaacactcggggacggtatcaaccagaattcgcacggcgcggatgtcaaagaggccgtcgaagctgagttttttcttcaccatttttttgtaaatggagtagatgtgtttcgggcggccggcgacttcgaaatggacattgtatttcttgagttcaccgcgcaggatgttgaggaagttttcgatgtattcgaggcgttcggtgcgtttttcgtccaaaagcagcgcgatttcgcggtatttttcgggcttttgatggcggaagcccaaatcttcgagctgccatttgagctgccacacgcccaaacggttggcgagcggggcgaagatgtcgagggtttctttggcgacggcgcgtttttcggggctgtcgggggcgttgcttaaaaattgcagggtgcgcgtacgcatcgccagtttgattaacacgacgcggatgtcggtaaccatcgccagcagcattttccgcatagtttctgcctgctgggcgcgttcttccggcgtggcgaggctgtccacccgggcgaagtgggtgagtttctgcacttcgtccacacctttgaccagctcggcgacggtactgttgcagcgttcggaaaccaataggttccagtcggggacgtagcgtccgatgtcggcaagcagggtggcggcgacggcatcggggagcaggtcgagttcatgaaccatttgcgccgcgccgaggaagtggtcgggcagcggctcgccatacggcgtggcggcatcggcggggtaatgttcctgcgccagcaaccatgcggtaccgatgaggtttttatcgttgtccggcagagc

SEQ ID NO: 80 - DNA, 5669 bp, Neisseria meningitidis
ccaggcttgggtctgcaccatgttgttttcctaaatattgctgcctttgaaaaactttaaaaccgccatcgaaatcaccgccgccggaatcgacgaggcaaacgtcagcccgactttcaaaccgaggtaaacattggacgcagtaaaaattacagtgatcaatgcaccgagtatcatgcctcggagcgtcagctcgcggtattcttctaccgaactggataaagatttattcattattcttcctttgacaacagacgttcacatattgttggcatcacgccatgatgtcaagttttaaaaagaacagttaaaaacagttatcccaccctgcctcataccccattgaaaataaaaactatttttaaacaaataaaaacagccgtatcaaggagattccccgatacggctgcttgtttccgaaccttaaaatcaatcaaacaaatcgcgcagcttgtctaaaaacgatttcttgcgcggtgtttggttttccaagccggtagaaatccgctcaaattcttccaaaagctctttttgacggtcggtcaaattgacaggcgtttcgacaacaatatggcagtacaaatcgccggtcgcgctgctgcgtaaagatttgacacccttacccttcacgcgcatcctcctgccggtttgggtttctttggggacggtgagcttgacctttccgtccaaggtcggcacttccaactccccgcccaaagcagccgtggcaaaactgatcggcagttcgcaatgcaagtccagaccgtcgcgttggaaaatcttatgcgcccgaatgcggacggttacatacaagtcgccggcaggcgcaccgtgcatacccggcccgccttcgccgctcaaacggatacgctgcccgtcatcgataccggcgggaatattgacttccaccgtcttgaccgccttattccgccccgcgccacggcatttgacgcaaggttctttaatgtgtttgcccgcaccgtggcaggtcggacaagtctgctgcatacggaaaatcgcctgctggatgtgcaccgtacccgaacctttgcaagtcgggcaggtttccggggatgtccccggtttcgcgccactgccgttacagacatcacacgcttcataagtcggaatattgatgcgtttcttcacaccttttgcggcttcttcaagcgtgatttcgataccgacttgaacgtcctcaccctgataatcaggctgggcgcgccccgaaccgcctccaaacatttggctgaaaatatccccaaagtcaaaaccctgcgcaccgccaaatccgccaaaccctccgaagcccccctgtccgccgccttcaaacgccgcatgaccatactggtcgtacatagcgcgcttttccttgtcggacaaagtttcatacgccttttgtacttctttaaacttctcttccgcctctttattgtcaggattgcggtcgggatggtatttcatcgccaatttccggtaggcttttttaatctcatcatcggtagctgttcttgccacacccagcgtcgcataaaaatcttgattactcattttttcatctaattcaaaataaaatcacggctcaaaataagggcaattgcgcaaaacacaagacaaacagactgccatagcttacaaactgaaacggaatacacttttcagacagcataaaccgatgccgtctgaaatcttcaggtatgcacgacacaaaaacttagataggcataaaaccaaccgccatgaagtgtttttgttataaaaacgccgcccgaacgcatgttcagacggcatttgatgcggctgcagacttccccctattttattttttatccgcgggcagcactggtttggctgggccttttggtgcgggcgcgccgacggaagcctgatccttcagcttcgccagcaccgcagggcctatgcctggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcacatcttcaattaaccttccagcaccgggcaggcgtcacaccctatacgtccactttcgtgttagcagagtgctgtgtttttaataaacagtcgcagccacctattctctgcgaccctccggggcttacggagcaagtccttaaccttagagggcataccttctcccgaagttacggtatcaatttgccgagttccttctcctgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcgtcacttctcggtgttaagaagacccggatttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgcaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttcggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgctactgaatgtaagtcgttgacccattatacaaaaggtacgcagtcacaccactagggcgctcccactgtttgtatgcatcaggtttcaggttctgtttcactcccctcccggggttcttttcgcctttccctcacggtactggttcactatcggtcgatgatgagtatttagccttggaggatggtccccccatattcagacaggatttcacgtgccccgccctacttttcgtacgcttagtaccgctgttgagatttcgaatacgggactgtcacccactatggtcaagcttcccagcttgttcttctatctcgacagttattacgtacaggctcctccgcgttcgctcgccactacttgcggaatctcggttgatttcttttcctccgggtacttagatggttcagttctccgggttcgcttctctaagtctatgtattcaacttaggatactgcacagaatgcagtgggtttccccattcggacatcgcgggatcattgctttattgccagctcccccgcgcttttcgcaggcttacacgtccttcgtcgcctatcatcgccaaggcatccacctgatgcacttattcacttgactctatcatttcaagaacttctttgactttgcctaacattccgttgactagaacatcagacttgaatttcctactttgataaagcttactgctttgttgtgtcttaatcctgccttttgtgtttcaggattaagtcgatacaatcatcacccaaatactgtgtttgttttcttttctcttgcgagagatttttatcctttgcaaagaataaaaaatcaaaacaaacgctttgtctttgtttgttgatttcggctttccaatttgttaaagatcgatgcgttcgatattgctatctactgtgcaaatcaaatcgagctg

SEQ ID NO: 81 - DNA, 9243 bp, Neisseria meningitidis
catgctgaacgtttggctgacataaagttaaatgagtcagtccgctataattgatgaaacgggttaaaaaagtgttgccatcgcctgttcttcttgtcggatacgcttaaataagaccagcaaataaatgggcaggccaatcaataaaacataccacgcttgacataataaggcgatgccaatcagttcgggtatgatgtttaaaaaataattggggtggcggaatgttttaaacaaccacgaacgattaatttgatgatttggtaaaatatagattttaaccgtccaaatctcccccaactgcttaataatcaatgacaatatcacaaacgaagccatcaccgtcagcgtaccaatcaaggatatgccattaaaagcagtgtcagaaagccatacccaaacaaaacacgccaaataataaagcgtatgaactgccgcaagcagcgtggaattggtttttccgtattgtttcgcccctttggcaatcaaggctttttcatgtttaatagagacggctaaaaataacagtctgatgataaaaaacaggcttaaaatgcttaaaatcattgtcattgatgtttttccattgaaattgaaataaatataaatcggattaatggtatttttaattaatgatgtttcagaccatcatgctctataaacaattcccattaagtccgcgccgcaacctgctataataagtctgcaatcggcgcaaatcaatgctttgcgtttattgccatcccaaaataattgatgctgccttaattataataccaagataagtttttttattcaataaaatacaaagggaagcgttcagcccattgcaaacagatgcaatccaccgattatttaaaaaacggcaaagccttgccccccttgcggcaagcctgcaatgcctttaatgtccgcaggcgcaagcgtcgccgtggtgcccgcaaccctgtgccgtttcgagccattcgtcgtcatcgccgtcaaactcttccacttcgtcaaactcgccgcgttccaccatgacgcacaactcttcaaggctttccgcgccttccacccaaaaacagggaatgcccggcggcatatcgggcgcaagcagtgccgctacgccttcatgccacgcaatccaatagccgttgtccgtacggacgaattgtgcgttttcgttgaccgactcgccttccgtaccttccagcatacgttccgcaatgtccggttgaaaagataaaatctgcataagtgttcctttatatgatggttttccgtcaaaacaaggtgttatagtggattaaatttaaaccagtacggcgttgcctcgccttgccgtactatttgtactgtctgcggcttcgtcgccttgtcctgatttaaagttaatccactatattttaaaacatcgcgcccgcttgagaaactgccaaccgctttataacaaattcgtctttgcaccaaactttccattctttccgtttttcggacggcatcgttaaagtagtccttccttttccttattttcagcattgttttatgttagcgctcaaaacgcccggcgtactgcccggcttcaaactcagccttggtctgaccgtattgtgcctgtcgctgcttgtggtcttgccgtttgcgatgatggcggcgaaggcggcggaaatcggctggggcggcttttggaacacgattgccgagccgaacgtgttggcggcggtatggctgagcttgcggatgtcgttttatgcgatgctgaccaatgtcgtgttcggcacgctggtggcgtgggtattggtgcgttatgaattcccgggcaagggtctggcgaacgcgctggtcgatttgccgtttgcgctgccgacggcggttacgggtatcgcgttggcaaccctgtatgcgcccaacggttggataggccgttttttcgagcctttgggcatcaaaatcgcgtttacacccgtcggcatttggattgcgctggtcgtcgtcagcctgccctttatcgtccgcgccgtgcagccggtattggaagaattgtcgggcgaatatgaggaagcggcggcaactttgggcgcaagccgttggactacgtttcgccgtgtcctcttgcctgaaatcacaccggcactcttgaccggcgcgggaatgatgtttgcgcgggcaacgggggaatacggttcggtgatttttatcgcgggcaacattccgatggtttctgaaatcctgccgctgattattacgggcaagctggaacagttcgacgtgcagggcgcgtcggcggtggcgttgtttatgctgctggtttcgtttgtgattctgtttgcgctgaacgtgatgcagtgggcgttgggcaggcgttcgggcgcgaagggttgaggtcgtctgaaatacctgttaccgtcattcccgcgcaggcgggaatccattggtgaatttcggctgccttatttattttctgttttcctgttgccctgcggtggattcccgcctgcgcgggaatgacggtagctagacgtttttattcccttaatcaataaaaggttgtctgaaaacgaatccgccccacaaaaaacggtttttcagacggcatccaaacattttaaaaccaaccagagaacaccaccgccatgaaaccctattccgccaatcccaacctgaccgaaccgcgccggctgcgcgtgttgctgattgccgccgcgctgggctttctgctgctgatgctggtcgtgccgctcgtcgccgtgttttacgaagccttaaaaggcggttgggatttgtacctgaaatccttaaacgatcccgaagcgtggtctgccatcaaattgacgctgattaccgcgctgattgtcgttcccgtcaatgccgtattgggtgtggcgatggcgtggctgctgacccgttttgattttcgcggcaagcagttgctgaccaccctgctcgatttgccgttttccgtatcgcccgtggtggccggtttgatgttcgtcttattgttcggcgcgcatacggcattgggtggctggctcgaagcgcaaggcatacagattatcttcgccatccccggtattgttttggcgacgctgttcgttaccttcccctttgtcgcacgcgaaatcatcccgctgatgcaggcacagggcgacagcgaagaacaggcggcattgatactcggcgcaagcggctggcagatgttttggcgcgttaccctgcccaacatcaaatgggcgttactctacggcatcatcctcaccaacgcccgcgcgatgggcgagttcggcgcggtcagcgtggtatcgggacacatacgcggcgaaaccaacaccgtcccgcttttggtcgaaatcttctacaacgaatacaacttcaccggcgcattcgccctctccggcgtattggcacttttggcactggcgacgctggcggtgcagaacatcattaccaaattacaagacaaaaaactcgccgccgccgaaaggaatgcaatatgagtatcaccatccaaaacttaaacaaacacttcggcaattttcacgcgctgaaaaacatcaacctcaacgtccccaccggcaaactcgtttccctgctcggcccgtccggctgcggcaaaaccacacttttacgcattatcgccggactggaaaacgccgacggcggcaatatcctgtttgacgggcaagacgtaaccgccaaacatgtgcgcgagcgcaaagtcggcttcgtgttccaacactacgcccttttccgccatatgaacgtgtttgacaacgtcgctttcggtttgaccgtattgcccaagtccgaacgcccgtccaaaggacaaatccgcgccaaagtcgaagaattactcaagctcgtgcagctctctcatttggcaaaatcctatccgcaccaactctccggcgggcaacgccagcgcatcgccctcgcccgcgcgcttgcggtcgaacccaaactcttgcttttggacgaacccttcggcgcgttggatgccaaagtacgcaaagaattacgcacctggctgcgcgacatccatcacaacctgggtgtaaccagcattctggttacgcacgaccaagaagaagccctcgaagtttccgacgaaatcgtcgtgatgaaccacggcaaaatcgaacaaaccggcagcgccgaagctatttaccgcaaacccgaaaatgccttcgttaccgagttcctcggcgaaaccgacgcttttgaaggacgcatcgaaaaaggcttctggcattacaacggcttcgcgtggaaattggacgcgcaatacaaatggcaggaacaaaccgccaccggctatatccgcccgcacgaatggcagatcgccgccgaacacgaaacaccgatgatttgtgccgaaatcgaaaaaatccacgccgtcggcgcattgacgcatattctggtaaaacacgacaaacaggacgtacatatcacgctggcaggcagcgatgccgcgcgttacccaatcgccgaaggcaaagaattgaagctgattccgaaacaggtttatgtcttctctcaaaacgaactgattgaatattcgatttaaccatgaaagcgcaatgccgtctgaaaggctttcagacggcattgtgctttcaagcgtcaggcaagaaacagcttgtacgcggcattttgcgtttcctcgtgatagctgtatcccagactttccaagaaaccgtcaaatgcggcggcatcgtgcggcggcacatcgataccgaccaaaatccgcccgtaatccgcaccgtggttgcggtaatggaaaagcgtaatattccaccctccctgcatatggttcaaaaagcgtgccaatgcccccggacgctccggaaactcaaaactgaccaaacgctcgttttctactttgtccgtccgccctccgaccatatagcggatatggattttggcaatctcattgttggtcaaatcgacattgggcaatcccgcctcatccaaccggctgccgataaccgccaaatcctgcgggcctgccgcttgaagtccgacaaagatatgcgctttttcatcgtctccgtagcggtagttgaactcggtaatattcctatttcccaatatattgacaaacttaaggaagctgccgcgttcttcagggatggtaacggcaaaaataccttcgttgccctcgcccaattcgctccgttccgaaacgtggcgcaaacggtgaaaattcatattcgcaccgctggtaacggcaatcagggtttggttttccgcgccttctcgggcgatataggctttcagacccgccaacgccaacgcgcccgccggctcggtaatgctgcgcgtgtcatcgaaaatatccttgaccgcgccgcaaaccgcatcggtatcgactgtaatgatttcatccaaaagttctttgcagaggcggaaggtttcgtttccgacgactttgaccgcagtgccgtctgaaaacagcccgacatctttcaaatggacgatttcacccgcttcgaccgactgcttcatacagcaggaatcgttggtctgaacgccgataactttgatttcgggacggacctgcttgataaatgccgccacgcccgccgccaaaccgccaccgcctatcggtacgaatacggcgcggattggatcgggatgctggctgacaatttccatccccaccgtcccctgtcccgcaatcacatcaggatcatcaaacggcgcgatataggttaacccttctttttccgccaactccatcgcataatcgtaggcatcgttgtatgaaacgccccgcaaaaccacctcgccgccatggcttttaaccgcatccactttgattttcggcgtagtctccggcataacgataacggcacggcagcccaaacgctgtgcggacaatgccacgccttgagcatgattgcccgcgcttgccgcaatcacgccgcaagcgagcgcatctttcggcaacttggacattttgttgtacgcgccgcgtattttgaacgaaaaaaccggctgcaaatcttcgcgtttcaaaaggatgttgtttttcaaacgtacagaaaggctgcgtgccggttccaaaggcgtttcgaccgccacatcatagacagatgccgtcaggatgcggatgaggtaatcggaataaggaaggggcgtgttcataattcaatatgggataatcggtttattaaaatcgcaaaacccaaaaccatacgcccaagacggcgcgaaatcaagaaaaatccgcccgatcagacaccctaagcgtataatcggcagactgaaacacgcacacaattagaatatttcatgacagcacataaaatcctgcccgtcctgctttccatcatcttaggcgtttctcacgcaacggctgcatcgcccgcgcccaacagaccgacggtacacgccgcccccacgttccaaacacccgaaaccctcacagcggcacacatcgttatcgaccttcaaagcaaacagattttatccgccaaaaacatcaatacccctgttgaaccggcggcactaacccaactgatgaccgcatatctggttttcaaaaacatgaaatcgggcaatatccaatctgaagaaaacttaaaaatacccgaatccgcatgggcttcagaaggaagcagaatgtttgtacgtcccggcgatacggtcagcaccgacaaactcttaaaaggcatgattgcactatccgcaaacgatgccgccctaacccttgccggccggctgggcaacggctcgattgaaaattttgtgcaacaaatgaacaaagaagcccgacgcttgggcatgaagaacactgtattcaaaaacccgacaggcttgagtagagaaggacaggtttccaccgccaaagacctcgccctgctgtctgaagcattgatgcgcgactttccggaatattacccgctgttttccatcaaatctttcaaattcaaaaatatagaacaaaacaaccgcaatatccttttatatagggacaacaatgtaaacggtctgaaagccggacacacagaaagcggcggctacaaccttgccgtgtcatactccggcaacggcaggcacatccttgtcatcacattgggttcggaatcggcggaaacacgcgcatcagacaacagcaagctgctgaactgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaggaagcgaaaatggcagaacaaattctagaaaccatacagccgattcccgccccagtaaaaaaagggcaaattttaggaaaaatcaaaatcagacaaaacggatacaccattgccgaaaaagaaatcgtcgcactggaaaatgtaaaaaaaagaagccggtggcaaaggctttgggcgtgtctgacagggcagtaatctgccgtttcaaatatcccgtttttccaacaaataaagaaatgccgtctgaaacacggttcagacggcataaaacaacagggcggtacgtattgcatacgcgccgccctgctgctgaaatcaattagcgtttcttaccggtaacggtagcaacagccagattttcgttacgtttcagggaaacgctttctacaccttcaggcagtttgatgtctgacaagtgcagaatgtcgccggcaaccacttcagcacaatccaaatccaagaaagcagggatgttggcaggcaaagcaactacttcaacagaagtgtttaacagagatacgcggccgccttgcagtttgaccgcttgggaattttcagcgttaacgatgtgcaggggaacacggatgcgtacaagttgatcggctttcacagcttggaagtcgatgtgttgaacttcgcggcggaacgggtgcatttggaaatcacggacgataacgtctttggtttcaccgttcagagacaacttaatcaacgcagtatggaaagattctttttccaatgcgtagaatacggttttgtgatccacagcgattgcaacaggctcttgaccttcaccgtacagaatgccggggatttggccttcgcgacgcaggcggcggctcgcaccagtgccttgtgcttcacgaacagaggcttgaatttcataagtcatgttaaatactccaagttaggtaaaatcgccgtcatcggccgcgaccagcttaagacggcttcgggcttatggcagcaacatgctgcctgtcatcacttcttcattgaaaagatatgagacggattcttcattgctaatgcggcggacggtttcggccaacagaccggcaatcgttacctgacggatacggtcgcagtttttagccgcttcagacaaaggaatggtatcggttacgaccacctggtcgatttcggatgaggcgatacggctgaccgcctctccggagaatacggcgtggctggcataggctagaacacgttcagccccccgctctttcagggcgacggcggctttgcacagcgtatttgcagtgtcaatcatatcgtccacaatcagacaggttctaccttgaatatcgccgatgatgttcatgacttccgccacattggctttcgggcggcgtttgtcgatgattgccaagtcggcattcagggattttgccacggcgcgggcgcggacgacaccgccgatgtccgggctgacgacggtcagattttcaatccgctgttgtttgatgtcgttcaacagaatcggggtggcataaatattgtccaccggaatatcgaagaaaccttgaatctggtcggcatgcaaatcgacagtcaaaacacggtcgatccctgccgaatacagcatatttgccaccagtttggcagaaatcggaacgcggacggaacgcggacggcggtcttggcgcgcatagccgaaatacggaatggctgtggtaatacgacctgccgaagcacgcttcagtgcatccgccatcgtcaggatttccatcaggttgtcattggtcggcgcacaggtcggctgaaggatgaaaacatcgcgcccgcgtacgttttccaacagttcgacggcaacttcgccgtctgaaaacttggatacggaagcattgcccaaagaaatgtccaaatgcctgacaacacgttgtgccaattcgggattggcattgcctgtaaataccatcaaactgtcgtacgcagccatattctcacctgattttatgtttaacttccgctcagaaaacacaatgcttc

SEQ ID NO: 82 - DNA, 529 bp, Neisseria meningitidis
gcaggtcgactctagaggatccccagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatgaaaacctgctgccgtttaatcatctactgatgattacttaggcaaatgtgcccgtccctcccttttcagacgacctttcattgcggaaaccgccgcaaaggttgtctgaaaaccgttttccatccccgttttacaaacaaaccgaaagccccacatgatctctttgaaaaacgacactttcctccgcgccctgctcaaacaacctgtcgaatacacgccgatttggatgatgcgccaggcggggcgttatctgcccgaataca

SEQ ID NO: 83 - DNA, 7919 bp, Neisseria meningitidis
cggcgaagcgcgccgcgaaatcgccgactttttaattgatgccgccgccttcaggcgaaaaatgggtcttgaacggaaagccggtaatgttgtcctatccgaaatgttccaattttgagcagatcaaacagggttcttatgtcggttcgacggttttaattctgttcgtagtcatttacggcttcaggcttttgattaattttttaaaagacatgggcaaggttgggattgattgatggttattgatttttggtttcttctcggtttcttcttggctttgtctgtcgctttgatatttaaatgacgtgttttaaaatcaggctttcaaaacaacctttgaaaggcagaacaatgaacaaaccgtttatcacgcaggcgcagttggcactttataaatatcagccgtcaagcaagtattatggtaaaacaatggcatatactttcgctagtgagcttttggattattcaaaagttaataaatttataattcatgaagaaatccaatgttttttaaatagaaggatttctaataatatttggaaaatttatttttctgatgagtctgttgcgtatataaaaattttagaattacaggatgattatagtcgtggaattgaaattaaaacgtttgattttaatcctaatgttggggatgttttcggttaattcttatgctgaacgttttaagtatcctattggaaattcagatgttagattggatattgatcataaaaaatctgtagttaccgattttcgtgttgatggtcagcgtttttcaggtcgaattatcgaaccttcaataatagaacacgtgccaacaggtgcacgctctcttgaaaaagtccccgttaaatttaccgcatcagtttcccgcgccgccgtcttgtcaggagtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatcgttgcacatttaattggaatggcggagattgtttggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctagcaggcgcagcaccgccgggcttcagtaacttgtaccaaggcagggggaggacgtccagaaagatttgtaaagacggctttatcgtctttataaatctttttggataccccttgccgccccgccaaaagaacacattctgccgcaagggcaggtggtaaggcgcgcgccttttgcgccgtccccatgcccccgcggcgtcgcaagtgagactagggggtgtgggggactagtcccccgcaaagcgttcagcttcggaaactttggccgaaaggcaggcgaagcagcgcactttgcgacgaatgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatagcaaatgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataaatggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctttatccatcctcgaaattgaatatcatcctagccgtatcaaggctgtataaataaggaaaataccaatgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataaaattcaacaaaattaaacggttacgcgaatatatttgtgtaaccgtgcatttgcatatcgtaaataaacgtaaataaaaataacaatataaatcagtatattgcaactttgttttttattttgtgttgacgggcaacatatcatctgcgcgggaatgacgggattttaggtttctgattttggttttctgtccttgtgggaatgacgaaaagtggtgggaatgacgaaaagtggtgggaatgacgtttcagttgctgcggttattgtcaggtttcggttatgttggaatttcgggaaacttatgaatcgtcattcccgcgcaggcgggaatctagaatttcaatgcctcaagaatttatcggaaaaaaccaaaacccttccgccgtcattcccacgaaagtgggaatctagaaatgaaaagcagcaggaatttatcggaaatgaccgaaactgaacggactggattcccgctttcgtgggaatgacgggatgtaggttcgtgggaatgacgaaaagttgcgggaatgacggaaagtggcgggaatgacggaaagtggcgggaatgacggaaagtggcgggaatgacggttcgggcattccttaaattacccgtgtatcgctgtaaatcttagagatggcggaatatagtggattaacaaaaaccagtacggcaaggcgaggcaacgccgtactggtttttgttaatccactataattgaaggggttatcggcttgtgcaacggaagcccaagttgtgcaagacatatttggattgcaggctggtacggatgccgtagcggaggaaggcggcatagttggacgagtcgctcgacccgatagacgcgccgctgcaaaacatttgcgcgttggcattgccggaagaaagcaggctgctgttgaaatcttccgtccattcccaaatcagcccgtgcatatcataaacgccccagtagttcgggcggcctttgccgacatcgtgcaggcctttccgtccgccgtcggcataccaatcgagaatagtgcggttgtagccgggttcgtttgagccgtttttctgcgtggcggaagcaagtccggcaaattcccattcgtcaatggtcggcaggcgtttgccttgtgcggcgcaataggcgttggcggcaaaccaggaaacattggttaccggttgttttaattcgcccgccttcggcgcatagctgcggctgccgtttttcatccaatgcttcaggtaagcgggttctgcctgtttggaaccgatcctgcctttttgccattgggggtggctgttgacaaattcggcaaactcggcattggtaacgggatatttatccagtttgaacggtttgactttaatcaggccggtatcttttttcagataaagcgggcggtagctgccgccttcgatttgaaccatttcggcagccgccgcttgagtgccggcgagtgccgcgccgaggaaaaataaccggacatacttcataaagcctcctgacaggcggttaaaatcaatcttccgaaaggaaagattggttgttaaaaaaccaccgccgtgcgtaatgaagtacagcggcagtggttcgtcccgctaatgacgggtatccaatttaataaacgcttttttcggatgcagaggctgccggggcagaagctgcgggagcggaagcagcaggagctgcaccgttaccggcgtaagcggtatcactcaatttttgagtcatgatttcagggttttctgcaccttctactttcaattgacccagtgcgcctttgttgaatgcgcggaagatagagtggtcaaccaaagtgtagctgcccgggatgtcgactttgaattcgacgatggcagagccgccggcaggaacgatggtgctttgtacgttttcgttaatcagtttgccgccttcaacataaactttgtcgaagatttcgccgatgacgtggaaggaagataccaagttcggaccgccgttaccaacgtacatacgtacagtttcgcctgctttggctttcagcgcgttatcgccggcgatagcacctacgtgaccgttgaatacgacgtattcaggctgttcggcaacggctttgtccatatcgaacggttgcagaccttgcgcgccttttttgcctttggtgtagaagtcgccttggacgatgtagaactctttatccactttcggcaggccttctttaggctcgaccaaaatcagaccgtacataccgttggcgatgtgcataccgaccggtgcgacggcgcagtggtagatgtacagacccggttgcagggctttgaagctgaatgtggaagtacggcccggagcggtaaaggttgcggccgcgccgccgccctggccggtagccgcgtggaagtcgacgttgtgcggaacggtagaagaaggattgttggaaaattccacttcaaccgtatcgccttcgcgtacgcggatcatacggcccggaacgtcgccgtcaaatgtccagtagcggtattccacaccgtcttccatggtcatggttttttcgacggtttccatttttacgcggactttggcggggtagtcgcggtcgattgcaggaggcacttcgggagcgtgggtggtaaccgcatcgataacgggcagttcgc

SEQ ID NO: 84 - DNA, 4156 bp, Neisseria meningitidis
gtcgactctagaggatcccctgcggatttattacgatattaccgtattcaggccgcaccgatgccgcctgccccccgaaaaactttggagaatccaaaaaatgtttcattttgcatttccggcacaaactgccctgcgccaagcgataaccgatgcctaccgccgtaatgaaatcgaagccgtacaggatatgttgcaacgtgcacagatgagcgacgaagagcgcaacgccgcctccgagcttgcccgccgtttggttacccaagtccgcgccggccgcaccaaagccggcggcgtggatgcgctgatgcacgagttttcactctccagcgaagaaggcatcgcgctgatgtgtctggcagaagccctgctgcgtatccccgacaacgccacgcgcgaccgcctgattgccgacaagatttcagacggcaactggaaaagccatttgaacaacagcccttccctcttcgtcaatgctgccgcctggggcctgctgattaccggcaaactgaccgccacaaacgacaaacaaatgagttccgcactcagccgcctgatcagcaaaggcggcgcaccgctcatccgccaaggcgtaaattacgccatgcggcttctgggcaaacagttcgtaaccggacagaccattgaagaagccctgcaaaacggcaaagaacgcgaaaaaatgggctaccgcttctccttcgatatgttgggcgaagccgcctacacccaagccgatgccgaccgctactaccgcgactatgtcgaagccatccacgccatcggcaaagatgcggcaggacaaggcgtttacgaaggtaacggtatttccgtcaaactttccgccatccatccgcgctactcgcgcacccaacacggccgcgtgatgggcgaactgttgccgcgcctgaaagagctgttccttttgggtaaaaaatacgatatcggtatcaacatcgatgccgaagaagccaaccgtctggagctgtctttggatttgatggaggctttggtttcagaccctgacttggctggctacaaaggtatcggtttcgttgtccaagcctaccaaaaacgttgtccgttcgttatcgactacctgatcgaccttgcccgccgcaacaaccaaaaactaatgatccgcctcgtcaaaggcgcgtattgggacagcgaaatcaaatgggcgcaagtggacggcttgaacggctatccgacctacacccgcaaagtccacaccgacatctcctacctcgcctgcgcgcgcaaactgctttccgcgcaagacgcggtattcccgcaatttgccacccacaacgcctacactttgggcgcaatctaccaaatgggtaaaggcaaagattttgaacaccaatgcctgcacggtatgggcgaaaccctgtacgaccaagtcgtcggcccgcaaaacttaggccgccgcgtgcgcgtgtacgccccagtcggcacacacgaaaccctgctcgcctacttggtgcgccgcctgttggaaaacggcgcgaactcgtctttcgtcaaccaaatcgtcgatgaaaacatcagcatcgacacgctcatccgcagcccgttcgacaccatcgccgaacaaggcatccacctgcacaacgccctgccgctgccgcgcgatttgtacggcaaatgccgtctgaactcgcaaggcgtggacttgagcaacgaaaacgtattgcagcagcttcaagaacagatgaacaaagccgccgcgcaagacttccacgccgcatccatcgtcaacggcaaagcccgcgatgtcggcgaagcgcaaccgattaaaaaccctgccgaccacgacgacatcgtcggcacagtcagctttgccgatgccgcgcttgcccaagaagcggttggcgcagccgttgccgcgttccccgaatggagtgcgacacctgccgccgaacgcgccgcctgcctgcgccgttttgccgatttgctggagcagcacaccccagcactgatgatgcttgccgtgcgcgaagcaggcaaaacgctgaacaacgccattgccgaagtgcgcgaagccgtcgatttctgccgctactacgcaaacgaagccgaacataccctgcctcaagacgcaaaagccgtcggcgcgattgtcgccatcagcccgtggaacttcccgctcgccatctttaccggcgaagtcgtttccgcattggcggcaggcaacaccgtcatcgccaaacccgccgaacaaaccagcctgattgccggttatgccgtttccctcatgcacgaagccggcatcccgacttccgccctgcaactcgtcctcggcgcaggcgacgtgggtgcggcattgaccaacgatgcccgcatcggcggcgtgattttcaccggctcgaccgaagtggcgcgcctgatcaacaaagcccttgccaaacgcggcgacaatcccgtcctgattgccgaaaccggcggacaaaacgccatgattgtcgattccaccgcacttgccgagcaagtctgcgccgacgtattgaactccgccttcgacagcgcgggacaacgctgctccgccctgcgcattttgtgcgtccaagaagacgttgccgaccgtatgctcgacatgatcaaaggcgctatggacgaactcgtcgtcggcaaaccgattcagctcactaccgatgtcggccccgtcatcgatgccgaagcacagcaaaacctgttgaaccacatcaacaaaatgaaaggtgttgccaagtcctaccacgaagtcaaaaccgccgccgatgtcgattccaaaaaatccacgttcgttcgccccatcctgtttgaattgaacaacctcaacgaactgcaacgcgaagtcttcggtcccgtcctgcacgtcgtccgctaccgcgccgacgaactcgacaacgtcatcgaccaaatcaacagcaaaggctacgccctgacccacggcgtacacagccgcatcgaaggcacggtacgccacatccgcagccgcatcgaagccggcaacgtttacgtcaaccgcaacatcgtcggcgcagtcgtcggcgtacagcccttcggcggacacggtctgtccggcacaggccccaaagcaggcggttcgttctacctgcaaaaactgacccgcgccggcgaatgggttgccccgaccctgagccaaatcggacaggcggacgaagccgcactcaaacgcctcgaagcactggttcacaaactaccgttcaacgccgaagagaaaaaagccgcagcggccgctttgggacacgcccgcatccgcaccctgcgccgtgccgaaaccgtccttaccggaccgaccggcgagcgcaacagcatctcatggcacgcgcccaaacgcgtttggatacacggcggcagcacggttcaagcctttgccgcactgaccgaacttgccgcctccggcatacaggcagtggtcgaacccgacagccccttggcttcctacactgccgacttggaaggtctgctgctggtcaacggcaaacccgaaaccgccggcatcagccacgttgccgccctgtcgcctttggacagcgcgcgcaaacaggaacttgccgcccacgacggcgcactcatccgcatcctcccttcggaaaacggactcgacatcctgcaagtgtttgaagaaatctcttgcagcgtcaacaccacagccgccggcggcaacgccagcctgatggcggtcgccgactgattttgccgaaatacccgggcgcggcccgtgaaccaatgccgtctgaaaacctttcagacggcatttttataatggattaacaaaaatcaggacaaggcgacgaagccgcagacagtacagatagtacggaaccgattcacttggtgcttcagcaccttagagaatcgttctctttgagctaaggcgaggcaacgccgtactggtttttgttcatccactataacagcaaccctgtcgccgtcattcccgcaaaagcgggaatccagtccgttcagtttcggtcatttccgataaattcctgttgcttttcatttctagattcccactttcgtgggaatgacggcggaagggttttgttttttccgataaattcttgaggcattgaaattccagattcccgcctgcgcgggaatgacgattcataagtttcccgaaattccaacataaccg

SEQ ID NO: 85 - DNA, 5532 bp, Neisseria meningitidis
tttgcggatcaacccgcccgcgtagccggtcagtttgccgtcgctgccgatgacgcggtggcagggaatcaggatagatactttgttctgcccgttggcggcggcaacggcgcggacggctttggggttgcccaaacgctgcgcctgctccttgtagctgcgcgtttcgccgtaaggaatcgccaagagcgcgtcccatgcctgcttttgaaactcggtgccaatctgctccaaaggcgtggcaaaggttttcagacgacccttgaagtataagtccaattcctgccgcaaaagttgcgtccgctcatcctcccgaaacacaaaccgtccgcgcaaggctttttggacggcggcaatttcctgttccaaatgcttctgtccgacaaattccagcaaacacaaacccctgctaccgaacaccgccagcatctcgcccaaaggcgtggcaatggcggcacacaccagctcgttcaaactgtcgggataacgcgcttccaacagacggatggcgcggcggatgcggacatattcttcaggcgcgcagccgatattgtcccaaaaatcccgctcgaactgtttggcttcgcattccgtcagattgggatgcggcataacgccgcactcaaaaacccgagattcgagccaatggcggatttcatcccattttgacggcagattgtttaaggaaggcagggtaatcatttgtttgctccgtatccctatcatagatttgacggcaaaatccccaatttttgccattcccgcacgccggagcaggaacgggctatgacgtaaatcttgagggttaggttgcggcaatacctaaatattcgatatttctaaagcatcagagaaaggaatgtttcaacacacaggacgacacataaagcgccgccccatgaaaaatttcagacgacctgcaaagggtcgtctgaaaccacgatttttgcatttgcgcattctggcacatcatccaaccgtttcggcacattcctgccgccgttgacagcctataatgaatccacttattcatcaagcaaaggaatcatctatgcaaaccctcatcctctccgccgtactgctggctttttcaaccgctgcctttgccgggggcgcattcacgctgcaattcgacaacccgtccgaagacggcggcttcacgcaaaaccagcttttgagcgcgccttacggcttttgctgttcaggcgacaatgcttcgcccgcgctgtcgtggaaaaatccgcccgccgggacaaaagtttcgtcctgaccgtttacgataaagacgcgccgaccggactgggctggatgcaccgggtggtcgccgacattcccgccgatgtccaccgccgcaacgcgacctcgctgcaattaagccgctgcgccaacatcgccgaccggactgggctggatgcactgggtggtcgccgacattcccgccgatgtccgccgccgcaacgcggcctcgctgcaattaagccgctgcgccaacatcgccgacgaccagtccgcagccatatcggcggtaatcagtttgcggatttgccgcatcaggttgacgccttcgtacacggcaaaaccgatgccgtcatgctgcaaccacgccaacacgccgcaaagcgcggcctccgcagcattgtgcggcacttcttcatccgccagtaccgcagcctcataatcaaacgccgcgcccatacgcccggaatacggcagctttaccgcatcgcacactgcctgcgccgtcccgtattgtgcggcgaacctttctacggtttcctgttcgaaagcaatccattgcgcctgatagaggccgtctgaatcgggaatattgatgacgtcaaacgtctgtccgcctgccaaggcgaccgccttacccgccgcagcttcttacttccgcgccgcacgataagcacagccggttcatataccgccacgctgcggtacaaggcggtatgatgttgcacgatgccgcctaaagcacccaatcgttcgcgcgtatgaaagtatagtggattaaatttaaatcaggacaaggcgacgaagccgcagacagtacaaatcgtacggcaaggcaaggcaacgccgtactggtttaaatttaatccactatatctcaaacccacgttaggtctaagcaaatggtcggacatccttatccgacagcccatcttcttttcagacggcattgcaaatttaagtttgacgtgcgttcaaaataaggcagttaatgcgaagcgaaattccgtcggcgtacctgcaacttggcccctcccctataggggagggtcggagggagggtaaaacggggcagatacagacaatatttccgttgccgccccgatgccctctccctaaccctctcccacgggagagggaatggattgccgttgaaataaatcgctctacataaaaaatcaatgtgttatctcaaacccacattaggtctaatcaaatggtcggatatccatattcggcaagcaagctgctttcagacggcatttccagccaacaagcgcgccaatatcccctcatacaccgcagacagcttcggaatgtcgtttagccgcacgttttcgttgatttggtggatggtcgcattggacgggcctaattcgataagttcttgcgcaatggctttgatgaagcgtccgtccgaagtgccgccggtggtggacaattcggcctcaatgccgcaggtttcggcaatggctgcgcgtgccacgtcggtcagtttgcccgcttgggtcagaaagggctgccccgaacacgaccactgcaaatcgtattgcacgccgtgtttgtccaaaatggcgtggacgcgttgtttcagccctgcttcggtggactcggtggagaagcggaaattgaatttgacgttcagctcgcccggaatgacgttggtcgcgcctgtgccgccgttgatattggaaatttgaaagctggttggcgggaaatattcgttgccttcatcccagacttcctgcgtcagctctaacaaggccggggcaaaagtatgcacgggattgattgccaaatgcggataggcaatatggccttgcttgcctttgacggtcaggttgcccgacagcgagccgcgccgaccgtttttaatcatatcgcccaatttgtccacggcggtcggttcgccgacgatgcagtagtcgataagctcgtcgcgcgctttcaatacatcgacgactttggtcgtgccgtccaacgcgtcgccctcttcgtcggaagtaatcagaagcgcaatgctgccttggtggttgggatgtttggcaacgaagcgttcgcaggcggtaacgaaacaggcaatgctggttttcatgtctgccgcgccgcgcccgtataatcttccgtcgcgctcggccggttcgaacgggggcgaatcccatttttcgacaggacctgtcggtacaacgtcggtatgccctgcaaaacagacgacgggagctttcgtgccgcgtcgcaaccagatgtttttggtgtcgccgaaatggagttcttcagccgcaaaaccgattttgtgcaggcgttcggcaaggagtttttggcaatccctgtcgtcaggggtaacggatggtcgggaaatcagctctttggcaagctctagggattgagtttcggtcatatttgttcacttttgaaattagaccgtctgaaacgttctgaatgtgattttcagacggcatttaggttaggttggcatacggggtgggtattttacccatcagtcttctgaatcatttgccgtggcaggcttcgtaaagcggcagcaaatcttccaccgtttccgctatccatttcgcgacatcctgcctgcccaaatcgtcgcgttcgatgtgtttgccgatgcagaaaaagtcttcgtcgttttgcaactttcggtcggactcgttttgttgcgcgacggtgcggtagtcgtcgtattcgctttccgcaccgtgccacatatcgaaagaagcgtatttttcggtatcaaaattatccaaccagcggttgtaatcaggcagcgcgatgggggaaacatcggctttatagcagtgccaatccaagctgacgctcagacggcggcggttgagcagtatcgacaaaatcgctgcggaatttttatattgttcgtatttgaagtaggcaaagaaatgggcgcgaacctgccagccgttacaccagcgttcgatgtgcggcggcgcaaacggcgcacccaattcggcggcaacctgctgaatcagctgctgccatatctgccagttttctttatagtcagccttgatttgcggaatgctttcaggctggtattttttaagctgggaaaattggaaaaacgggatattgaacaaatcgcaacttttcggggtcagcataatatatccttgagacgattgtttcagacggcattatttgcgccggcgcgccgccataatttcgccgatttcggtcagtttttcttttgggataaaggtgttgcccatatcaaacagcggctcttcaatcgccaaatgaacatcatatcccgccacaaaacgtttgaacgcttcctcatcggggacataagcgttgtctgcttcgagtttggcaaattcggcggaaacagccgcccagttgtcgtgcagcccgatatgttggcgcaaaagctcgtccacgctttcttgggcttgcggcgcatattgcagcagcagcgggaagaagttttcttcttcgtcttcatggtgcagcggcgcggcaacgttgaaatactgggcgatttggcggatggtttgcaaaacaatctgattgcagccgttttcggcgatatagtccgacagcatggcgacttgtccgcaaaaacggcgcactttgccgtggcaggcatacagcatttcaatcggttcggcaaaggtaacgcttttggtttcaaacggattcatgttttcgttctcaacgggcacttttcaagcagtcattttataataaaacagcctgcacaaagcaggctgtccgtcttttgagactttaagcggattaatcgaccaaagtcactttgccgttcatcaaagcaccgtgacctgggaaggtacaagcgaatttatattcgccgtcggccaatttagcaggatccagagtcagggaagcttcttcgccgccgccgatcagtttggtatgggcaacaacgcgtgcatcatcaggtttgacatagtcggtatcggcagcacctacgccgtctttaaatacgccgtccatgtcttcagctttggcaatcacgagattgtgacccatgctggctttgggttgcgtaccggtatgtttcagagtgatggtgaactctttacatgctttgctgacttggatgtctttggtgttgaactgcatattgtcgttggattcgacagttgccgcacagttgccggcagcaggggcttcggcagcatctgcaggagcagcttcggcggcaggcgcttcggaagcgggtgcttcagcagcaggagttgcctcggcagcaggcgcggcaggttcttgagagcaggcagccaaaccgataacggcggcagg

SEQ ID NO: 86 - DNA, 1699 bp, Neisseria meningitidis
ccgcaatattcgtgaaacgtcggtcggcatcgatgatgtgaaaaaacccccgcttttgctgggtttgtttttttgggtggttttctggcacggctatcgtcagaatcggggtgcaggttcggattcggattcagattcagattcagattcagattcagattcaggtttgtgtcccattgccgcgctttatagtggattaacaaaaatcaggacaaggcgacgaagccgcagacagtacaaatagtacggaaccgattcacttggtgcttcagcaccttagagaatcgttctctttgagctaaggtgaggcaacgctgtactggtttaaatttaatccactatatcggttgaaactctgattttaaggcggtaggatgtgggtttgcccatagaaagggaatcctttctgtatcaagccctgaaagggataattcatacaaattcacgcctttccccctcattgggaaatggatggaatcgtgccagatgtgtgcggcactgtatgccggatatggttttatcatcagcccttttcggttgaaaccccgtcagttgcagcgattgagcctaatcggtggcggaagttgccgctttgcattcggggcggcgtgcagtgcggtgctttgatatgccgtttgtgtgttgaaacagggtggtcggtgcatacgggtacggtatggccaaagctaaaagtgaaatacgctgaaacactgaatgagccgctttattgtttgtacggcctttgctgccttgctatgatttaaattggattcgcccgccggatattttgggatatgaaagaatttgacttcatcaaacggtatttgcaaacaggcacggataatgatgtcgtattgggcataggcgacgatgcggcgattgtccgcccgcgtgaaggcttcgatttgtgtttcagtgcggatatgcttttgaaggacaggcatttttttgcagatgtcaaacctgaagacttggcttggaaggttttggccgtcaatatttcagatatggcggcgatgggtgcgataccgcgttgggtgttgctgagcgcggctttgcccgaattggatgaggtatggctgaaacggttttgcggcagctttttcggtttggcaaaaaagtttggcgtaacgttaatcggcggcgatacgaccaagggcgatatggcgttcaatgtaaccattatcggcgaattgccgaagggtagggcgttgcggcgtgatgcggcggttgcgggcgacgatatttgggtgtcggggcgtatcggtatggcggcggcggctttgaactgccgtctgaaacggtgtgtgttgccagatgaagtgtttgccgaatgcgaacaaaagctgctccatcctgaaccaagggttgggctggggcttgcgctgttgccgtttgccagggcggcgcaggatgtttcagacggcctcgcgcaagatttggggcatatcctgaccgcttctggcaagggtgcggaaatttgggccgattcgctgccgtctttatccgtattgaaagatattttgccccgagcgcaatggctgtcttatactttggcgggcggcgacgattacgagctggtgtttaccgcgccggaaagttgccgcagccgcgtatttgatgcggcggaacggtgcggcgtgccggtaacgcgcatcggcaaaatcaacggaggatgccgtctgaaggttttagatgc

SEQ ID NO: 87 - DNA, 782 bp, Neisseria meningitidis
cctagtttctacagcggcctgtatgttggcaattcagcagcttcttctgtatctgctgtacaaatttaatgagggaataaaatgaccaaacagctgaaattaagcgcattattcgttgcattgctcgcttccggcactgctgttgcgggcgaggcgtccgttcagggttacaccgtaagcggccagtcgaacgaaatcgtacgcaacaactatggcgaatgctggaaaaacgcctactttgataaagcaagccaaggtcgcgtagaatgcggcgatgcggttgctgcccccgaacccgagccagaacccgaacccgcacccgcgcctgtcgtcgttgtggagcaggctccgcaatatgttgatgaaaccatttccctgtctgccaaaaccctgttcggtttcgataaggattcattgcgcgccgaagctcaagacaacctgaaagtattggcgcaacgcctgagtcgaaccaatgtccaatctgtccgcgtcgaaggccataccgactttatgggttctgacaaatacaatcaggccctgtcagaacgccgcgcatacgtagtggcaaacaacctggtcagcaacggcgtacctgtttctagaatttctgctgtcggcttgggcgaatctcaagcgcaaatgactcaagtttgtgaagccgaagttgccaaactgggtgcgaaagtctctaaagccaaaaaacgtgaggctctgattgcatgtatcgaacctgaccgccgtgtggatgtgaaaatccgcagcatcgtaacccgtcaggttgt

SEQ ID NO: 88 - DNA, 4583 bp, Neisseria meningitidis
gccgatttggacgcgctcgagcataatgttgcccacaattttgccgaatatcaggaagctgcccacatcstttctgccatgcgccatcaggcggcagagcgtttgagcggcgaaacgaccgagcatatgcaacaccttgccatgaaaggcgcgcgtttcgacatcgtcctgttgccttcgtcgccgacggcacacggtttggagcaggttcaatttcaagttgccgccaacaaaggcaatccgccccgtctgctgaataaagttgcctccggcggcgaattggcgcgtatcagccttgccttacaggttgttgccagccaatatacccaagttcccaccctgatttttgatgaggtcgataccggtattggagggggagtggctgaaatggtcggcaaggcattacgtgcgttgggcagaaaacatcaggtgcttgccgttacccaccttccccaagtcgcatcctgcggagaaaaccactggcgggtgcgcaagcacagcgagggagagcaaaccgtcagcgaaatcagtatattggatgaaatccaacggatcgaagaggttgcccgtatgttgggcggagaagtcattaccgatacgacgcggcaacatgcggcagaattgctgcaacttgcgtcgaaaaatagtttattttaaaatcaatcagttaaaaaataactaaaaataaaagtctaaaacaatagacagaactcagataaatccgtattatcacgctttcttaatcacttgaacaagtgattgtgctgcacccgtagctcagttggatagagtatctggctacgaaccagagggtcgggcgttcgaatcgctccgggtgcgccagtaagaaaatacaatatgcgcccatcgtctagcggttaggacatcgccctttcacggcggtaaccggggttcgattccccgtgggcgtgccaattcaaaatgcctccgattatatcggaggcatttctcatttctcatttctcatttctcatactgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcggattaacaaaaatcaggacaaggcgatgaagccgcagacagtacaaatagtacggaaccgattcacttggtgcttcagcaccttagagaatcgttctctttgagctaaggcgaggcaacgccgtactggtttttgttaatccactatattgagtcctcgagaagggaaataaaaattaacatccttatatattgagttcctgagaagggaagattaacaaaaattaacgccctttacttcatacaatcaacagggctttttcattccttccttatctaacagggggtacagaaaccgaaacggctggcagggttaaggaagtcttcgaatgttacggaacattcatcttggacagcaaaggcaatttgttaggcattccttactccttattttgggaagaaaacgttatgggtgttttcgatattttaccgtcaggattggtatgtttatttgaatatgattttctgtggtcgggacggcatgcggcaaagacttaaggggttagatccttccttctgacgatggcgcggatgatggtgcggttggggtgtagggcgtggcgcaggcgttgtgaaaagggatggggcaagcctaggatttgggctgcaatggcggcggcgcagatgggggcggtggcgagtccgcgggtgccgtgcgcggtgttgacgtaggcattaggcaggtatgggcatggggtgtcgatgcggtagtttttgtccagcgcgagtttggtgtaggtctgccgcatggcggcaatgtcgccgagtgcgccgactaggggaaggtggtcggggctgtcgcagcgtatggcggcgtgcccttggtgtttttgggggtttgggttggcggcaaacaatgattcggaaagggcggggttaaggtgtgccaatgcttggcggtttgaggcttcttcggcttcgttccatccggtatggctgctgttgggaataaaactcgcgccgtagcagtgcagtccgtgccacgacgggctgatgtagctttcgcctgaaacggcgcaacgcagttgttcggaaaacggggtggacggtgtgaggccggtttgtccgcgtatttgcctgagaggcagggcggcgaggttggtttcgggtaggtaggggctgttcgcaccggtgcagtagatgatgtgtgtggcggtaaatgtgccgtttggcgtgcttgcaatccacttttccccgtcgtgggaaatgtcggtcaagggtgtgtcttcgtgtagtccaatgagcggatggttgaggagggtgcggacgaatgcgggtggattgagccatacgccgtgttgccagtagagtccgcatgaagggtggtcgtatgggacggacagtgggataccggcgattttttcggcttctgcagatgtgatgctgcggtagaggtggttatggtgtttttgcaaacccaattcgtgattgcgttgttgttcggtgcggctgtaattgaggtggatgatgccgttgccgccccaggtttcggattcgggcaggatgtgtccgagcaggcgtttggtgtagccgtagccggcaagcaaaagttcggtctgttcggtgtcgtgcggcgagattttggcgtagagcagcccttggcggttgccgctggcggcttgggcggcttttcgggcttccaatacggtaacggaaatgccgtgtgatgctaaggcgtgggcggttgccgcgccggatatgcccgcgccgataacgaggatgtgttccggtttttgccgttcggatgtttgtggaagtgcaaaccagggtttgtcgggcttgctttcggtttgcgggatggcttcggtctgccaggaaatgtggtggaaatgttcgtgcaggtggtgggtgcgtgaagggggaaccagccagaagcggacatcgggcaggatgtgttcgatgaggttgatgctgtcgaactggaggcactgcattgcctgatccaaacggtgcttcagacggcattccgcgtccgaagcatcttgtgcggtttgaaaatcgggaatctgattatcggggaggcagataatcaggttgagcgggggtgcgtgtttgcggatggcttggtcgagtgtgcggatgtcgggaatgccgtcccatacgagattgtccatatcaatgccgtttaaagtgtgggtttgaatatcggtatcgggataaagctgttaaaatacgcgccgtttgaaggcacgcctgcgcctgccggatattgtatgccgaaccgaggtgttttttgaataatattcctgttgaaatccgtttgttgaaaaaccgtaccgtgttggttttgacttatggggacgaacctaaaaatctgcctgccgaatttttacgcgtctattcgccgagtgcggaagtgcgcggacacggcgtgggacaggatgttttgcagaccggcaaggcggatgtccaaatcgcggatttgcagcctgtcggacagtacgcgctgaaaatcagtttttcagacgggcacgacagcggtctttacgattgggcgtatctgcacagactggcatacggatacgatgcgatgtggcaggaatatttggacaaattggcggcggcgggcgcgtcgcgttttgaagagaaataagaccggtcggatggtaatctgacgggcaaaggtatcagagaggtggttagaatatgggcggacagaaaacgcatttcggattcagtacggtcaacgaagatgaaaaagccggcaaagtggcggaagtgttccactccgtcgccaaaaactacgacattatgaacgatgtgatgtcggcagggctgcacagggtgtggaagcatttcaccatcaacacggcgcacctgaaaaaaggcgataaagtgttggacattgcgggcggtacgggcgatttgtcgcgcggttgggcgaaacgggtcggcaaggaaggcgaggtttggctgaccgatattaattcctctatgctgaccgtcgggcgcgaccgtctgttgaacgaaggcatgattttgcccgtatcgcttgccgatgcggaaaaactgcctttccccgacaattatttcaacttggtttccgtggcgttcggcttgcggaacatgacgcataaagatgccgcgctgaaagagatgtaccgtgttttgaaaccgggcggcacgttgctggtgttggagttttccaaaatctacaaacctttggaaggcgcgtatgatttctattcgttcaagctgctgccggtcatgggcaggctgattgcgaaagatgcggagagttaccagtatcttgccgaatccatccgtatgcaccccgatcaggaaactttgaaacagatgatgctggatgcgggcttcgacagcgtggattatcacaatatgagtgcgggcatcgtcgcgctgcataagggcgtgaaattttaaacggactggctgtgcagccg

SEQ ID NO: 89 - DNA, 1013 bp, Neisseria meningitidis
gtagaattgctaaggaatcctcacgatgcttctaacactttctttgcgtgattttgtcattgttgaaaatctgaatctggattttcaaagcggctttaccgtattgaccggagaaactggcgcgggcaagtccattactttggatgcgattggtctgctgttgggcgataaagccgattacagccaagtccgcagcggcgcaaaagaagcgcagttgtcggcgttgtttgatatttcccatttacctgttttaaaagcagaattgtatgaacaggggcttttaaacgacggagaagaagaactcagtatccgccgcattatcgatgccaaaggcaaaagccgcagctttatcaacaatcaggccgctaccttggcgcaactcaaagccgtcggtagccagcttatcgacatccacgggcaaaacgcccatcattcgcttaatcaggaagccgcccagcgcgaattgttggacgcatttgcgggtagcagggagcaggcggaaaccgtcaggcagctttatcaaaattgggccaatgcgaaaaaagccctccaagaggcgcaggaacacgccgatgccgtcattatcgagcgggagcgtctggaatggcagtttaacgaattgaatcagttggacattaaacaaggcgagtgggaagccctcagccaaagccacgacagccttgcccattctgccgagctgttgcaggctgccgaagaagtcggaagcaagattgacggcgacaacggcatccaacgccatatctatcaatgtcaaaaactattggccaatctgcaaaacatcgagccgcgctttgccgagagcctgaatatgttggcaagcatcgaagccgaattgggcgaaatcagtgccaatatgcgcgatgtggcaggtcgcagcgacatcaatcccaacgaacttgccgcacaagagcagcgcatgggcgagctgatggggatggcgcggaaataccggatcgagcctgaagagttgcctgccaagttggcagaaatcg

SEQ ID NO: 90 - DNA, 463 bp, Neisseria meningitidis
tcgactctagaggatccccgggcgtattcggcgcgtggcttgccacacccagcaccattcggcttcaaagccaaaaaatcaacacaccgtcaaaaatgccgtccgaacccgttttcagacggcatttcaatttgcctagtataatggcgcatttttccaacaaggaacctaccatgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataatcgccacacaaaaatgccgtctgaaaccatttcgtttcaga

SEQ ID NO: 91 - DNA, 137 bp, Neisseria meningitidis
ttgcatgcctgcaggtcgactctagaggatccccggcggatttttgccgcgtgttccgcgtcggcgtgtgcgtttaaggcttcgagggcgtttgcggcggctttgaggcggctgcgtgtttccgcccagaccgtcca

SEQ ID NO: 92 - DNA, 384 bp, Neisseria meningitidis
ccgggaccttttttctccagaaagccggcaatggggctgtcgggccgggtgggcatcagcagctcgatcaaggtgtcgcccaccacgaaggcgcggacccgcacaccctgagttcccacgtcttcgtcggggccttcggggcgcaggccgagcgcgacataaggtgcggcgccctgatccagatcgggggtggcgatggcgacgtggtcgaggagcatggcctcagcttatacctgctgaccaggacgcggcacacaaaaatgaaccgggaacaggttttttctggacgccggccccgctcgttacactctgaagtgtgaccctgaccgccctgctcgccctgctgctctcgtacctcatcggcgctattccggcggcggcgtg

SEQ ID NO: 93 - DNA, 2132 bp, Neisseria meningitidis
cttcgtcaacgaaagcgcgcaaaacatccgccgcatccttgccgaagtgccgatacacatcatccaattccacggcgacgaagacgacgcattctgccgccagttccaccgcccctatatcaaagccattcgtgttcagacggcatcagacatccgaaacgccgccacgcgcttccccgacgctcaggcactgctgttcgatgcctaccatccttcggaatacggcggcaccggaaaccgcttcgactggacgctgctggcggaatattcgggcaaaccgtgggtgcttgccggcgggctgacccctgaaaacgtcggcgaagccgtccgcatcaccggagcggaatcggtcgatgtatccggcggtgtggaagcgtctaaaggcaaaaaagatgccgccaaagtcgccgcctttatcgcaaccgccaaccgcctatcccgttaaagcaacaaaaattgccgccggaatgacttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactataatctaaaaaatttatgctattaaatcagtaatttctgatgaattttgaaaacttaatcccgtcattcccgcgcaagcgggaatccggctcgttcggtttcgcttgttttaagtttcgggtaacttccacttcgtcattcccgcgcaggcgggaatccggttcattgaatttcagctatttagaataaattttgaaactctaatcgcgtcattcccacgaaagtgggaatccaggacgcaaaatctcaagaaaccgttttacctgataagtttccgcactgacagacctagattcccgcctgcgcgggaatgacgaatccatccatacggaaacctgcatcccgtcattcccacgaaagtgggaatccggttcgttcggtttcgcttgttttaagtttcgggtaacttccacttcgtcattcccacgaaagtgggaatccagttttttgagtttcagtcatttccgataaattgccttagcattgaatgtctagattcccgcctacgcgggaatgacggattttaggttgggggcatttattggaaaaagcagaaaaccaaaaacagcaacctgaaattcgtcattcccgcgcaggcgggaatccaatgcgttgagtttcagctatttagaataaattttgaaactctaatcgcgtcattcccacgaaagtgggaatctagaaatttaatgttgcggcactagccaaaaaaaccgaaaccgaacggactagattcccgcctgcgcgggaatgacggctgcagatgcccgacggtctttatagtggattgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataatatgcacagataatatcaacccgtttttaacaaagatattcccggcatttgcgtaaagttcagcaagaaaaactacaaacccagtcgcgcaggaagcggatgtcgtccgcccaaccggatttgactttgacccagaccttcaaaaatactttggtatcaaacagtttttccatatccaaccgcgcttcggtggaaattttcttcaaacgttctccgcctttaccgattaaaattgccttttggctttccttatcgaccaaaacggcgatatagatgcggttcaaaccgtcttcctcttcaaactgctccacttcgacgttcatcgcataaggcaattcctcgcccaagtagcggaacaatttttcacgcacgatttcgcgcgctgg

SEQ ID NO: 94 - DNA, 3739 bp, Neisseria meningitidis
  misc_feature (3735)..(3735): N is any nucleotide
ttttcagcttggtcttaacccgcccctgcttgagttgggaaaggctttcgacaaacacgatgcccatcaggtggtccaactcgtgctgcacgcaaatcgccaacaagccgtccgcctccagcgtgaacttttcgcctttttcgttcaaagcctcgacggttgcataatctacatttgcacgtaaagtatgcagtggcacgcgaccttcacgataccattcgctacgggcaatatccgcaccattcagacggcctgaagtcataatcttaatgcctttagcaccagaacgcattgcattttgcattgctcgtttcatagcacgacggaattgaacgcgcttttccaactgctgggcaataccgtcagcaataatttgagcatccaactcaggacggcgaatctcttcaatatttacatgaacaggtacacccatcaagacttgcaagtcacgtttcaaaacctcgatatcctcaccttttttaccgataaccacacccggacgagcggagtgaatggtaatgcgtgcagattttgcagggcgttcaataaccactcgaccaaccgaagcattggccaatttttgacgcaaataattgcgaacatcgatatcctgcttcaaaacagtagaaaagtcggtgcttttagcaaaccattttgaagcccagtctttagttaccgccaggcgaaagcctgtagggttaatcttttgtcccatagcttttccttagttacccactgtcacattgatatgacaagtttgtttttcgatgcggttaccgcgacctttggcgcgagcttgaaaacgtttcaagcttgggcctttgtcaacaaagatagttaccactttcagttcatcaatgtccgcaccgttattgtgctcggcattagcaatagctgactccaatacttttttaatcagctcggcaccttttttaggactgaaagccaaaatattcaaagcttgggcaacgtctttaccacgaatcaaatcagctaccaaacgagccttttgagcagagatacgggcatttttatgttgtgcatttactctcatgattcaccttatttctttttagcctttttatcggccaagtggcctttaaaggtacgggtcaatgagaattcgcctaatttatgaccaaccatattgtcgctgataaacacaggcacatgggtgcggccgttgtgcacagcaatggtcagaccgataaaatcaggcagaatggtagaacgacgagaccaggttttaatcgggcgtttgtcgttgcttgcgcgagcagcatctacttttttcagcaaatgcaggtctacatatgggccttttttcaatgaacgagccatactaaattaacctttatttgagtaacggcgacgaacaatcatgttatccgtgcgtttgttattacgagtgcggtagcctttagcaggagtaccccatgggctgaccggttcgcgggcctcgcccgtacggccttcaccaccaccatgcgggtgatcgacagggttcatgacaacaccacgtacagtcggacgaataccgcgccaacgattggcaccggctttaccgatttttttcaggctttgctcttcgttaccgacttcaccgatggttgcacggcaatctacgttgattttacggacttcgccagagcgcaggcggacttgagcgtacgcgccttctttagccagcaataccgcagaagcaccggcagaacgtgcaatttgcgcacctttacctggtttcatttcgatacagtgaatagttgtaccaacaggaatattgcggatcggcagagtgttacctactttgatcgcagcttcagcaccggaaaccaatactgcaccggcttgaataccacgaggagcaataatgtagcgacgctcaccatctgcatagcacaacagtgcgataaatgcagtacggttagggtcatattcgatacgctctacttttgcagggataccgtctttgttacgtttaaaatctacgacgcggtaatgatgtttatgaccaccacctttatgacgggtagtaatatgaccattgttgttacgaccggcagtagaatttttcttttccagcagaggtgcataaggtgcacctttgtacaaaccttctgttaccacgcgaaccatgccgcgacggcctgcagaggtcggcttcattttaacgattgccattttgtttattccttatctgcagctgcagcagcggcttccaaatccaactcttgaccggcagccaagcttacataagcctttttaacatcgctgcgacgacctaaagtgcgaccaaaacgtttaactttacctttaatggtaacagtagtaacgtctgcaacttgaacgccgaacagcagctcaacagccgctttaatttcaggtttggttgcatttgccaaaactttaaacgtcatttggttacgtttttcagccaatacgttgcttttttcagaaacgataggtgccaaaatcacttgagtcaaacgttgttgattcatacccattgctcctctaattgtgcaactgcatctttagtgatgattacttttttgtaacgcagcaagctgtaaggatcaacttgttgagcttccaaaaccaacacgtttggcaagttgcgtgaagccaagtaaacattctcgtcgagctgtttggttacaaacaacacttgctccagacccagatttttcacttgttcggcaaaaactttggttttaggagtttcggcagtcaacgcctcaatcgcaaacaaacgctcgtcacgagtcaattgggacagaatagtcgccataccggcacggtacattttgcggtttactttttgagtgaagttttcgtcgggtttgttcgggaacgcgcgaccacctttacgccacagcggagaagaagtcataccggaacgggcacggccggtacctttttgacgccatggttttttggttgagtgttttacttcggcacgggttttttgagcgcggttaccggagcgggcgtttgccaagtaggcatttaccagctgatgaaccaacgcttcattgtattcgcgggcgaacaaagcatcagaaacagacagactgcctgaaacttgtcctttagcgtcaattactttcaattccattacgcacctactttcacgctgggacgaactacaacatcgctgttgaccgcacccggaacagcacccttaaccaacagcagttggcgttctgcgtcaacacggacaacttccaatttttgaacagttgctttggtgttgccgtattggccggccatgcgtttaccggggaacacgcgacccgggtcttgcgccataccgatagagcctggaacacggtgagaacgggagttaccgtgggaagtacgttgggcaccgaagttatgacgtttaatcgtgccggagaaacctttacctttagaggtaccggttacatcgaccagttgaccgacttcaaacatagaaacggtgatttcgtcaccagctttcaattcagccagtttttcttcagtcaaagcaaactcaatcaaaccgcgaccggcttcaacacctgcttttgcaaagtgcccggcttcggctttgttgacacgattggcttttttctgaccaaaggtaacttgaacggcagtatagccgtcagtatctttggattttacttgtgtaacgcggttggcagacatatccaaaacggttaccggaacagaaacaccctgttcgtcgaacacgcggggtcattaccnaact

SEQ ID NO: 95 - DNA, 2456 bp, Neisseria meningitidis
ggttttaacctgcaaaacatcgtccgcattctgcggattctgccaaacggcgagatagccgtaagtatcggcagcccgtgccgccgcagtcatcaggcatagtgccgatacggccagtatctttttcatcatgataaattcccgacggttcgtccaaattctgttgcattataaacaaaaaacaggataagtcccgccttatcggcttatccctccccgcagattgcaccgccgggtatggcaaaccgatttcagcagcgcaaatccgcataccgccgccttagcggcaagccgttgttttcagacggcattgcggccaacctttgcggcgggcgaaaaaccttgtcctataatttatcccgtttcaaaatcagcatacggtcggaaatgcaaaaaatatctttcaatttgttgaagcctgcaaactccccgaaaatagggaaacgccgccccggtttgaacggcgcgccgcatattccgatgccctccccccgataccttccggcaagcccagaaatgcccggcaacaacatccatccggcaaaaatccgaaacaacacacccggcggcaggcagagtcaaaccgccccgcaaagcatccgccatcagaaaaacaaaccgcctccgagggcttcatcctaaagggcgtattgttcgataatggtttgggttataatcccctatcgattctccacgtccgtgagacacttcagctatggaaaccccgaccaacaccccgcaacgctccctgcgtcaaaacagtatctacctgctgcccaattcctttactatcgccgcgctgttttccgcgttttacgcaatcacccaatccatgcacggacgttatgaaaccgccgccatcgcggtattcatctctatgttgctggacggtatggacgggcgcgtggcgcggctgaccaacagccaaagcgcgttcggggagcagctcgacagccttgccgatatggtcagcttcggcgttgctcccgctctgattgcctacaaatggcagctttggcagttcggcaaaatcggttattccgtcgccttcatctactgcgcctgcgccgccctgcgcctcgccctgttcaacacactcatcggcaaggtggacaaacgctggtttatcggcgtgcccagtccgactgccgccgcgctgattgtcgggctgatttgggtcaaccacagcgtcgaaaaattccccgccgtccactggtgggcattgggcatcacactgtttgccggcctgtcgatgattgtccaaatccctttttggagttttaaagaaatcaacatccgcagacaagtcccctttgtcggaatgctgcttgccgtcttactgctgcttctggtcacttgggaaccgtcgctcgtcctcttcctgttctttctcggatacagcctgtccggctacattatggcggcacgccgattttggaaaaagtacagaaaggcggattaaatgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaaaacacacgaaaaaacctttttaccgtttgcacaagcaattaatcaggacaaagctgcccagtctcctgttccgacaaaaggacagacaacctgaccgagacctttgcagaatatacgaaaaacgacagataccgtctgaaaccacattccgacaatcggcagggtttcagacggcatctgataatttc

SEQ ID NO: 96 - DNA, 996 bp, Neisseria meningitidis
ccttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaacgcaaaaaacagcaagacgcgcaaatcgacgcttgggcagaagcctaaggcgtggactccgccaccactcaaaatcagctctgtaaaaccggtctgagtcttcttttcccccgtactcaataatttatccgccgcctctttaccaccaaattcatttacaatttgtaaaaatcgtgtcgccttgtaaggttgcggcaaattcaaagcctcctgataaatatttaacatggctttatgaaattcttgttctaactgatttttatccatcattcttcttccaatatttcagaccggattattcttacccagaatttcttttctcatccgctcccgtctgatcacctaccgaatcaggtcgtctgaaacagtctgaaatcgcttttcagacgaccctcagcctttttcatacccttcgtaataatacgactgctcgatacctttaaagatgatttcacggttgtccacatcgtcagtcaggttgtcctttaacagaaagcgcagttctaaatcgttgacggggctgcgttccatcgcctgcaaatacagggttttacttacattttgccagttcacgacttttttcaggttttttttcagcaccaaatccagccagatgcgggtacttctgccattaccctccaaaaacggatgggcaatgttcatttcaacatatttggcgatgatttcttcaaaagtccgctcgggcatctgctcgattttaaccaaagcctcttttaaatacatggcgttggcaaaacgaaaaccgcctttggaaatgttgtcttccctg

SEQ ID NO: 97 - DNA, 12438 bp, Neisseria meningitidis
cttggtgttgataccattcgattccattcgatgataattccattcgattctatgcgatgattccattcctttccattagaagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctgaaaacaggcagacataaaagaaaatccgcgtagagtgatgtaaacttacccttgctttaataagtagaaaatggtgggtttacgtccccccctgcggctactaaaaaaatataagagtaaacaacctttttgaaagaaaaatgtatggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccaattcaaaaacaaagctagatattttgcaagaagcatgggaaacattattaccacacagaaaattacatattacagcagatgatattcaagtctctgctgtagataatgaggaattgtattctgcctcaaatatgagtgatggagagcgagcacttttctatattcttggacaagttttgtcagtagatgacggttctgtcttaatttttgatgagcctgaattacatattcataaatcaattatttcaaatctatgggataaaattgaagaattacgacctgattgttcatttctaatcattacacacgatattgaatttgctgcaactcgagtagctaaaaaatatgttatcagaaattattatccgacccctgcttgggatatttctgaagttcctgaaagtaattttgatgaagaaacaataacgatgattttaggtagccgtaagccaatattatttgttgagggcaacaataatagtttagatattgctacttaccgctattgttatcctgattggaccatcatacccaaaggggcatgcaaagatgtcattcaatcagtatcatcgctgaaaaaattaagtaatgaaatgccattactaaacttaaaatgttcaggtattgtcgatttagatagtagggatgaaagagaaattgaacaattaaataatttgggtatttacattttacctgtatccgaaattgaaaatctttttagcttaactgatgtagcaaaagagatattgaaactaaatcaatattcagatgaagaattactcaataaacttaatggatttaaatccgaactaattaaatatatagataatgaattaaaagacgataaattagacgaatttgttgtaaaacaggttcgacgtaaaattgataattatttaaaaaatattgatttatcctccaaaataacaagtactgatatgaaaaaatcattacttaatgaaatttctactttaacagaacagaaaattgaaacatggatttcagaaattaaaaatgaaattcaaagatgtattgaacagcaagatttggataaattacttactatatatgataataaaggactcttggctaaatcagcttgtgttttaaaaggaatgcgtaacaaacatgaatttgaaagctggataatgagaacattaaaaggaaggaataaagattttattgatgcaatcagacagaaacttccaattctggattaaataaaaccatctgaaaatttaccttcagatacagatatatttcatgaaaaatcatcaaactacactctctttccctacttcgagtagcctgaaaccttgcgcagacaaacaaggcctgtctgaagaccgcagccaataccgcctgaccaaactcggcgaacaaatggcgcacctgcctatcgacccgaaaattgcgcgtattttgttagtattattccgtttttaaaaatgcccgattcgcggtatatcaatgacggttttcaggtattgctggaattgggggcggtggaggccgtctgaaaataaaatctttctttataaaaaggcaggccatgtttcattttcagacggcctaaatcattgagaaactaaaaactattaaaaagggaatattgggttttaaaactcaatcggtaaatttttattgtgaaatattaatgatgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatgagtggcgtaaaaaccaataaagacaaatttagatgatgtcggggaagatgcccgaccgacaagactatgcaaaatatgaaaaaccaagtacgcggatcaggcatggatgcccgatccaatccggccaatgtttcagacggcctgcaaaacagttcgggtcatatcggtaccaacacgcgttaccgcctgaccaaactcggcgaacagatagcgcgcctacccatcgacccgaaaatcgcgcgcattttgctggcggcgaagaaacacgactgcatggcggaaatattggtgattgcgtccgcgctgtcgattcaagacccgcgcgagcggccgctagaagcgcgcgatgcctcagccaaggcgcacgagcgttttaccgacaagcagtccgatttccttgcctatctgaacatttgggacagcttccagcgcgaacgcgataaaggcttgtccaacaagcagctggtgcagtggtgccgccaatatttcctgtcgcacctgcggatgcgcgagtggcgcgagctgcaccaccagcttgcccaaaccgcgattgaaatgggtttaaccaccaaggaagccgctttcagacgacctcccgaagtcaggcagctcacgtcgtctgaaaatgcgggtgaccaagacctatctgctaaactcaaacaaaaacaactggataaaaagcaacaccgcgcccaaatccgcgccgccaaagaagcgggctacgaacaaatccaccgcgccctgctcactggccttatcgccaacgtcggcatgaaatcgcccgacggtaacgactacaccggcgcgcgcggcagccgcttccaccttttccccgcctccgccctgttcaaagccaaacccaaatgggtgatggcggcagaattggttgaaaccacgcgcctttacgcgcgcgacgtcgccgttatccagcccgaatggatagagcaggaagcgccgcacctcgtccgctatcattatttcgagccgcattgggaacaaaaacgcggcgaagtcgtcgccagcgaacgcgtgacgctttacggtctgaccgtattgccgcgccgccccgtgtcttacggcaaagttgcccccgaagaagcgcgcgaaatctttatccgcagcgcgttggtggcgcaggaatgcgatttgaaagcggatttttttgtccacaacaaaaagctgattaaagaaattaccgaactcgaacacaaatcgcgcaagcaagacgtgctggtcgatgacgaagccctgtttgcgttttataacgaacgactgcccgaaatggcttggaaagacgcgcaaggcagcgtttggggaagtgaagattccgtacggattattgaatctgacaaagccgagaggtcgtctgaaaatgagcgcaacgagtttcgtaaaaacaagcgtaatgggtctcgccaaaatgaaaatcacggcaacaccgtaggttgggttgaaaacccaacatcagccgcaactgcaaaaactgttgggtttgacaatccaacctacgctgcccaacaaaccaccccctcccccgtgggggagggtcggggagagggcaaaacagttgccgcacaaaccaacttttccgcaaccgcagcaaaccctctccctaaccctctcccgcaggagagggaacagagtgccgcagcttcaacgatttcagacgacctgcgtcctgcaaatctgcagcaaaccgccccctcccccgtgggggagggctggggagagggcaaaacagttgccacacaaaccaacttttccgcaacctcaacaaaccctctcccgcaggagagggaacagagtgcctcagcttcaacgttttcagacgacctgcgtcctgcaaatctgcagcaaccctctccctcccccgtgggggagggctggggagagggcaaaacagttgccacacaaaccaacttttccgcaacctcaacactttcagacgactccaaacccaaaaagcagcctgcaccccaaaaaaaccgtctgaaacccctacccctcgccgacatccgcaccttccaagcctggctcaaaaccgccgagcgcgacaatccgcgcctgctgttcctcagccgcgacgatctgatgcaacacgccgccgcacacattaccgaagaacagttccccaaattctggcaaaccgcagacggcaaattcaaactttcctaccgcttcgagccgcaccatccgctagacggcgtgaccatgaccgtgccgctgaccgtcctcaaccgcctgcacgcgccgtcgctcgaatggctggtgcccggcatgatacgcgaaaaaatccagttgcaaatcaaagcactgcccaagcaaatccgccgcatctgcgtgcccgtgcccgaattcatcacccaatttttaagccaaaaccccgaccgcaacgcccccatcctgccccaactcgcccaagccatcgccaaaaccgcaggcgacatccgcatattcgagcaaatcaaccaagacgaatgggccgcgttcaggctgcccgaacactgctatttcaacctccgcattatcgacgacggcggacaagagcttgccggcggccgcaaactgcacgaattgcaacaacaactcggtcaagctgccgccgttaccttccgtgacaacacccaagaatttgagcgcgacaacgtcaccgcatgggacatcggcaccctgcccgaatccatcaaattcgcacgcggcaaacaacagctcaccggctatctcggcctacaaaaagaaaaagacggccgcatcgccctgcgcctgtttgataccacagaagccgcagagcaggcacaccgtcaaggtgtcatcgaattgatgaagctgcaattaaaagagcaggtaaaggatttgaacaaaggcatccaaggcttcacccaagctgccatgctgctcaaacacatcaacgccgacactctgcgcgacgacctcacccaagccgtctgcgaccgcgcctttatcggcgaagacgagctgccgcgcaacgaaaaagccttcaaagaacaaatcaaacgcgcccgcagccgcctgcccgccgtcaaagaagccctcagccgctacctgcaggaaaccgccgccgtctacgccgaactcaacagcaaactcggcaaacacccattgacccaccttctaagactacgcctgcaaaccctgctcgccgccggcttcgccacccgaaccccgtgggcacaatggccgcgcctccccatctacctcaaagccatgaccctgcgcctcgaaaaatacagcagcaaccccgcccgcgacgcagcccgcgaagccgatatccaagagctggaacaaatgtggcaggaaaaaacagacagcctgattaaacaaggtctccccatttcagacggcctcgccgcgtttaaatggatgattgaagaattgagggtgtcgctgttcgcgcaggaattgaagacaccgtatccggtgtcggtgaagcggctgttgaaagagtgggaaaaaattgaaaaataaaaaaacagcctgaaaagtttcaggctgtttttttatttgactaatcgaagtttcctatatctatttaagtccctctcaactaatccaaaagttaaatcagcaacatctttgggggatacgtttaaattttcagcaatctgttcaataccaatgccatcattttttaaaatagtaagcattttacgtaatgcgcttgatatttccctttccattggctctggttcgatagttcgatattttttctttgcaaacaaaggacaaagattgtgtatatacatcctatcagtaatcattcctaatttatgcatccgatatgctaaggcaacaagtgatacaccaaatcgtcttttgatttttaataaattttcaatagtgataggaacatgacgatataagcgtagtgcagcctccggcattaaaaaagctgaagcaaaggcattagcctctttttcgataatatcacgaggttcatcttctgtaatttcactatttttactatgttccatactgtatttatcacggattaagtgccctaattcatgggcagcatcaaatcgactacgttctgcagatttttgtgtatttaaaaatacaaatggatgattttcataccaagtacaaaaggcatcaatgtcctttgtatctaaagataatgaaaatacacgaacacccttaacttcaagtagggtgatcatattcggaataggttcattgccaagcccccattctaatcttagttcctgagcagcctcttcaggagaaatatcagaaaaatcaggcaatacggcttgacttagtgtaaattctgtctcgagccagtcatttaacaaaaaagccgtaatgctatgatttaatgcttgtttttcaagcctcttcgaggtgcgtgaacgagcacgaaaacttactgcctgagatttcaactcaggcagtctttcgtcattagtaaagaaatgaactggaaactctaataaattggctaattcatttaaatcaggtatttgctcatcttttacatagtttctaacctgtcgagcggtaatacctaataactcagctaattttgtttgcgtacaaccacgtttatccagcgcaaattccagtctctcacgattaaatgtctgcatgatttatcattcaaattatcctgctttttgttttctttcaaccaaaggctcatattcttcaacaggttgcttacgttcaagctcatcaaatttagttaaatcaacatcagctaatataattcgctgcttgtacccagttatttgatgactaacaaaaccactcggtaaagataattcaagttgcactttattatacttccagtgaaacagcagaacccaaaactgcacagtatcaggcaaatctagttttgaattacgaatagcctcctcaaatcccttacctttccttgcggttgtcattggcatcccgtgatgcctaccaacatctgaagtagcagtagccacaataatacttttagttcgacatggcgagagacatagaaatgcaccacccgaccaaggctcaagcgtccagccatctttacttaaatatacccttagagcaaatgtaatttctgcttgccgatacatccccaatgtatttctgtcagataatgctgctttgtcctgaatattattatgcgcagtaagtacaatctctttaagcatctcctgagataagtacttgctgatttcacttaaagcaatatcactattttgttgctcgactatttctcctacttcaaatgggaaaggttctgataatgcaaattccaccataaaaatttcctaattttatacgtaatgtttacacaatatatcaggaaatatgaaaacgtacaactatatctataaagcaattaataagtagcctgcccaaccgtgtccttatctttcggcacacccgacctgcaaatcacgcaaaacttggaatccgtgtgtagggtgtgtgcggtacatacgcacgcagtctttttaaaccacagcccttcccaactaaaccaaaaggtcgtctgaaccctattttcagacgaccttttgccactttgtaaaacaaatcttcccaccatcctctccccaaacatcgcccgaaccagtaaacttctcatatttcaacaactccttggaagcaaaccatgtctggtatctacctaccccgcctattcccgccccatatcgccgaacgcggcctgttgtattttcagcagggcaaggttctcgatgtccgaaaaacttccgccgggcattatcgggcggaggtgtgcggttcggaaaactattgggtatagttgaagctggatagtgatttgtatattaaagacgaaggctgcaattgtccttatatctaagagtgcaaacataccttaaattactatattgcataggcaaaatacaagcctataacgaattggaaacaaaatgccgtctgaaaacatcttcagacggcattataaaatctgttcaccttttcagatgagtaatgtacacccttatacaatttttgctactatgccccataaatccacggctaaagatatccttattatgtcctatgatttatcgaaacgacttgtaatcggcttagcatcaagtgccctattcgacttatccgaatcggataatatatttagaatggaaggggcagaaacctataggcaatatcagagagaaaaacaaaaccatcccctaaaaaaggcgttgtctttccatttattaaaaaacttctgtcaatcaatgaaataaacccaaacgacccaacgattgggtttattcttttatccagaaacaatccagatacagattacgagtcataactataggcttaatattacacgattctcattccatcaaggcggaaaaccgcacaaatactgaaacactatcgatcgatttgtaaacaagcctacttaagtaacttgcagtccttatcatttcctttaaaataatccagcccgtcactacacgaactggcggacttcttgcaaataaaggttactagattttcattcatcttaataataaaaggatttttatctttatctatggctaccgccttcaacatgaatttactgtctaaagccccgcgcgcgattccattcaaacggatacaaaagccttctgcctctttaatcggcaaacttggccacttggtagatgtttgtttaaacctcccattctgcagataaaacttttccataaaatgtgcattttctaacaaggctgcccgcactgcatttatctttgctttctcaacataattgcgatagctcggataaacaattaaagcaagtacagacaatatcaagaccactgatattaattcaaccagcgtaaacccccgattatcagtcattactttacttccaataagaacagattattcaacatatttctttgaacagacttactatcccattcaacagtatgcatatttcccactctattttttagcggccggtatagccggtttggctgggccttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaatcacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccataggttcgtcgactccggtcctctcgtactaggagcagcccccgtcaaacttccaacgcccactgcagatagggacaaactgtct

SEQ ID NO: 98 - DNA, 3959 bp, Neisseria meningitidis
ctatattttacaatttttggtcatatgaatgtctgttccgttcacaggcaaaccgtgtttaaacgctgtattacagcaaatcatcagataacgggccggcagaaaaaatgattccgtctgatttcttattccaataaaatcaggttagatgatatattgccgcttctgtctgtcagccgtttcgggctgcacaccacatctgttcaaaggaaaaccatgtttcaaaattttgatttgggcgtgtttctgcttgccgtcctgcccgtgctgctctccattaccgtcagggaggtggcgcgcggctatacggcgcgctactggggagacaacactgccgaacaatacggcaggctgacactgaaccccctgccccatatcgatttggtcggcacaatcatcgtaccgctgcttactttgatgttcacgcccttcctgttcggctgggcgcgtccgattcctatcgattcgcgcaacttccgcaacccgcgccttgcctggcgttgcgttgccgcgtccggcccgctgtcgaatctagcgatggctgttctgtggggcgtggttttggtgctgactccgtatgtcggcggggcgtatcagatgccgttggctcaaatggcaaactacggtattctgatcaatgcgattctgttcgcgctcaacatcatccccatcctgccttgggacggcggcattttcatcgacaccttcctgtcggcgaaatattcgcaagcgttccgcaaaatcgaaccttatgggacgtggattatcctactgctgatgctgaccggggttttgggtgcgtttattgcaccgattgtgcggctggtgattgcgtttgtgcagatgttcgtctgactggctttcagacggcataaacgctccagaaaacgcggcaggacatattgccctgccgcgttttcctgtagtgtaatcttatttttttcatcattattagaaccaggttgcatgataatacctttcattaactgaaacactgattaagaaactccagtctgtctaatgatgaggttttcacatcgccaaaacttgccaatcaaatgctggatttattgccgtctgagatttggtcaaatccaaaggcgacattcttagaccctgtgtgtaaatcaggggtatttttgcgtgaaatcgtcaaacgcttggatgaaggcttgaccaatcaaataccagataaacaaactcgcattaaccacattttaaaaaatcaagtttttggaagtactgccacgtatgtaggtagctttgaccgatatttgcataaaaactcctttgctggtgaaaggaattattttgccaattttaaaatatttctggcaccaaatagtacaatgacaaagacaatcatgccaatgattaaatcaggatagctagaatgagtcaataacgtcaatgctcccgccgctatcacaccgatattgatgataatgtcattggatgtaaaaatcatgctggctttgatatggatttctttattttgatttttgctcagtagatataagcacagccagtttgcaatcaatgccaaaaatgccgtgccaatcatcagttgataattgggcagctgctcagcaccgataaaacgcctaatcacttctatcaccccaaataacgccaatattatctgcgttatccccgccaaaaatgccacacgttttttatacgccagcgtcataccaatggctgatagcgccaatatatagacaaagctgtccgccagcatatctagactatcagcaatcagccccatagaattagcaaaaataccaaccgaacactctatgataaaaaacacaaagttaatcatgagcacttgatataataatcttttttctaagtgctcatcaggcttgttaaacactatcttatcaacaatcacttcggtggaaatgatatgactatcaaaattaagcggttcaagtacttgtaaaatcgttgtatcttgattatcgtgatagacggttaagcaccgcccagcaatatcaaactgtaattcataaatatcagacacatcttttaaacgcatgcgaatgagctgttcttcggacgggcagtccattttggtaatgttaaaaatggtctttttcatctatttagttccttgttttgatcaggttggctcaaataaatctgtgtttatattgctgcttggtaatttttggatggtttgagtaaattgattaggttaaaatttacctttggaagtaccgccacgcataatagtttagatatgtttataatctctggataaaaaaacgtaataagtgcttactggataacaaagtccaaaccaatagcaggcaaaataaggcatccaccccccttcttcattaaggatatatattgagaaacaaatcgcaactaaacagaaaaaacttgggagataaagccatttcattcccctattcaagaatctagccaagataggtattttgtattctacaaaaaagaaaggcatttccaagggaaacatgtcagataaaaacttttgtttattttttactatagatagaaccttgcttctcaagagaaagccattaataataccgatgacagctattaatatatagagaatagtataagtatgaataatcttcattagacaaaaagaagaaatggcagataaattacatacgatatattggaatataaaatatttacggtctaaaccttgttcagttgcaatttttttaaaattgccttgcataaaaaaatcaaaggcgtccattaaactatctttcacattagaaatttaaaagctaaataatacgacaaacaatgtgaagtactattcatggtttatttaaaaaataatactattctgaacattatttagatacagaaattaacaaattagaactaaacaagcttttaaatactttaattttattggaaagctataaaaggaactataactttacacactagtcacttctttttaagaggcaaaagggattgggaaggtcgtcttggagataagcactggtatttcggccaatggtaaatagagtttacctcaaatagggtagaacctccttcatctgtcagttaataacagccacttttacaatgccctgtcaaaataaagcggcacgcccgatttttcactcatcgtcatcaaataacccatcaccttttggggccattcgatgccgcgcaccacggtcagattcctcaaaacggggaaaaccaaaatatcctccataccgattccgccgttgatgccgtctgaagcaccgtccatcaaattttccaactcttgcaaatctgcgtttatccgttcgaggtattgggcggttttattcaaattggcggaaaagctgccgatgcttttctcttttttgtctgtaaaatatttcaccgcttccggcgttgcaaattcaggcagcccgattttgatcacgcgcggctgcaccagtttgtcgttgtatccgcccaccttgtccagccacgcccgtatctcggggcggacttcgtctttcagacggtcttcgcggtcgaaatgccgcacaatgtccaaactctcgcccataaacgaaccgtcttctttttgcaggacgggcacttgtttcgcaccgatcataccgatcggcgttgcctcgtcgtcgtttgccagcacggcttcttcaacgtccgcgccaaacagcccggcagccatccgcgcacgcacgcaaaacgggcaatggtcgtaaatatacagtttcatcaaaatattcctcgtcaacctgtcggtaccgactaccttaacaccccgcgccgcccgaaacaagtttatcttcccgcctatgcaccgtaaataaataagctgttacaataaactcgtttttatcggaacggaagaccccatcatgaccgccatcagcccgattcaagacacgcaaagcgcgactctgcaagaattgcgcgaatggttcgacagctactgcgccgctctgccggac

SEQ ID NO: 99 - DNA, 801 bp, Neisseria meningitidis
tcatacatataattaatatagagcctcaagcagatcaattccaaatatatgctgagtttgtagctatgttaagtttcatggatttctaactctaatccttatctttcgaggtgatgattgtcttggtccaactcaaattgttctcattctatgaaggacaacatatcttacttggaccaaataagttccttaatctttaaacaaaatcaattggcgttagtaaattaattcatgtcctatacatattactctaggtctaagcttacttcaactgacatgggatctcataatcactggtttactttagtcaagtggtaaatgggaaagaatcttggcaaattgttgaaagggaagtggcacacaagagaaagtaagaaaccgataggagttattattccttcatgatcagaagtgagattgagagaatctcacaaagacaatcatatcttgttgtatagtgacatgtttcaagaatagggtttttaattgttgacacacacacgatccaatccatcaaacccagcctgatctctttttcgtggctgcgaaaaataccgtcaatcaagagaagaataagcatatctctctgcttattccccaccactttgggctatctcacacccacacccttcatctgagcatgattcttgaacaaaataatattcttcgagagaaaaagtaaaagcttggtccacataaattgtaagattctaatccgatcatgcataaaaaagttgcaaatacatatataaaacatgtgcggatgtaccatattctttagcatctgcaacaaagaaacat

SEQ ID NO: 100 - DNA, 502 bp, Neisseria meningitidis
cgacccgagtcttcgagtaggacccacctctgaatctgtgacagacgccggtttcgttctctctctctcctttttttcctctctttgcttttccaaaaaataaagttgtctttttttatttataataaaatgatttgttgtttcacagtgtgttgtttgttttggggtaaaaaagaaaatcataaggatgctttcaatatttgttttgttttggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcaga

SEQ ID NO: 101 - DNA, 663 bp, Neisseria meningitidis
tagcttgagaaaagactcaagtttgtctgctcccacgcccaataaactcgcataaaagaattattcttgttgtatgaccttcttccaaaacggaacgccatccctgcatgtaatatatacatgacacaatattaatattctttttactctgtagtttgaatgtggtatttcgtttcttttctcttttagtttcagaaggcttgaaaccgcaacccacttcacggctcattaagctctctatcatacagaaaccatattgtaacagatgtactggaaaagaagtgaaacatgataatgacagcgagacgtatcatttactctagaggattgtgaaaagaaaaaaattacctctgagaggcactccaagagcattttgcagcattcttgatgaagtggaacaactccaaaccggtcagctagaaagagaagatgaatcaactcggtgccaaaattcacagtgtcttccatgttcaactctccactatacatgaaattcatcatagccttgaatgcttctggtgatacatcggttaggtaaatcgttgatgaatggctttcactcatcccatttgtaaacatctggatgttcatagagaataaataagaaaattgagaatcaatatattcatgtacatcagaactgcgacactaaaagagattctc

SEQ ID NO: 102 - DNA, 945 bp, Neisseria meningitidis
tttgcattcaggagtagcggttgacaaattcagcaaattgagaatatccagagattggtgttctcttaagtgttgattactattgtttatatcattactacagctctcagacccaactgtgaactgatgctgttgctgtctcctctgctcaaaatattgtttttgccttcaggtgcaacaaagatgaaattaaaagtgtaagcacaatgggaagcatatgctgacaaacatctcataaagagaacaagaaggagcttacacacctcttcttcactgacgtgtgtgactgattaccccaaaaggttcccagaaaacaataacaagtcaaaatgaaaacaaattataagaaaaataagctattatcccaacaccaagaggttttagcttcaccccatttataacggacctctgaatttgaaatatcactaaaaggaaaaagtcactcacagcggctactttccgcctcgatcctcccatccattgcagcattcgtagaaattccggttcttagagttttcaaattgtacractgcacaaagatttcgaaattaaaatttcgacgccaccacgaacaattckacccaacgattccataactaggttgcgattcactatcaattagacactgagactgaaaattttgaatcctaatcctaaatttccgatcagatctagaagaatctaggtaaaatttctacgaaatccctcaaaaaacatacagattcgagagaggagaaagagatatatttagaaaattcgagaagcttcgacagtatctgaatcgcgtccccaaaacggagctcggagcatagaaacgattacgagaacttgataattgctgctaccgaatgatgaatccgatgatctttgatcaaatttgcagcaggggaaatcaaagacaacgacacgaacggtctttcaaatttcgaaaatttcttgtaagca

SEQ ID NO: 103 - DNA, 423 bp, Neisseria meningitidis
cccagtttgctttattttgtaaatcgcttgtgcttgtgtgcgacacctcaacttgagagtagtatgttattgagatgacgcaaaatttatacattcttatgttgtacctgttatactttcaccaggctgaagaattaagaaaatgcctttgggaaaaaaatgtaccagcaaagggtatatgttgggaatgcggtattggcatccattcactgaggaagccattgaacaggtatgttgaatatggtgtttggtagtatcttgatttaaggctaaaacacaaagttttcttttcgtatttgcatcttcaaatatttgcttacatttaaagtaaaccactacattttgtgtttttatcaaacagcatttgcaaaataatgattgaagtatgtgtgaacacctggagtttgcactttgtgagtctta

SEQ ID NO: 104 - DNA, 407 bp, Neisseria meningitidis
aggtcggtatccgtttcagaacctggtatttaagtggcaagaccccaagcccaattgtaatgttcagtatgttggtctgagcagctgggataaacatgttggatatagaaacgtgagtgtgtttcctgtgacacataatcatatcttgctgtggaagcaagtggattgccgtgaagttagaggagatgagtctggtgacgagaaagttgtggaggaagggactggttatgattatgaacaatggggacttgggaatttcttggagagttggcaattatctgacacagtcttccttgttggtgaagaggaaatggatgtccctgctcacaaggttatattacaagcatcaggtaattttcctttgagatcatctgatggggatgtcattcaacttcgtggagtgtcgt

SEQ ID NO: 105 - DNA, 637 bp, Neisseria meningitidis
gaacgaccattatctggagaatttcatgcagcttaaacgtgtggcagaagccaaactgccaaccccatggggcgatttcctgatggtgggatttgaagaactggcaaccggacacgatcatgtcgcgctagtctatggcgatatttccgggcataccccggtacttgcgcgcgtccattccgaatgtctgaccggtgacgccctgttcagcttgcgctgcgattgtggcttccagctcgaagcggcattgacgcaaattgccgaggaaggccgtggtattttgctgtatcaccgtcaggaaggtcgtaacattggtctgctgaataaaatccgcgcttacgcactgcaggatcaaggttacgataccgtagaggctaaccaccagttaggcttcgccgctgatgagcgcgacttcactctttgcgctgatatgttcaaactccttggcgtcaatgaagtccgcttgttaaccaataacccgaaaaaagtcgaaattctgaccgaagcagggattaatattgttgaacgcgtaccattgattgtaggtcgtaaccccaataacgaacattatctcgataccaaagccgagaaaatgggccatttgctgaacaaataaccctcttgcattgtgtaattc

SEQ ID NO: 106 - DNA, 827 bp, Neisseria meningitidis
tcatattcttcaatttcttgctcctcaatgacaacgatggtaggctttacactaggagagggacgaagcaagtcctgagcttcttcccaagtgagtctcagctccatagattcttcactatgcaaaagaagtctcttattttttgcaccaatggttcgagttctcttcttctctttaactcgtgtaggatcatcacctatcctgcccccgttagtctcactgttcaaattctcaggcataccattcaactctttcggtattagtgaaatacacgaggaaccatttatggagggtgggttttctgttacaccagacgatgatgtgtcctcagttgatgttccgttggtgagcccacaaccctatttataaatattgtaaccggataagaatggagctaagcagaaaataaaaaccagcacattcctacagaaaccagttcatagaaaccccaacctgcatgtctccagcattagctgccttcctggaacccatgattagttttccgccaggatcaacccgactgaaagttactgtagaggtgaaaaacacagaaaaccaacaatagttttagaaaatggttcatgaaaatttgatgttaaaaccagcaaatgcttgaagctttagctaagacatgaactatattaaaagtacctgtatcaccagcctgtagcatcatggactgtatgcatggagtgacaccttctaaaacatacattctactattgttattgggccaatatctgaactggaacgtccactccctacccctcacatcttggattttcaaaggaatgcttcggattgactaatcggaggaaaatatgcct

SEQ ID NO: 107 - DNA, 467 bp, Neisseria meningitidis
cccacttaaattgaactaattatgtgtttgcaaaaaacttaaataccacatgcaaaaagtttagttttattttaaacttttaagcaattatgagctacttctcaactgtccatttaaaatgacatgttatatgttctttttttgttgctcatagttatgttataattgtttttttattattattatgagattgtattaaaagctcaaagagctaatgctatagtttttttttttctttttttgtcatcattttaaaacgagaagtgtagccaatgctatagttaaatattatatttaatactacacaaaaaatcaaggttattcaattcaaaagaaaaccacaatggacaatatatgccacatttgcacctgagaaatgaaatacatccatgttttcaaatttacatttagccccgttataatattaattacatataggacccaattttgacgtaaggtgaatctct

SEQ ID NO: 108 - DNA, 837 bp, Neisseria meningitidis
gttgtctggcattacaaattaatggtttagctgtcaaattcaaaaaacatgattttatccacaatgaatctagtaacaatctacaacaacaacaaaaagaatctagtactaaaattggggtcaaaatctattgttaaaacttaatcctcttatttgaaacttcatcttatcttaatcctcttattgctcttttagttgaaacaactctcccacttttggaatttataaataaattttgcaagcttcacatggagtatagtgtgataaccatataaagtcacatgcggctagacttgagagtcgacacatatgtttatgtgcaatgtattggttgggcttcttaattatgaaacaaatgggctttgcaataacaagttaagtttctcgatcaagctaagcaatatctcagctcgtgtgttgattgtttcttttcttggtcaattccatcaagctatatttcttctagtcacggtttcgtaccgttgcctctatccgaatccatgcaacctccccaaccatatataacagataagagatttgcacaaatgacagcgaaatgtgctaaactcgtctggcgtttcctaagaagacgacattattgtgtgaattggaagaagcgtgattagggaaacttgacgtggactttttgggctattgacaaataataaccaactttggcccaaactgttcgtattaatttgtggttcattttgttttctagttgcatcttttcttagcctttgtcccctcggtttagccgctgtgaggtcgggaccgttgttaattattgtaacaccgcataattacataataatataaactcgcaaaataaaaaaa

SEQ ID NO: 109 - DNA, 632 bp, Neisseria meningitidis
tgaacacgtaagtctacaagttctaatttaaaatcacagtttttctttttatattttagaaatttttacggacggagatggctgtggaatgtggatgtacataatctataattttattttacagttctccaataacattaggtgaaattttttccccgaaattttcgacttcgtgaaaattggacaaaaaaagtccataaaccgttaatttcgtgttgtgatatagatttgtgggtcgtaaataatactagcaaaatccaacaaaacttttgttttcttgtgcttttttctctttagatttttttgtgtgtgtctaattttacatatgcatgccctacagataattcctatttatgcatctacagaactcaattatcgtctcagtgataataaatgcagtaactgtaagaaacggacgtatcaatttcttttcctgacagattgaaagttgtcttagagaaatcggtacttatataatgagcatatcattttctcagcgtgaaatcagaatgaaccatttatgattttacccactatatattaaaagagtaggttaggagaaaattgatcctacgtggtacgtattagctaagaccaattcaaaaatatgaaattcctctaatttatcatta

SEQ ID NO: 110 - DNA, 822 bp, Neisseria meningitidis
ggatgtacgattagagagaagtaggaccatggaagttagggaagtaggaacatgtcatagataaggcccaccccaaatatgtggtcgtgcttcatcttagaacctcgtggtgtttggcttagctacgtcgtcaaatcatccatcagaatccagtttcagttttgtcttccaatcatgtttatacacgtgttcctatcgtctttaaagatatctcacgtctcttacattgcctagttgccctaataattttctgccggtgcgactagttttataagactatttgtagtttgaatgtgaagattcacaaaatgggtcttcataaaaagttaaaaacccttaccagttttcgtgatttttctattttgatgtaagtttctgtgaatcgatgtgataatatgtcatgtgagtcttttttctccggctgacatagtaacatgtgatttgataagaaaattattttagtatcgtgataaattttgtgaggtgtttaactttttgtttaaatcttaatgcaaaaacttccaaaccctagatttcttttttgtaattggttttgcatcaaaacacaatatccgaatgtaaaatattgaattagctaaacagtagatgtccactagatcatgagtaggcgatatacatataaatttcattaattcagagagaataataattaaattttgtaaaaaggtgctaaggcaaggtcttaatacaagtctaaattattcagatgaaaaattcatgttaggaaataggttggaccataagaggatggtgctatcaatctattaacaaaagtacaaataccctgagctgtactgccgg

SEQ ID NO: 111 - DNA, 485 bp, Neisseria meningitidis
  misc_feature (468)..(468): N is any nucleotide
ccctgctcttccgttccatgtttctgcactttttgtccatccccattcccacattgtcaccggtgctggtaactcccttctctgtgaatcatacgttgctaataattcttctacactcccgagcggaactaacgactgcccaaccagaaaagaaaagaattagaagtgaagataacagattcttttgtggagctttaactagatgtaagatgaaaagtgtttgttacctgtcgagcttcaaggtttgagacagccatagcaccaacgtatggaagactttccacaacagcatctgccaagtcagatataaacataggttctgttcctagagcaggtactcgcccccagtttttgataccagacttcaaagccaactctttatactcaacatctatctcctccagagtttcaatgtgctcgcatcacaaactgttaaaatagaaacaaacgtgagtttcaaataaccangagagagagaatttgtg

SEQ ID NO: 112 - DNA, 1156 bp, Neisseria meningitidis
ttaaaaagggtaagtggatcctgaccctgtatatgctgaatgaactttgtcattttctgttaaattaatttcgctgatgccatctatgctttgatgatgacgcagttagaaaacagcaacctaagcaaagaaatcccagtattcaatcgtcttgtaagttcttaacatcttctatcgatttggggattatttaatttgtcatttcaagactgattttctctccaagccctcacttattttgtcttgtgtacagttgaaggaggctgctagcttcctaacatccggattgatatccccaggaaatgaaccgatgtatgaattacatagtcatgtatcttaggattgtaaacatctccaggtttatatttccagacttctcaattattaaagcttttcacctctagttcaagattccaacatcggagatcgagtttcaaggagcttcagtacatacgtgatggggacagcaatggggtgctgcactttgtgggtacatcttatggtagtcatcagtgggtcaaccccgttctcgcaaaggttaacctcacttttatcttactttctttattcatattgttggaaatccaattaccatgacaaggaattctgctggagaaaaatatttccttatttgagttctttatgttttacagaaaatcaacattacatcgagtagtcccacatccagattcactgatccaaaggctttggcttcaaaagcctatgcggtatggtccacccaagttcgctcggattatatgactagaatttggcttgaactacaaaattgacgaagcataaaattaattgaagtgaaccttctttcctcttagatacagtatttaaccatatgatttcatttttttggcaccagggtacttcctttgcagggcctaggatggaagacggccatatatcatcctggtgggtggtggacttaggcgaagaacatcaggtctcctccataacttctctttctacatactctgttctcataaagacacaaacggtctaaatgctccatatgtaacccatactcgcagaaataagagaaaatgtatttgagtaaaacaacatttactttaagttctgaaaataatataacacggtgaggattcctggttgcagcttatgtgcaactattacaccttcagac

SEQ ID NO: 113 - DNA, 749 bp, Neisseria meningitidis
acattcaccaatggaagctaatgttggtttttaaaatactcgaaccatattatctagagtcttctagactattctatcacttaacaaacatgcagtttgattacgagtttttctcgttacggatttagtgatgagctagtaaatgattattgattgacaaaacttataatatggttaatgttttccatctaccatttacgaaaaaggtaacaaatttttgtcactaatctttcgataaacacaagtatgcaattttatttttattttttgtattctctacatatgctaagaatcttaattaaaacaataagaccttacactagttttgattatttagaatacttatccacatcccttactttcagtacaaatgtcatcttcattcttccctagacattatttaagaaatatttacgaaattttacgaaatcaaattaataattgtcattgagacatttaaaagtttatcactaaactaattccctaattagggataaattttcatttcttatgacatacaaacagaaacgtgaaacacgtaggccctctttgttaacctcctcacattaataatttgtcgtaaacatcctcacattaacacttcgtgaatgtttagttctaaagagaagaaaaactttaaatatgtttagcatatatttagttaactttgttctatgaaatttaaagtaattctttatgtcttatgacatttaaaagtttatcactaaattataagcgatttgatctac

SEQ ID NO: 114 - DNA, 1558 bp, Neisseria meningitidis
tcattgtgactagccaagtagccatgctggacactaccaaagtggtctgagccaagactttctaccttttgtttttcctagtctagacaaaaactttgcaaataaagtatattagtaggctgaaattttccttgttcatttatttcatcattctacacaaactaaaaaaaaataaaaaaaataaaaataaaataaaaaaattaggaggtttagtaaataaaacggacaatgaaaaaaaacacagaagagaatgatttatatatgttaatagtactaaggaactttggatccaacaggaaaacgtaaactgtggaacaccacgatcaagtactaaggggttaatcctttttgactcctcaagcgcaccatgaacactttgatggaaacaataagcaactcaagagattagaagatgggaaagttttatcactatatcaatgtatatttgttaccaactcacatagttaagcaatccgaagattgtgcgacggaagtgatgggccacacgaaggatcaatgaacactttgcatgagacgatggcacaatctcactgttcggaatatcagcatgatcatctaccatctttaaaatctaggatttgcttaagtgatttttttctttcttaacacttcgccaaatggatctatagatctaaggtttcttcttcttcctccaaggattatatgtgggttttagtacttctcaagttatctcgaatctggttagttttactaacttactattttactagcaaggaaaagtccaataatacgacttgtgtagccaaaaaaaaaaacacgacttgtgtaaatctggaaatgacgataataccctcgtaaaacctaaaactgtgaggagagaagaaggtgccctttttgtcccagcaagaataaatcacgtcggccttctttgcccttctcctttgtccagattttcttcttcaacctctttctctttgcttacccgccaaattccttatctttgaaattgcctcatccctttcgcgtttggtgattctgaagattccgcttcatatccttttgatctgtaagtttcgatttccgatctccttcgtttgtttcctgtcaaatttggttagaaattgttccgagcattgaattttctcgtacatgatctctgtttttaatctgtgtttgtttgatcaagttgtgaaatttcgaattgggttttggtggctcaagggtgttttgttcgttagctaaatccccaacagagagctttcaatttcagagatggtggtagttgtaaaacttaggctaaaacattaatctctgctcttaactagtgttggtttggatttttgttagaaacaatgattggagcataagtttttatagaagaatgcttccaagttagttgcttttgtgctatatcttgagggcttatggttatacaacttatagctcttttatttgttttttgttctcacttttctgtcaaggtcttatgttagtgttcatactttgttttcttctttacaggtctataaaagacactactggttgaattagaatctgtaagagatattagtgtttt

SEQ ID NO: 115 - DNA, 860 bp, Neisseria meningitidis
agcgatgaaggcactactcttttgcccatctaactatctaaataggcctagtcgaggataaacctttggttcttttcgttagttaataggcctaggatttgtcttgtactaattaaatgttgtataataatgtatacatatatatatatatggttctttatagtttcacgctgagacatgaacattaactgagacaactttaaaccttgaatataattgagcttgttatacgtgtcagtttcttattacatcaactgaatttatttatcactgagacatttattgactccagtcataaatagtgcgtatatgtataattgtgtaaaaaaggtatgtaaaatgtatgttgagaaacaaaaaaggtaatatgtgtagaatgctaaaaatgaaaacaaagtacaaaaaatcagamctttcattggtgtggcatagtggttactggctcggatctactaggacgagtacgatttcggcccacgtacagatctaatatcaccgcaccaaattaacagattgttggagtttgtccaattttcaagaagtagattcaaacaatactttcagaaacggaacaaaagatctaaacgatattggaaaagtctactgttgtaactttcctcacaggaccacatccccatctccgtcagtagaagaaattccaaaataataaaaataaaaactgagaataattgatatgtcaaataaattagaactagcgatatactgcagtgaatagtagattaaactatgttagaatttggatgattctacataaaaccccaaagactagtaaattagtcatgacgcattagtggagaacatttttctacatttaggaaagatcgaaataccaccatttt

SEQ ID NO: 116 - DNA, 467 bp, Neisseria meningitidis
ctgttatcgttgcgggtatttctcaatctctctaatttcctattctaaactccaaatttcgtttgatttttgactaaagtctcgatcttttcgtgaccctcttcttgattctctgtttagctcttagtttgttcatgttctgtttttttgactacgtatatggtttcttagtgcgaatcttgactcttttaatctataaatagggaaaaaatatgtgactttggtacataaaagggaaaaaattgagactttggttgtaatgattttgttatagatctgcgtatgagagttctctattctgtgaacaatttcataaggaccaatctggttggagggaatgctatttgtgtagcaaggtgcgttttttgaaactgtgtgaatatgtttgttttttctatatatagagtttagtggtgatgttttgttgtgctgattgagaatctgtgaagacagagactacattgtgg

SEQ ID NO: 117 - DNA, 468 bp, Neisseria meningitidis
atcccccatcttcatcagctcacttctcaacgcttcgctcttctccgctaacgtatatcagcttgcagttggctacgtgtctttaaagcttcagggagaacaactactgctctttcttcttgttctgcgactccacttcttagctttaactgatcgtagtaaagagcgtgaagaacaatgtttactggtaatctcttgttctgtgaagcgtgaagacgtgcgtcgtaagaaagctttaagggatccattgagctacacactttttccctttcgatctcgtctagattcggatgagctttcaagaagatgtctatagctctgtagagatcgtcgtctgattttctagcggatttcgggacaagattcgcaatcgcgttgaatttggagattgttaggtctccgtaagtagcgatctccgctaagtaagaatcaactgttttagctactctttgtagtgaaacagagcag

SEQ ID NO: 118 - DNA, 1698 bp, Neisseria meningitidis
ttttttttttttgggtgaatttttttttttgtttcaatttaatttatcgatgtgaaaaattaaaacttttatgggtgagatagagagagaaagagggagagagcattcaagtgaacgaaacgcataaaatgcatgcacgacacttgaagacacacacaaaactcgaaaagtaagaaaactcgcagagatttagaacagacacaaagtgaaagactttggtttttttttgactttgttaagatatgtttttttggtatataatatatatagaaatgaaatttagggttggtaggaatcatatattttggaaaaaaaatagtatggtgacgtaattttaatatttggttatatgtattcaactaatttataggtattttcctttctacagttggggtattatttatataaggaaatattgattatttcatcaagaaaagaaagaattattcaatagaaacatatatgtttctttttgcaaatcataaatatatagagtgcatgcatgacactaacacacacatgcacaaaagactttgaggttcttctttttctcttttgactttcttggtttgttattgtcaattactctaagaaatcattttaatttaagtttgtaaaagttataaaaattatcctaagaaaagaaaataatagtacataaattctacttatctaattaaagattataatagaaatttgcgatcgcgtacatgtatatgctatatactctacctgtcgtcattctctgtatatgtattctaaccaaatttgagttccgaataccctaaaacttagagtggattgagaccgatagataagtaaaaattgacgattcatatcaaacatgtagtcttatggtagaatatatattccaaaataagataccaaatttatagagaacttgcaaacgaaatgggaagaattggtggaatataaactaaaaattcattcttgcttaaattgaatttttttttcctacactgaagaaaacaaaattagtttataccatcgacaaaaagaaatatgcaaaaaatcaacacaatatattttgtaggatttgtttattttttgttaatacttttgaaggatttgtagttaattgaatatatatatatatatataatatattatgtttttttttttgccattttactacatttaaccataaccttgctatttatggagtccaatagtccatgcgcatgataaacatacagtataagtgttcacacgattttatatatgcatgtgattttctgtcaaataacacgttactacccaagaatatatcatctatttgttctaacttttactcatgcatgctctattcacttcgtatttcccattaaatctttaatcttttctatctaattagttcaaatttaaatctaactaaaatgacaccatatcttttggaatcgctctcttttgggtggaatcttctatattatcaacgagctactattaagttactacgttttttcactcccttttttgaccttatatatagctaggcttgtaacacctatcgagtaattgactactgttggaacgagtaaaaaacttataagttttaactcagtgtaaaatgtcgccgtctgggtaaaaagagtggtaatctatgtattaacctaaatttcattatacacttatggaattttcttgttgacagcaaaatatatagacataatccatttt

SEQ ID NO: 119 - DNA, 794 bp, Neisseria meningitidis
ttgtccaactatctactatacttatgtgaaaaatacatacatatgcccaaaattgttatcaaaccaaaatgttctggaaatagcccattggacatctatttataaaattgcatacactttagctaaaaaaaagtacttcagtttgttgttagaatattcaaattcaagaattatttttgaaagaattgtgtgcagaatatcaaagaaattttgaaataattcagaattgtgtacacaatatcaaaaaatccatttcgaaaatgctttgtacacttgtgttttggcttgtatttttattttaaaagtatgatatgtaaaataaataggaagtgtaggattattctttttcttgtctaataaaaaataaaaaataatcatatgcatttatgaagataattaaacttttaaatactttttaatatttcatacatattatccatttctcattccaaaaaaagagtttaattctcagtttcagaataaaatgtgggccttatacagatttagttggcccattaatgtacaggtgacaataatccaccaactcgtttctcctgacacaaaaaatatctcatcatgtcttcttcttcgtattcgtgtctctcatttccttttttgactcttctttccaaaaaggattagatctgactcactattacgtgtcacgcacagttcattaggtacgctcggaaaattttatccacacatctaaatatctgatttatgatcaaatcacccatttttatttttccttttgtagcttctcaaatcttttgtccttaatcgatttaaaa

SEQ ID NO: 120 - DNA, 480 bp, Neisseria meningitidis
cagtcaggttactaataaactttcattatcccttctttgttatattactaatagaccaaaaacatttcagatactcagtgccgatgtagagcctaagaagaagctaaagcacattgtcatggcggctacaaggtgagtctaaaaaacaagtgttctctttaatgattcttcccaaaatgattgtttgttccttggttaatatatagggaacagaggtttgagagggtgactaaaaatctaaaagtggcaagagtgtttaacacattggtagaggaaatgaaagcaatggggatcgcatctgttgatgactcagagtgtacagaagttatggctccagttgcacacaaggaccgaagcccggttctacttcttatgggaggtggtatgggtgcaggaaagagcactgtgcttaaagacattctcaaagagtaagtaaagtatcaacatatctgtcattaatcagtgttcttatgcattgaa

SEQ ID NO: 121 - DNA, 454 bp, Neisseria meningitidis
atataagagttaatcttataaatagttttctgaaacttaatatactataacaatgtaaaagtcgtcgctttgttatttgaagtgaaaattaagcaatgttatgatatttttactaattaactcaatatgaaaaacaaaaatcctcttaactaaaacagaaacataaaagacgacttagtttttgctttagatctagactcataactcaaaaaacaatttcattataaacttttgtagatcttacaattttaaaataaaatgtacattaatgttgaaaagcaaaatcttaaattagtgtatactactactttttttttatcaccgtgatagatcattagatccttaacctcaatccctagagcctgcttattgcctttaagcattgtgcaatcactaccaaacacactcaaaactaaataaatataatttataacttatcaaataaaataaatac

SEQ ID NO: 122 - DNA, 842 bp, Neisseria meningitidis
cctcgaatttgttttattttttcattaatcagaccagacacagttgggataaaatgaaaggggcttgaggagtgaggacggagaaccacacgtgtccacacagttgtgataatttttttattcaacaataaaattgcaagagacgagtttggtaagtaaatccggttgaaccggtccgaccggtattgaccgaaacatacaatcttttatagtcttcacacattgttcccaactttaaacttagaaaccttagatgttgtattcaataattgtcaaaccacaagtactgacagatacagatttaaaacatttttgttttgatcaatttaactagatctgttcattcacctgaaaacaagtctctacagagttctccataaaatcttgagacaagttcaatgaagacaggactcttaagattcttccaacagaagagaagttcctctatgtccattaagtcatctattttcccttcttcaacaatcagatgaatcagatagttttcaaagcttctacaagcatcttccacagcattgtcttcaaatgtatctcttgcgttcagcgatttcctggtccgtgaagagtaaggtgtcgtgatgggtgaagtgaagagcttcttggctgttgctggcgtaagaggtgattgcataaacttggagtaatcatcatcgttcacactaactgcaatggcaaaataagagaacaaagagatcaagaagctgataaaatttcaatgttaaaacagattttgtagcgaagttgtcttacaagaggaacttctatgtttggcgttgctcatcttaaggttcttgcttgaattgaggaaacagagacaagaacag

SEQ ID NO: 123 - DNA, 1000 bp, Neisseria meningitidis
ccagtgatcttatttcattatggtgaaagttggaacctctcacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggargcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgtcaaacagagaagctggctgttatccactgagaagcgaacgaracagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcgaattatgtcagcaatggacagaacaacctaatgaacacagaaccatgatgtggtctgtccttttacagccagtagtgctcgccgcagtcgagcgacagggcgaactcgmagtgagcgaggaagcaccagggaacagcacttatatattctgcttacacacgatgcctgaaaaaacttcccttggggtatccacttatccacg

SEQ ID NO: 124 - DNA, 467 bp, Neisseria meningitidis
cagtagaggccataccaattatcggccttgctataatggatttggtggaaggagtccgataatctaacttgcatctaataaattcaaacttggcagcgagccaacttgcattgaacctcaaacattatgctattcattctttacttaaacttttgatctgagaaattgtttgtttttatgtaagttggtcgcctttattacaaaagattttgttcttacttgatagttactatctattgaaatgaaacaagttcttatatcacttttatgcagtttgtaggaaatgcatttatgagaaaatcacagaggatgagatagagagctgtccagtatgcgatattgacctcggggggtacccaactggagaaactaaggtaagttcttcttcttctttattccttacacaattttctcctcggtcttggtttagcagtgattccttgtatagactgttagaagccttttgg

SEQ ID NO: 125 - DNA, 1343 bp, Neisseria meningitidis
taattggaaacgcggccaagaaagtgaacacgctttctctacacgtctttaactccacagctacttatgactcacctgcttattttaatctcctcaaaagtctttcctttttttacaattttttccaaagactcaataattgtggtatgatatggaagagagcattaatggcgtatcttcaacgcccaagattttgcatgtggctctatcgtgattcgagttttgatccatctctctaggtatagaaagagaaagagatcaaaccaacctttaacaaacttatggacgtaactatatcacttacaagccaagtcaatgatgaagaaaacatagactgatgatgtgaagaaaaaaaaaaggtagataacttgtgggattcttgatgttaagtttagagaaacaaagttgagtcacttctctctttctatgtattcatcaatctacaacgagtaaattagcaacaacaaaaaggaacagaacaaaacaaagatcagagggtctttgtgtatcaatagctctcattgttttcattcggaaaagattcgaacatcgcacgctggtttgagaccatttatcacatcactctgcttcacactctcgcacgcaataacaattggtatatgaaccttaaatcccaaccaatcaacactcagtttccctctcaagaacacatcaaccaaagcttcaagcgtcttctctttgtttgtcagcaatgtagcatcaacatcatacactttggattttctgagtcttgtgaggatcttcaaggaggtaacatttcccgggtcctgcttgaatccagaaagtgtcttctttccgaggtttatgttctcagaagatatatcagctttcataggactgtaatatagcaccgtcttgtcattattattagagagctgaagcaccgtgttcaagttcgcattcatcagaagatctgtcgatgatttggcgatatccaatctcgagaacttgaggtttgtgacaagcacctgaggtagtatagatttgattgaagagtttgcagacaatcctaccaacaagacgattataaggacaacagaaacaaacatgcaggtgcaagcgcagcattttctgaaacatccagaggcgcatattctcttgtcctcctgaccgatatgatccacaaaggaacccgattttctactccgatcggcctcttcttcctctcgaaagccagacagtctcgacgcagaaggaggccgcttaaaagacgaagcctttttcgggttttcaacatcatcaaacctgtttcgagaaatggaagggcttgagaatcttgaactcagatcaaaagaacctttgccatagctactatcttccgg

SEQ ID NO: 126 - DNA, 1934 bp, Neisseria meningitidis
tatttttcccccataatttaattcatgaaactgacttggatagtccgaaccactagattagattcgcatcatacaagtacaactggattataaaactgaaatagaaattcaactataaaattcaaagcacgtaatgaacttcttcttttttcacctattgtgtttccatataattccacaaatgacattttttaactggtagtgaggataataggatatgatgattctcaaatttcgaatatttgtatattggttgttaaaaacattcggataagtcacaaacatataaatcagcataaccttggaaaaaaattacgtttgaaatctagactaatacatccaatccaatgattagtttgaactacatgcataattgcatactaaataatgatcaagtatactaaattctggagtttgatatgattaagcgmaksttaatgtttcggccatgtgaaacctcgtcttagaatagttgtcatcacgcgatgttggctaacgtaacaagaatcatcaatctcgtaccacacatgttgcacatgagaaacaaacagccgcaatattcttgattcacctttcttcttttctcttttaaccaaaaacataagctgcaatattcttaattcacactcgggaccaaaacatgttaaagagttattgttttgtcattggtattcaaactcgtgatcttgaagattttttttttctctggtcacaacatcataatcatgttattttctaatatttatgtatacttagaaataaataatatagttaggatattttttaagtaattaattaacatgcaaaggattttgtaggacggcatgtaagaaacagaatcaactgatagaaactgcaataatgcctgatacacacacacagctgtaattggggctcacgttcccagcttgcaatagacatttttttgtttatcttattcataaaatatataattacaatactaatatcatggcatctcattacccctcatataattaaagtataaaaaaacaataaagtataccacatttctaaaagaaaagtacgcattatgaactttattaactcaaatatcgagtatcagagtaaaaatatgtcatatataagccatataggcttttgtgaaaatcaacggcatgtgttaatgttacaggaatgaatttggaatctttaaaagggaaaaaaaacaaaaaatgaaactcactatgcaaaaaaccatgtctacctaaatttggtcacaaacatgttttacgtgattatatttgccttcatgaagtatagaccaacaagaacgtctcaaatagtaaagacagaacgtgggtaagtgacaaacacggttgcatgtaaaaggtaggtacaaacgctatatcgacaaccagatatggttggtgtttatatctgtgtaacctagtggtgcatgctcaatgaaagatataaccaaaaataacacttttttccttatgcttaagaaacatatcagatttggtgataacttgaactaaagacccaagatatggatatgaatttcttacctaagtttttaaagagtcaagaagcaatgccttgttaaaacaaacgagctgaagtgtgcgtctttccagcattatcatttgttggaacgggtctctacttgtcttttctcctgattctgtctcaagattcatatgttagctttttgtaataattctaggtaataaacaaattatcttagcaaacagaattaaatttacctctgtttctttggtgacgagcttccatgacctccttgttggggttacatctaacaacacttaagaaatttttatgtgtcagtgtaacatattgtaagagatgttagtgaagaacacaaagaagtgtgtgacaatgttcaccgtacatactcattttcgtctgagaggctctttgcaatggatgatgaggtctcatctccctgg

SEQ ID NO: 127 - DNA, 1492 bp, Neisseria meningitidis
ccctgcctttgcgaaacttggataatcgatattcctttttaaaagatgtgatcttcgagttggtgaatctgaaatacagaaaaaccaaggaattagcaaataaataggcaaaaccccagtaattccaacaaatatgtagataaatcacaaatatttctccaacttcaaacaccaacaacagaggaaactaagagatactgaaagaaagtgaactaaaacttaagagatatgatttagaacttccaaaagaatgatatgaaacactgagtcaatgaacctccaaaagacatacgcttagactataattattttatgaatacaactaacaaggtcaaatgaaaattctttgataaaagcatatatgcgtgttagctgttattcctaatttagttgagataaacccacctctaatgttggacctccaggtcgtttccaggtaatccctaaaacgcagaagacttttaatgtcaaaaggcacagtatcaccatcataaagtgacgaaataagagagtttgaagactacctcttctttttcctatggtgttctgtagaagagcgactctcagtgcaatcattgcaatatttcaggaaatcagggttcaaactctccttttggcatggctgttcggccttccagtaaaaactatcttccccgtcatcaagaaaggcgggcttagctggttaaggaaggacaagaaatcaaattcatacatctttttacttgatctcgtgaggaaagaaagaaacaggtgcacatatcttatatcagaaaagattccctatagttcatatcacaccacatgaaattgtgtaatattcactaagaagtgacatgctactttgatcaagtcatgttttccataaatttcagaaggtagtgggttgcatagatggtgatttgtgaatgaaaagaaaataaaccttttgcataagacattaccattccattcatcgtcagagaacctgctgttgttgaaatctgcaacgtcacagaagtaatttctagagtcgctatattgtttgtgcaagtgatcactgaaagtttgcagtttttgctttctgcccccatctttagcatgtatgccaattggagacctataaaggctgtcatcttggaacattttgctactttgaatcattgtgtcctgtaagagggagatgaaaatatccggtcaggaaaaaagagttagaaatgaatggaagacagctaaaagataagatgacgagactttgttaccacttcgttctcaaagtcgttgagccttcccctgacatgtgatgtatctggttgaccagtatccttccatggagaggagcaccggtacacaaaagttctttcacatcacaagttaaataaaatcactgatctatatcttaagtggtacatattactgctaatgtaagagaaaacagtataaataaataaaaaggaaaacaaacaaaatgcaaacaagtcccaagaaaaaaaaatactcgtgaatgctaatcacc

SEQ ID NO: 128 - DNA, 339 bp, Neisseria meningitidis
ccatacatccagttccacacaaaactgagtggaaaacaacagaaacctgaccggaagaaagtggtgaggatggtgaagagattgttatcagaccacctagggatttaagacaaccaccacggccaaagaagaggagaagtcaaggagaggaccgtggacgtcaaaagcgggttgttcgatgtagccggtgtaatcaggctggccatttcagaacaacttgcacagctcctatatgaaaaacatatgacatctctctttagatgttttacttcttctctgatctgaatttattatttcttatacttaggtttagaatattattttcaaagcctttctctg

SEQ ID NO: 129 - DNA, 746 bp, Neisseria meningitidis
ttgcataaaataatatgactaattcgtgaaaagacaggtcttcccgcctcttcgaccttattgacctcatcaaccatctacttgaaaatttactctattataaatatccgtcctctcacctctcacttttaaacaaaacttaagttttcttaaagagtcactaagaacttctaagatttcaaagaatggaaggaaaaggtggtagcggtggaggagggaaaggtggtggtggaggaggaggaataagcggcggtggagcaggagggaaaagtggttgtggtggagggaaaagtggtggtggtggtggaggagggaaaaatggtggtggttgtggaggaggaggaggagggaamggagggaagagtggtggcggtagtggaggaggtggctacatggtagcgccggggagcaacggatcttctaccatttcaagagataagtttgagagtgatactaaaggttactttgataatctccatggtaaaaagtgagtttggtctttattgatcatctatggagaatggagtgaagatggtttactaccaaatatattatgtaatgaatgaataaatgataatttgctttattgtcttaccccatgttaactatatgtgtattcatcaagagactctaaaacttgtgtaataatcagtgattgaaatgtaaatgtaagattaatttatcaatttggttctcactgaccattatggatgggcttttgaatacatccatttcaattgtttggt

SEQ ID NO: 130 - DNA, 474 bp, Neisseria meningitidis
ccaattgcgtttcaaaaaattgcaggcagtgggacaatggatgcaagatagggtgtgtgtgtgtgtgtgtgtgtgtgtgtgtgtgtgtgtgtgtgtagaaggtacaaaaggaaaataaatcttgtggcccccaaatcactaaaccaagggaaaaatcaggctggaaactgtcaggcaaacctgcctcccattttattcctaaataagatagctagaaatataaaagagctacatacctcccttacaatttgtccacaaggaaattccttgtgggcctcaagatctttatcctaagacatttctgttgaatttcaccctggcaatgtaaattgatggctgatcttcccaggtgcaggacagaaagtcatgcctctgcacacctaagacaaatgcatatctgattgcttcctctgccctgttgtttatgtaaaaatgcagattcactgactagattgcatattcagtgagaagctg

SEQ ID NO: 131 - DNA, 1476 bp, Neisseria meningitidis
tatgagagcaaagcttttgttgcggttatcaccaaggacaaagacataacctttggggacaaactgcaaataaacatgaaaagcaaacattgttaacaatctgatactcaacaaggatgaacaagtggtaagtaaaagttgctcaccattggttccatttcatatgacattggttctaagacaaaatcttcttcttgcacaatgtcattcacaaagagcttcccatcacgaacctgcatggtacatcatctacaggttagacaaaaatttgattaaaaaaacagaaaaaggggttaggtccatttctgaaaaaaaaaacttgtagtccgagaaagcctctacacaaataataccgaccgaggtgaaaaaaagacttcaatgggtgaaaaagatcaatcaacaagtggattggatataagggcttacttcaacccagtcaccttcacttgccactatcctttttatgaatacatcattggaactgtagccatattccggatattcctgcaattcaaagggagaatatcatcaaattctttagtttacaaaagttgatacatctgaataacaagaacaatgaactgtgacttaccagcaaaattggaggagccttgaagattactatatctgaaacctctggcttcctgaaaaagtatgagacctgaccaacaccaaggcacacaaacggtcagtttagtcataaagagactaaaacagcctcattcacaaacctacatcaagcaactaaacaaagctcaaggtgaagtctagcaatcacctatagaaaaaccttcacattcaatcacataagagtatcatacaactatctccatcctaaaacatgcaagaactaattccagaaccgtgtagaaaaagtcaccatccatcatcagctatgttttatgattacaattatacatgaacagactcagaattcataccttctccgccataacgcgatcacccttgtccaaggtagggtacatagacgttgaaggaatcgactttggctccgcaagagctgatctaaaaaggatagaaacagtaaccgccgtgaaagcagccttagcatcctcagaacaaacactcaaaagcttattaacccatccacttcctccattcctcgattccttatcatcatcatcatcacaaactgttcctcctttatccacgtcatcaatcaccggtggattcttaatccatttcgacccttgaagaaacggaataatagaagaagccttgaaagatgaaacccccagaacattcatcgttgacgactcatgacccgtcgttgacttcaatatcgagatcaaacccatcacaagcgggctttgacttccttctccgatgagctccctcgcgatgctaccatacatcgatgcaggtcgattccgaggagatctatcgaaatcacgcttgtggggagaagaatctaggacgaaccaaggattcaaagcagtaaccaccgggaccaac

SEQ ID NO: 132 - DNA, 633 bp, Neisseria meningitidis
cagccattaatgttaacatttctttatgtacatttctgatctttggttgtgtgttttctctcatctataggtgcgacttcaactggaaacactgttagctgagaaagcacggttggctcatgaaaactcgatatacacccgcgaaaacctctatctgagaggagtcgtcgaatatcaccagctaacaatgcaagatgtggtctactttgatgagaagactgaagaagtaacggaggtatatcccattaatgtgtcttcaatgtcttcttcatcagataactcttacaatccaaatccaagtttcttggagctcaaatgaaacaccacaacaactatcagtttctgctgttcttgttgtgaatcagacaagaagacaaatcgttgcctgtaattgctctgtatttgtagaaatatatatactctgtactctttatwtggggtggggtcttaagaattagcagtgaatgtatttattacccttaattaacttaaataaaagaagaatgttctattatttccctgaaacagtaccatgaaagctaaaagttgaactggtgagtagaaattagtcaattattaatggatattacctgaaattacagaacaaacaatatatatataaagctacattac

SEQ ID NO: 133 - DNA, 575 bp, Neisseria meningitidis
aagccttttggctcttactgttgatgaaacgaattttcttacataatgctgaaaagttgtacatgattatgctgaggtgtgccacatatggaaggttcttccgtaatttttgtggcatagtgtgaagttaatcaagaaaagtcatttcgattcagaagcagttatgacctgaatatgttggctagtttaatactttcgctgacaccaacaattttttgttagaacctgaaacaaatctctttagtactacactctctcttactagttggtcaccagtaagagctttgttggtggcgaacttattcattttctaaagaaccactcttatgtatttattttaggcctgaccacattttgcaagacttgagagccaaattatttcctctaaaacgtaaaaaggagagagcgcctgaagttgtgtcctccatctcattacctgcaaagaggaaggagaggtctatctcgtctttggtggtaagcacacccagggtttcagcacaagctggtacaacaggaaaaagaacaaaagctgctacgagaaaagatgtaagaggtagtggttcattcactaagag

SEQ ID NO: 134 - DNA, 384 bp, Neisseria meningitidis
ccattattgtttttctacttgtaactgttttagaaatatattgattgtaaagaaaaaattgttttttagatattatttttttaattacaaaattagtaaacctcactataaattaataattattaaaattatcgataaattaatatatttatgaatatatagaatttttcgtttctaatattattaatttgtagaggttttatcgtaattgtttttggtaaaatgatttaacctcttaattaatctccttataccatttacaagtctacttcatgcagttttcaacaactgtcataatttgtgtttaacaatattataagaaacaacttttaaaaaaattaaaccaactaggcatttggttgaaaacaattacaaaaaaaaaaa

SEQ ID NO: 135 - DNA, 757 bp, Neisseria meningitidis
  misc_feature (720)..(720): N is any nucleotide
tacatcaactccgtgagacttttgcatttgctacttggagctctacggttacttccgttgaagcgctctgcaatgaatgaccttttgactgtttctactacacacgtttttgacgtttatcctgtttaccttttgttcttgtactacagtgatctttgaacctgaaagtgtttctcaatatatgttaaacttgattccagttagattgttttggtttttatacaagagatttggcctatggctgtggagtaatgagttatactttgttttttatgactcggtttaagaatctcttgcataaaactgacsaagcasactcttttttgacaaaaaaaagtatcacaacagagtaaaatcaagacctagacgaaaagcgaaaaatgacaaaagccacaagagttgtggtaagcaaaatgtttgggaaccgctcgaatcttttaaagcatttggacatccatgagtccggcggcaaatgatgtgtagaagggtatgtcacaatctttggagcagaatccgaatgtcgaagtggaaccatattctctacgaaatgagataaaacacgaatgtctgcagcgataaaatggacttcgtttgtttctggattatatttgaacagcctcttttcactgtcatggaagaaaagattcccttgcttagaaactgtcactggtctacaccacaacctccatatccaagggtgaagagctctagggaataaancaaatgagtacgtcttggtccatgtatcttccggata

SEQ ID NO: 136 - DNA, 380 bp, Neisseria meningitidis
cctagaaaattttccttatagagatatatacagacagtaacaaataactttctaaattaactcttcttatcacatatataactgaaaatgtaaccaaaatacaaactggatccaactcatatatacgtcaaatgttttccaattcaaaatctaacccaacacaaattaagaacgctaaattgatctatagctaaatgtcattacacaagtaaaaagaaaccgttttgtaaagttataatcaatctgaccatagtctaatttatttcgtcacaaatattttctaaacgatgatactcttaaatgttaaaattcaatcatatatttatacccaaacaaagcggctaagtaagataggaacctttaacacaaccataaatagc

SEQ ID NO: 137 - DNA, 1223 bp, Neisseria meningitidis
tgtgtgctcgcattacgacataaaaatgtaatttgagttttatttcatttctttgacaaaaaaaaaaaaaaaagttttatttcatttatttacccttttttatagatataaaatatgtaaatcaaacttttatatcgtacaatttaagtatatattttgtgttttattatgtcaagttcattcattaattttaaatttgatacaacaaaagaataatgtagaaagtcaagtatacaatgatggatgaatggatttacataatgcttttttggtacgtaaacgttagtatttgctaacaaagtattagttgcgttatttttttcagaacaatcaatcctaattttaaatatttttattaaaaacactatgatacatattaatttacattataatttgttattgaaaataaaaacggagcaattttgtcataggttttttttttgtcaaccacacaaaaatggtttacaaattacaatgtaactttaaaaaatggtatacaactacactaacaaccataggtcacaagaaaccacacttgctattttttctagatccaaatttcacaatttaaaaccacacaaattttctagaaggaatcaatatttggaatgccatttaataaaactttaactgttatttttaaatatattgaatttaaaacgaactttgaatgtttgtgtagttttagacgaacaactaatttgtcaagttagctaggtgatcaagatagaaaaaagttcgtgtgaatcatattttgttcatgaaaatttggtgtagtttatggttatgaggttatctcatatctatgtataaaattagaatgtagaattttgtctgacatacttgtttaaaacttaaaattatgatacatatatcacctattctttttaattcttaactttataatccaaaactgcaagatcatttaggcccattgatttgaatatttgttgcttatgttcactcagaagtcagaaaccataccatatcacatgtcttttgctgaaactcataagccaactgtggtaggggaggaatttgcaacagtggtcctctctcttctcagagttcattcttcccttcttcacagaaaaaaaaaaacccttaaggattaaatctcatcactgtttctttcttctttaatcacatctcagttttatgtgtcagtggtcctctctctaccttcaacgattatccaatgttcttcatgcatatatataaac

SEQ ID NO: 138 - DNA, 659 bp, Neisseria meningitidis
actagatacctcgaatagttcctgtggaatcaaaccagaattagtagacacataatcttaccaaatgtgaaacaagggtgctaataagggccttgttacagatcacgatcgaaacagaggacacaacggataaactcaaagcgccgattgttccaagctggaacttctgggcatcgctcatatttgctcgcttcttctatcacgatctacgatgatctaataaaaccaacaattacagtatggaggaatcaaactcacatcacatgcttagccaatcaaaaccaaaagtaactgtaagagcaacgcgragaagaaaaaaggaacctcatttacgaaaatgcgagagaattcaaagcaggagaagctgaactgcaccaatggaagataataacaacacgtcaaattacaagcagaacaaggatagtgtaaagtcgaagaatcctgaagcaataaaccctagatctatcgatgaagataaaaaatagtttaacggagattcaggagaagaaaaggagagaaaatggagagagagaccttgagagaatcagacaagttctaatggaggagaagagaatctgtgaatttggaagaagaagcctatttttgtaaattccaagagattcaccatacgtcaaaattgggcctatatgtaattaata

SEQ ID NO: 139 - DNA, 767 bp, Neisseria meningitidis
ccatctctcaaactcttcaacgagcttaatgaagagagaatcagcaccaggctcttcagagaagaagctgtatatgtcttcctcacagctgcctgattttcttatgtactcattagctaatttgcagagatgaggacattctctcctgtccttgaatcccatctgccgcactacaaaagacacaaacaacatttccttaatatgcatcataatctaagatcaggaagatttcaaggaagctatgtagattgattttaccaacatagtgagagaatctctcaagcttctcatggcctttgtgtttttgagacgatctgagacgagggatgttcttggagtgacgtagcttccttagacggaagtgcagtgcaagggctaagagtaagccaatggatgagattactaaaatctgtgcgaaggtcgtcgtgttgttgttgctgttaaactctggaacacacattgatctggatttgctttggggatcatcaagagacatgagattaagattgttagaactctaagattgggtccattcttgagtttgttttctgttacgagacaatgtatctgctttctccacgtgtgttgtactaaaatagctttgagtcctattactccggaagtttcttagtttgctttttgtgtgatttgactcaccattttgttttaataaccaaactctcatccccaatgtatgatataatagtgttttggcaatggttttataaaatctattcgttaaggctataacataacaagaatctgtc

SEQ ID NO: 140 - DNA, 453 bp, Neisseria meningitidis
  misc_feature (407)..(407): N is any nucleotide
cctgcaagcagagacgtctagaggattgattacgtatcctacaagtaagaaatagaagttaccggcgacattgatgttctcgacgatgtaaagaacattgtcctcgttgatttctcccttctgctcagcttcaaggatgtgatcaatggcacatttcaatccttcactacctgtaggcttagaactcgcaatttgcctgtaagaatgaatcatcaatgtcaatttcccaaaatcaaactcaaaagataaaactaaaaatagaaacaaaaaaatgaactcacttcctctcatcaacaaagtacttcttgaaaagagcgattcttcgatctttcacatcttgacaaatcttcaaatagcctctgaggaatggtctaaggataggaatgaaatctccatagttatactcnaagctctgagctaatcgacttctctcaccattcaaagccttaagcc

SEQ ID NO: 141 - DNA, 1208 bp, Neisseria meningitidis
cttctgttttatatgaggtatccactcggtctaatatggaaacacatagaccgtagttctatacattggttcaagtcttgtgcttatcaatatgactgtaaggtccccataaatgtttaaactaaagttaactctcccttttatttccgacttgtgtaccgggtgatatcttatgatctgggactttttcgacccaccggtgttgaaccttaactactctatgttttttttttgtaaacaggtagagataacatgtatgggagaaccagtgatcccaacgttgcagcttcacagcttagtagacctatggttggaaacaacttctaagcatcaaagagtcgctgcgtcaataggttcatctgcaaaggaatttgtaatggtgctagtttattctcggaagctccctgaatgcaacaactaaagagctattcattgaatcttttctagaccgagaagaaagaaaagtgcaggagcagtggaatgtcttgtgtagaaagaaacttagcaatttatatttatttaattgtaatcttaaaatttgaaacattggtgtgagacagacactttgtttgtttatccaagaagattcaaaaatggctttttaaaggagattgtgtcctttttggatatttgaatgtatgattaggataatgttgtcatttctataaatatttgtttccttgtttggactaaatggagaagtacacggaatccttgtgaatcgaatgacttagccattattgagaagtcaaaagaaaaataaccaaaaaaaaacttgtgaagtgtacctttaatacaagaattaaagagagatgtataaaagttttctaacaattttgttcaccaaaaaaaaaagttttctaacaatttttaatacaaaatgcaaaattaaagatgaattttcttatttctttttttaaaacataattttgaagaaatttggttgtctttttgcatttgtttctagatatttctaaactgttgggaaataaaaaaatttgcacacaaaacatagttaaattcacgtggtatttatagagatttacttcaaccaaatttggattttgggtcattgttttatggacggataaactatccattagtcaaatttccacaaaaataatatgtgaattagattcgacaaggctaattcccccacaacatacgatactagaacaaacgtctctgactacttgacgtaacaatgt

SEQ ID NO: 142 - DNA, 568 bp, Neisseria meningitidis
tcttttagtttgagattagttgtgcaatcaaaggaaaggaaacttcttggcgagtagagagaaatggtgattggtgaaggtgaaactcttttttctcaattttaaaattcatttttgttatttttagcagaaagtcaaacatttgaccgaaaaggaagaagaaggagataagtcaaatccggctgctgggcttattgggtcacacgatcatgtcgtttcatttgttatgcttgacgaacgaaaccactatattttgtttaatattactttcttttaagtaaggataaaacatgtcattgttttacaaaaaaattaactgataaacatttctggttccctgaatatactttttttttttgtgaaagggttttcttatataacttgaacataaaaagtatacaaaaaaaaacaaacaataaccagaaactagattggggaagaagaccaactaaggtacttaacaaaagaagatatcaaaacctatatatcttgataatgatggattctttttggtttgtcatgttaatgatagtttttagtgtagaacaataagaaaattgactgaaca

SEQ ID NO: 143 - DNA, 465 bp, Neisseria meningitidis
ccgtgacttcttctgccgggatcttcacgctctcatcccagaatttcacgcccataatcgggttgacgattttgacgctggagttgaggtattccagatccttcgcttcatgcgttgcaccaagcatgttggagtctgtggagtaggctttttcgacagacattttgtagtcgaaaccgcagcaatcataaattcagacatctcatgacggccgcccagttcatcaataaagtcagtatcaagccacggtttgtaaatctgcagttcagcattggtcagcagaccataacgatagaaacgttcgatatcgtttcctttgtaggtgctaccgtcaccccagatattcacgccatcttctttcatcgcagcaaccagcatggtaccagtcacggcgcgggccagcggcgtcgtgttgaaataggtcaggccgccggtggtgttatgaaatgcgccacactgaatagc

SEQ ID NO: 144 - DNA, 594 bp, Neisseria meningitidis
ctaaactaaagttatggtctaaaatcacactctcatttacacaatacttctattattaatgtttggttctgactacaatcaaacctttagatcaaaattgtttcttgacttcttgttgattcaccaccaaactagacttatctctatacatgttttcaaaaccactcaacaaatataagcaaacaaagatcttcttcactttgcacataaccagaatgaatttctactaaaagatgagatctgagaaagatcaaggaaggcttttttaccaagaacaggagcagagatggcgacggtaggcttgagaaggagagccggacgagcggcggagacgtggaagcggaggcagtaaagctagccatttctctatttgcttcccctaacgactgagagactcttcaattgattttttgtttgttctgtttgtgttctacagcaacaagaacacttttaatttctttgcttgtgttggcttttggatcaaacataaatatgtggtggataaaaaatctgttcgaaccaacacaagccatctaacttggatatgcttctatccatactccaccaatcgacgccctccacgtgtcatatttc

SEQ ID NO: 145 - DNA, 358 bp, Neisseria meningitidis
cgaagctctgatgtccttctcttctatcatctcaatcattgattccctgaaatctttctttggatcaacggaccgcttcatcacagcgaagtctcctagaacatcttgtttgctctctgatcttctagaagtgcttctacgagtacctgagagttgaattctaggtgaattcactcttttgaggtttatcccagcagatggttttcttccactagaaacttgcctttggtacttcttctcggctttatattcattatcatcttcatctcttgaaattttcacagaaagatggcttttctgcggtttcttaatcggcatgcatgcagtacaagctttctctaccgaatcaatcactttg

SEQ ID NO: 146 - DNA, 365 bp, Neisseria meningitidis
atggcatagctattcattacagatcaaattcacttcacttgttaccctgtccactaccatgcaaattatcaaagtaacctttaggatcactctcaaagttatctcttgaaatgtaagaagatctattgctccctggtgctaccatgtagccacctccgcccccaccaccaccgcttttccctcctccaccgcaaccacctttcgctcctccaccgccgacgcagcctcttcctcctccactgccaccaccaccaccaccttttcctcctccaccgctacagctaacgccttttcctcccattctttgaaatagtagttcttagtttcactctctagaaatttttaagattttgtgtgaatgagaa

SEQ ID NO: 147 - DNA, 518 bp, Neisseria meningitidis
acaactcttcactatactatcgccatatccatcaatctaacatccctgagaccaaaattagaaagcgaattgaagaaaccgcagaagtagaagaagctcaccgacggaagtgatgctcttgagccgattcgaaacgaaaacaatcggagctaaaacagataacaatagcagcgagaggatcagaatcctctgccaacgacgaacttgattcatcaatgtgcgtaacttctcagagaacgcttcatatattttatctccgttgcgctttaatcgttctccacgaagaagaagaagcacattcccagagggaagaacacagatctcggagattctctgcttcttcaacaagcaattgaagaaaacgatgagcagattagggttttcagattcttctgcaataggattcgataaatgcgagagtctgtttctacgatttcatatctggagattcagagcttcctcgtgcatgtttagagacttctgctcttttattttttttcgcttaactcagaattttt

SEQ ID NO: 148 - DNA, 704 bp, Neisseria meningitidis
ttaaagaatgtcttttattagtatcatcatcattcatcatcaacatcaacttgagacatcacatttacacgcttgtgctcacataattaataaatttattttatggtgaatttttaaaattggttgactaattgaaattgtatttggtgaaaaactgaaaatcataagaacataacttttatctaaaatattatataattaagggaatagtacaaaaataattataaaacagagaatcagttgcttctgatttctgacagatttctatcatcatttcatggagattttactcttcatcgaaatgataaaataactgaaaaatgtaattagcgaattataaaacagtagcaaatgtaaacagttttaaagaatacacaaaaaggttgaccaaatggcaattacaaaagaaaaatacagcttcttttcctcgaagtatgctttttgattgaaaatattaaaacgtttctaaacggacaaatcaatttaataaataaaaacaaagttttcacaattcaactaaaagtttaacatatgtgaatctatctaggttaaagactcaaagtacacgttataatgragttcaatagtttcatttcgatgcttctttgaatttggtaaagtgtgaaccttatcttaagtttttaggtagaaataatttagtatagtagcactttatgttaaattaaggtgatacagatacacaa

SEQ ID NO: 149 - DNA, 473 bp, Neisseria meningitidis
gaaaatatcaagatgctggcgtaacagcatttctggtggagaaacgtggtcgaaactcatatagcgcacggattcaacggtcgctttcaggttctcaatggtatcccacgccagttgacagtcggcaatctgcgtcaggagttgatggaagttgtcatcaagttcaaaaaaatcatccagttgcttgcgctcaatggcaatgcgttgctggtgaagattttgttccagttgatagcactggctttcggtaatcatgctcgccgcccgacgcgccaccgcgcactcaatggcctgacggataaaactgccgttgcgcacctgggccatggaaattttgttgacgtagctgccacgttgcggacgaatttgaatcaggccgttttccgccagtttaataaaggcttcacgaaccggctggcgtgacacattgaaacgaacagaaacttctttttccgacaacggtgtgcctggag

SEQ ID NO: 150 - DNA, 408 bp, Neisseria meningitidis
ccgtggacagatcctgactctcacgacatccgaattttcagaacaaggtaaaaatgatcttggatagaagcttgaatcacggcaaacagttttatccctcacacacaaacaaaaatatttaattgttaaagcacatattttcacacatattataatacaattaggtcaagaatttaatttttctatttggaactagatcaatatataaacagaagaagaaaaatgttacgtgcctgtcgccaacaagtctgtacattctaaagatgagatcttcttcttgttcggtcatattgataaactcccatttcatactactcacttctgcattttagttagtatataaattcaaaatatcagtgaaaacgtacatcacaaaacaatttaatgttacaggtcaaatgaatgagc

SEQ ID NO: 151 - DNA, 931 bp, Neisseria meningitidis
caagacttctttcttctctgcgttgagcttgtttatgtaggtatcagcgtctctctgagccaactcgagctcatgttgtaagctcttcagcttctcctcagcggctttgccgatctcgagctcatttttcagagaataagtctctttctcaaagtgctgaagcttctctttcgcgatactcagctcttcctccaaggctagcacttttgtagctactgcatcttctttagtgtcctctttatccaaatcaacactcttttgttcagcaccaagatgatcctctgtgtcaaaagacatgaagctctgaagctgattcttcagattagcaatctcgtcttcgtgcattcgcatcttctcattagcttctttaagctctccctcatatgtagtaattttgtgaaggagatcaacattgttgtcaccatcaacactttcctgctggagaaggagcttctgtttcgtctcttgaagctcaagctcaagttcagccattctacggatcaatgcctcgtcaccgtcttcatcattggcagaggaatgatcagaatcagaaccagaatctgtcaaagacgatgaatcttcctcttctttatggctagattgacggcgactcaacttctctttggtaggagatgatatctcaagagagctctgtgactggatctcagatgtatggttcttctgaagttcaccactagcttgatcataacgctcagccaatgcgcgatacatgcggtagaattcctcgacaagctggattaactcgggacgtttctgaaaatacatctgagctttctttgcaaaagagtctgcgtcttcttcaatcagttttaacatgtggttcacgcgatcatccatctctgagaaaccaaaacaagaacaagagagaaaacatcagattgtgttctttttgagtaagtggagagctcaa

SEQ ID NO: 152 - DNA, 460 bp, Neisseria meningitidis
tccaccagctcaaagacgtgagtaaacactctaaacccaaaaacaaagcttcttcttcttcctcaaacacttgtagcaagaagaaaccttcctcagattctcttcctcaacactcttatttctccaacagcttagtagctaacaatcctcctcaccataactcaccaagaaactctcttcacacaaaaaagatgagtaaaagaaagacactttacaagccatcccttaaacctttgactcctcctcctcttcttgtatctgcaagtttcaacaagagcaagatcaacgatcaagattcgtcttacagcttgttcccggctattgaaacctcccctgagtcttttgtgtatagtttctacgaagaggatgatgatgatgagttcgttgaattttccaacttcaagatcaacacaaagaacaaagctttcaccaagcagaaggtcaaagtgattgattcggt

SEQ ID NO: 153 - DNA, 405 bp, Neisseria meningitidis
ccaataggtccaagtaatttgcggaaaagttagtgggctttaaatataaaacatgactgaaattgggccgtattcgacatttagttgtattattctctaaatattcagaactctcaataaaatcactctctggcgactcaacgttggccagagaatcggagagggacattaactgctggcagactggcagagtggcagtaaccatacgccgaaagagatattctcaacttgtcccgtaaatcaacatctttacgagaccttcatgcaccttcggttctttcattgtttctgggtggttggtgtggcaaatagctagctgtacgtttgaggttgccaagaactccaaaactcagacagtacgtgagtctcaaaaagtttttcctcagctagttggagatttttagc

SEQ ID NO: 154 - DNA, 224 bp, Neisseria meningitidis
catattcagatattttatccagttgtatcaagagcaagtccactggtccagtagtcctcattacggtagcttgggacctccttttctatatctctctctttactcttcgtcacaagttttctatatagttttctctacctcacatctacttttttttcattgcattctccaactccaaaatcatcagttgtaaataatttgtccccttccacttccaaatacca

SEQ ID NO: 155 - DNA, 478 bp, Neisseria meningitidis
ccaaacacatcaatccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaagtatcctttatttgcttctagtacttttgccaaatattttattctggacagacttctggtgactcattgtttatcttaacaaattctagtttgaatttgaacattgtacctctctttgagaaaactcttagtgccagtgatgctggtcgcattggtcgtctagttcttccaaaagcctgtgcagaggtaaatttcccattccttaggtgatgtcttttcttgtccttgaaatattttgtagagttagtactgatgtct

SEQ ID NO: 156 - DNA, 379 bp, Neisseria meningitidis
cctttttgtcacataattaattttatatttataaagagtatataaataacatatgatttggatactattggtggattattttgaggattttcaattgtacacctctagaaatacaaataaaataaaaatacattttggtcgtagattgtacaagcattgatttttcgatacaaattttgtcatcaatatcttcaagattttccgcggacagtcccgagacatgcgtttaacatgtgagtgacacatcttaacatgcgtttcaagattctagctctggatcttcacactgaacagtttcgtgatgtcccaacaccgcccacaccccgggaaccgagcgagctagttaaccttgaagatcgtctagccttggttaaaacat

SEQ ID NO: 157 - DNA, 786 bp, Neisseria meningitidis
accacagtagaagcctaaagcatttgtccagatatcaaattcaggagtataaaggaactgaaccacaacatgttgaaagaaagagaataaaggtgaaacatttacctttgatgaggagattgtagagttaacaacaaccgaagaggccaaaacattgtcagagaagactacgtaatggtagagatcaggatcattataactttgttgcaaaagctgccttttttcgtgatccagggtaaaatattctgttgtcaaccgcattgagagacaatgaagcccttttggggtagtccttgctgcaagctgcattaaatatgctgcttgtttcttctgcgcccgagcttgttcttcggttttataagtcatggcttggagtttggtagcaatggcagggcagttgtgaaaggcacggctgaccttgtataacgcaacttccatggccttcaatctgttaggagagctgaaaagaaacaaaacatttatgtatgactcgtctaaattaacacaatattcattaagatttagcttcataagtaaaggccaaaactttttacaggatggaacaggactccctttgaatcaatcagctgtgctcacctctttggcaaatatttatcgcttggtagtatcaccagtagcccgttccagctctttcgttcgaactctcaactcgcttacgatttgggagttattcccaggtagggccaaattcagataggctttcgcttggataattttgtctctgatctcgcttaccctgtcatctgttgctctgtcaagttgaac

SEQ ID NO: 158 - DNA, 396 bp, Neisseria meningitidis
gggacaattgtgactatcccaccaccatgaatgtgatttcttagtcatagacctcttaaactgcttcttgctctgagcctgagagaacatcagacaaagtgactaaatgttaggaccaagagactaaacacaaggatctaatgaacttatatagtgaagatcacgaaggtttcataccgtagacgaagccatgaccgtggagtgcagagaaaaaaaccctacaagaaaaagatcaagaacttaagtcatttgacaaacaaaaggcaatttgatgttcaaagactatgactttctcggatgtgcttgagttgaacaaaactaaagaaacaaattagatgagataagaggagaaaagaggacacgtgaagattcaacaacccatttgtactttgtcac

SEQ ID NO: 159 - DNA, 546 bp, Neisseria meningitidis
cccaaaacaatgagcaccactaattattattgcaatcgtagaacgaaccatttaaagacattttacacaaaaacatctcacaaaagcaaaacaagggaatatttcaacagatttcacaaacatttataaagtcatcttcatccttttttttgtgcagaaagtttaacagttccttggtttcataacgattatggagtggttaaggatgtgcaagctgaattgtccacctttctcactagtatccactttagactgtcctggaggaggaagaagctcgaagttctggaccatcctaccaatggtgatccccaaaataggcaatgccaatataatcccgggacagcttcgacgtccaacaccaaatggcacatacctgaagtcattaccgttagcttccacgtgcgattcttcttcaaagaacctctctggtctaaactcttcaggcttcttccagctgttggggttgtttgctagccaccaagcattaacaaggattttgctttctgctgggatawcgtagccagcgagcttcgcatcaggaggttc

SEQ ID NO: 160 - DNA, 585 bp, Neisseria meningitidis
catacagaaggaaaggacgaataattgttttggaatttgcatgcatttgaattcgagtactcataatcttctaagcgaaaacttgcgaaaactttatcacctataaaacattgaaaatattgaaaccaaatgggtggtctaatagttttgaaaactaatgtgtgggtcaaagtcactagtttaatacttgagaggaataatttatgctctaaataatcaaccacaaaattttcgatctttcactcactcacagaaaggaaaacaattcattgctaaagcgtcatgactcacgttgcttgaatccttaaattttttttgttgttgtatggaaacatccaaaatctaacatggtttatgaattaagtcgcaactgattcattttattatgttttcagtactataacgtgttacatttaagtgaaggacatcacatatataagtatacacaacaagttatctaatccaactagtccaagaagtttttatttaatcaacaaaagaagcaaggcttaacatcgagttcctcgactaagtctgtaaaatccgctcaaatcggaagtagacacaatcacacaatggtttttt

SEQ ID NO: 161 - DNA, 536 bp, Neisseria meningitidis
taattcttcttcccaaagtttcttggttccatacttccattagtttgtcaaacgattttcaggtcaaaggcctaatgatccattttatttcatttgcagtcgaaaaatccagttttcattagtcatccttctccttggtgttggaattgcaaccgtaacagatctccagcttaatatgctgggttctgtcttgtcgctactggctgttatcacaacttgtgttgcccaaattgtatcctatgcttatattctctttcccctttccatatgtcttctattagccagtggttcagctaaatagtagtctttgttggagtcgttgctgttatcttaaccagttatatacagatgaccaatacgatccagaagaaatataaggtttcatccacccaacttctgttatcagtcttgcccatatcaagcaatcacactttttgttactggcccatttttagatggtctcttaaccaaccagaacgtgtttgctttcaaatacacgtctcaagttgtggtgagaatgaagcaatatatgtgga

SEQ ID NO: 162 - DNA, 106 bp, Neisseria meningitidis
gatatatttctctggttaagaatttgaatggttgacaaagaaacggtcactctatatacttagaaaatatagtcatacatagacaccatcggtctagttataataa

SEQ ID NO: 163 - DNA, 569 bp, Neisseria meningitidis
atattgcttcctcttgcaatcataatgtaatacattgctaaatgtagaaaaatatctacaaacaaacaccacagcgattccaatactagatattggtgacttcttgagtatcataacttgtttcccatatatcaatttaacattttagcattcaaaattagttatgaagtttcaattattcttgctggagataaattttatttactaggcataaatcaatcacaacgtgatatgtgcatgcttagttaatagagtatctatcgaaaattcgctttttttaattaaagtaacgtatatcatcatcattattaagcgacaaacgaatttagacattttaccatcatttacaagataattggtgatagacgaatcatacgttactttatagatagtataaaataaaattacgccaactcgtctattgcgcttgttttagtaacatatgttagatgaattggccacgttgaatctaattcatgtgtgctttttgtagaaaatcgacaagtagataatttattcgtcacaatgacccaagattcaaacctaattgaaataaaaccctagtagta

SEQ ID NO: 164 - DNA, 451 bp, Neisseria meningitidis
tataagtactcaaatataaactcgagacgacaaaaaaagttatgcacaaagagtattattgattgtatatgttttaaagtttttcattgtctaccatgtactatatggtgattccttttttgtatttaattataatgtatgtactacatcttctttattggtacattgattatttctcaaaagcaaagttcaaaatttttagatgcacgttcaataaagttacattagtattttgaattaaggttgtttaaagggttttcaaaacaaaaaaaaaaacacgtatgccgaatttcgttggtctatcatatggagaaaagatcttcaattcggatagaccaacccgccaatagttttgaacattttgcaaaacattgccgattgttttggactttgggtttgataaaggaaattccaattacgacaaaaaaaaaaaaaggaaattccaattacg

SEQ ID NO: 165 - DNA, 478 bp, Neisseria meningitidis
  misc_feature (476)..(476): N is any nucleotide
  misc_feature (478)..(478): N is any nucleotide
cccaggacattcatttcatcaatgtttaggatttggattgaagctctgccacttgggtttagtaaaaaccacattgagattgctgggtaattgagtgaatctgtcaccacatggaatactattttatccggttcctgcaagcagtaatatcatttgttaaaagacatgtggcttcagcagagattcggaaaagagcattaaaaacacaagtttggatcgggaatcttgcattaacaagtttaagatgcttgcaacatgatttaaaatgatacctgagttttgaattaacaagtgtaagatgcttgcaatatggggcataagttttgaatcatgaaaacataaaacaatgcaaggtttctcaactgtaatttaaaaaaagataaagttattcactgaacaaagagcacacaaaatgtaacttccttttcctagtttcataactagacaatatcctatatatggtactaaccacagtngn

SEQ ID NO: 166 - DNA, 494 bp, Neisseria meningitidis
ccgcaaaccttctggtccagaaaatggtaagtatatgcttgttatgacttccagcagtcataattggagtcagtttatgaaccatttatttgctttatcgctcagaaccatgacatgtaatttcactttgcatttttcttgtttgtgtcacttgttaacggaaaaaggaatgcaagatctggatgctgatttttacagccttaaggacaacatgtccggagtaggtaaggtcgtcaaactcattatctatgaatatggtcctcttctgctcatgttgtatgtgataatgcaggaagttcatttaaccatatagcagaacctacttcctctaagaggcaagccagttttctttgtttttgctttcatataatgccactgcacaagttttctttctcagcatgtatatcatcttggttatcttgctaacagaattgcacattttcatagaaattttgatgctttactttcttacaggactttgtttagtatccctg

SEQ ID NO: 167 - DNA, 520 bp, Neisseria meningitidis
ctcggaattccattagttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcagtatcgtattaattgatctgcatcaacttaacgtaaaaacaacttcagacaatacaaatcagcgacactgaatacggggcaacctcatgtccgagctcgcgagctcgtcgacagcgacacacttgcatcggatgcagcccggttaacgtgccggcacgcctgggtaaccagttattttgtccacataaccgagcgcaaaatgttg

SEQ ID NO: 168 - DNA, 636 bp, Neisseria meningitidis
ttcagtaaacttcagcacgtttcatcgtcattggaaagacatctcctgtcacttatcaggttctaggacatctaaaaacatgcttagtgttagcatttgggtatcttttgctgaaagacgcattcagctggcgcaacattcttggtattcttgtcgccgtgattggaatggtgctttattcctattactgcacactcgaaacccaacagaaggccacagaaacatcaactcaattgcctcaggtaaatagtttcaccttcccttttggcacaatgtgactcaacttcatttcattatatgcgtaacgagaaaacaagagttgagaattgatgttgtgaatgtgtcttgtctcagatggatgaaaacgagaaagatccgctagttagtgcggaaaacgggagcggattgatatcagacaatggagtgcaaaagcaggatcctgtatggaattcaaacaaagattttcaagcgtagagctggagctcgatatctgaaatctgttgtagtatcagatttcataggtttccgtttgtcaactttgatatctctcttagagagaatctacagcttccctttcaaaggaaggggggagaggattagaggaggaacagctttttgttgatccatttcatatac

SEQ ID NO: 169 - DNA, 476 bp, Neisseria meningitidis
  misc_feature (397)..(397): N is any nucleotide
cctgaatgtgcatgcaggggtccacttccaatagagaacatccttggaagatctgtgttccggtactggccaccgagcaaagtatcagacaccatataccacgaccaagctatcacaaggggacctgttgcagtttcatgacaaaagaaagttggatttttcttaggattaaagcacaagattgtgcaaaaccagtctggtcagaattgggtagacttggaattgaaactcaaaaccgttatgatatctgcagatacatactgtatcatcgttatggatcgcatctggttcttagctgatggtcgggaagccggagatgttacgtgtacaaaaggaatggaagatgcaaagaaaaggaaacgatttactgtgattgttatgtgtgaaaaccctggancagatactgtagtaaagccataaaggcaactgttaaacaaaagtgtgattttttgttgttatgagtttgtactatagat

SEQ ID NO: 170 - DNA, 612 bp, Neisseria meningitidis
ggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgct

SEQ ID NO: 171 - DNA, 444 bp, Neisseria meningitidis
tacataatgctgaaaagttgtacatgtatcaaattgaaaaattgatgatgcaaagttataaagcaaaaacaaagtaatgcacacttacctaatgtcgaaatctaggttcctttaactttgatacgaaatcaaatttttttcaagaatacatacttacctaaagtaaaagtagacggttcttttgaaattagatttttccgaagaaaccgaaagtatctttgtttagccattaaatcatgtagtaacatatctctatcctatcggtaatggatgaggaccaagagcgaagtaccatgtacaaaattagttcaataaacgtaaaacttcaatcaattaataatcgatgaattattattttttatatattaataattttttatgacataaatgatataaatcaataaaataattttaagaagtcatttttgaaaattctatgtaaac

SEQ ID NO: 172 - DNA, 496 bp, Neisseria meningitidis
ttattaattctttttttgcagtcttcatatgcaaatccggaccagtccctctctaatcgaagaaacaaggatgttgatgaaccatgggattccaaattacatctttggaaacctctaaattttcttgtggatgtggcaaacggaacaaaggacccaaaatctgagcttggaaacgcatcccacaatgatgttcaggggagtaaaaccaaaacaaaggatcataaaagaaagtgtaaactcgaggaagagatcagcaataacggtgatcctacaacatcagaaactgctacacttaaacgaacgcgtcggactcgtcgcaaaaggtcatctacttttggtgattctagaattccactgttaccaggtgcagcaagcctaaaacaggagaggagaaacggtcatgtttggttctcacttgtagcgtcaagtaatcagtgagattcctgttctgtatctgagactctgagtacttctgatattcaatattttctgtgtc

SEQ ID NO: 173 - DNA, 581 bp, Neisseria meningitidis
gtcaaccgcattgagagacaatgaagcccttttggggtagtctctgatgcaacttgtgccacatatggaaggttcttccgtaatttttgtggcatagtgtgaagttaatcaagaaaagtcatttcgattcagaagcagttatgacctgaatatgttggctagtttaatactttcgctgacaccaacaattttttgttagaacctgaaacaaatctctttagtactacactctctcttactagttggtcaccagtaagagctttgttggtggcgaacttattcattttctaaagaaccactcttatgtatttattttaggcctgaccacattttgcaagacttgagagccaaattatttcctctaaaacgtaaaaaggagagagcgcctgaagttgtgtcctccatctcattacctgcaaagaggaaggagaggtctatctcgtctttggtggtaagcacacccaaggtttcagcacaagctggtacaacaggaaaaagaacaaaagctgctacgagaaaagatgtaagaggtagtggttcattcactaagagaacagtgaagaaggaagaagaatttggag

SEQ ID NO: 174 - DNA, 622 bp, Neisseria meningitidis
gcccattacggcagcaaaattgctttgcggaatgctgaaattgatgttcttcagaatcgggcggtcgccatacgcgaaggcgacgtctttcatttcgataaaggggggcaattgtggtgggcaaacaaagcgatgggcgttacaccgaaaaacgagcgcgtgatttccaacgtcgtcatgatgggcatgggcgagccgatggcgaacttcgacaatgtcgttaccgccttaagcatcatgctggacgaccacggctacggtttgagccgccgccgcgtaaccgtttccacttcgggtatggttccccaaatggacaggttgcgcgatgtcatgccggtggctttggcggtttccctccacgcttccaatgacgaagtccgcaaccaaatcgtaccgttgaacaaaaaatatcccttgaaagaattgatggccgcatgccaacgctatctggtcaaagcacccagggatttcatcactttcgaatacgtcatgttggacggaataaacgataaggcgcaacatgcgcgcgaactgatcgaactggtcacagatgttccctgcaagttcaatctgattccgttcaatcccttcccaaactccggatacgaacgctccagcaatg

SEQ ID NO: 175 - DNA, 318 bp, Neisseria meningitidis
tatccatttaatgttcacttttgaaatatgtttttgctggttaaggaattttaggtgaatacatgttcagtattttaaatgtgtttcttcattgtattctggcttgtgtagtctctggtgagacgcctactatatttggtatccttgctcttttttacttattgtatctttcttatcttgctgtttttaagattttcttttcttttttcttagacagagtttcactccggtctcccaggctggagtgcaaatggcatgaccctttggctcactggctcacggccacttctgctattctgccgcctcagcctccagggt

SEQ ID NO: 176 - DNA, 712 bp, Neisseria meningitidis
cgtcattatggatcttgaatcctcttctcggcaggttgcaattagcgagtgggtagtatcaccaacagcgcgaaatccgcgtctgataatggatatgttctgatataacgtgttagtaggcacacgcataccttcttcttcccagactctggtgaaaaaatcttgttgtgcaaccacatcaggaaaagcttcaagtagaagtgataaacatcgactggctggcgttgtcaagacgacgttaagatcggcgttatgtaccgatattaattttcggtgctcaggccagaactcgatattatcgttaataatccagtacatacgtcaataaacactaaatcaatcgaaatggagatcacatagtttgctaagtatattggtatttacggcataaatatatattaattttatatttatcatgatgattgaaatgaggctttaatgttgcaacgtaaaactttacgtaaattaacatggttaacatttatgccactattgtttgtaaattcatatttcgtaatgcttctgaatttttcgtgtgatggttttaaatactatggtgtttactcttgaggggacggcctatttataaaatacggacatttcaataaatgcccgtataaacagagtatgattctggctggtcgttgagtatcaatgttggaccgaatgtgaacgagtaaataaattcgggtattttaccacccattctctt

SEQ ID NO: 177 - DNA, 694 bp, Neisseria meningitidis
gtaccccattctcaatagcgttgccgggcgtcacgatatggacagcctcgcggaacgattggttgaagcacaaaaccatcacttttgaagagattgctggtaaaggcaaaaatcaactgacctttaaccagattgccctcgaagaagccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgacgtgaaatcgacctacagcgacaagctgccgctgatgatcaacccgaaaaccgggcgtgtgcatacctcttatcaccaggcagtaactgcaacgggacgtttatcgtcaaccgatcctaacctg

SEQ ID NO: 178 - DNA, 709 bp, Neisseria meningitidis
cctgactgacggagacgaccgctttgactaatttgaattatcaacagacgcattttgtgatgagtgcgcctgatattcgccacctaccttccgataccggaattgaagtggcttttgcaggccgttccaacgcaggtaaatccagcgcgctgaacacgctgactaaccagaaaagcctggctcgtacctcaaaaaccccagggcgcacccagcttatcaacctgtttgaagtggctgacggcaagcgtctggttgacttgcctgggtacggttatgcggaagtcccggaagagatgaagcgcaaatggcagcgtgcgctcggcgaatacctcgaaaaacgtcagagcctgcaaggtctggtggtgctaatggatattcgccatccgctgaaagatttggatcagcagatgattgagtgggcggtagacagcaatatcgccgttctggtgctgctgaccaaagcggacaaactggcaagcggcgcacgtaaagcgcaattgaatatggtgcgtgaagctgtactggcgtttaacggtgatgtgcaggttgaaacgttttcttcgttgaagaaacaaggcgtggacaagctgcggcagaaactggatacctggtttagcgagatgcagcctgtagaagaaacgcaggacggcgaataattttcttgccttaatgcttgtgccggatgtggcgtatccggcccgtaaattca

SEQ ID NO: 179 - DNA, 620 bp, Neisseria meningitidis
ccctccctagtagctaggactacaggcacacatcaccacatcaggctaatcttttaatttttttgtatgggggggggggtctcactacattgcccaggctggccttgaactcctggcctcaagcaatcctccttcctcagccttccaaaatgctaggattagaggtgtaagcgaccacacctggccagcaaggttgggatatttttaacagccaaagtatttccagttccctcaagggccttcatgaaaaaacaatttaagtccaaacagaattaattttaactcactgtagtttaataatgaagcgcaccgtataagaattttagaaggaaagtctgtgcctaattaaactctggcaataaagacagagaagtctgaaggtagagaggctttctcatggttacccagtgtgagactctgattcctggagaccacaattatgcaccaggcagagggaattctactatgcatttgagactttgattatgatgttgtataatggacattatgcacaaatctcagagctggattccaggaaaagattgattggcattccccatcctccagccccatctgctttccgtatgtattccccacaccgagctcattcccgtctcagg

SEQ ID NO: 180 - DNA, 1161 bp, Neisseria meningitidis
aaagctttactgggacacaggcatgctcattcatctattgtctacagctgtcttcaagctgcagcgtcagagctgaatagttgaggcagagatggtagcttacaaagcctaaaatatttacctggtcctttacagaaaacatttgccaagcgctcttctagtctaaagtacctgtaatatcctttctgcctgggtgcagtggtttatgcctgtaatcccagcactttgggaggccaagccaggtggatctgttgaggtcaggagtttgagaccagcctggccaacatggaggaatcacatctctactaaaaatacaaaaatcagctggacatggtggcaggcacctatactctcagctattcaggagctgagagaatcacttgaactctggaggcagaggttgcagtgagccgagattgtgccactgcactccagcctgggtgacagagtaagactccgtctcaacaaactattttattttcttcatagccgctaccagtatctaaatttctaagttctctctctctctttatttacttacatgtttaaaaaaattgtctccaccaacactcccacaataaaacaatagggccgtaagagcagagactttgttttgtttccttctctatcttcagctattgatacataatgggcttttaaaaagtttattctgtttacattactgacattaaaggtttaacaaattgaagctatctgagaaattgtttgtattgctaagctatatagccattcttttctatcgctgttttgtttgtttgtttgtttgtttgcttgttttgcgacaaggtctcactacatcactcaggctggaatgcagtggcacaatcccagctcactgcaagttctgcctcccgggctcaagtgattctcccacctcagcctcctgagtagctgggaccacaggcgcacgccaccacacctggcttttgtttttttgtttgtttgttttggtaaagacagagttttgccatgttggccaggctggtctcaaactcctaacctcaagtgatctgcccgtctcagcctcccaaagtgctgggattacaggtgtaagccaccgcacttggccccaattttcttttcttttctttctttctttttttttttttttttttgagacagagtctcactctgtgcagg

SEQ ID NO: 181 - DNA, 679 bp, Neisseria meningitidis
cggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggcctcttatgactacccatctggtctagaataaacacaaatatacgtctgcacgataatctcgcactggctgccgcctgccgcaattcgtctgcacgcgtgctggcgttgtatatcgctacaccacgccagggtctgacgcataacatgtcgaaacgtaaagctgaacttatcaatgctcaactgaatgggctacaaatagcgcttgcggaaaaaggtattcctttattgtaccgtgaagtggatgactttgtcgccagtgtcgaaatagttaaacaggtgtgcgcggaaaacagcgttacccacctggtttt

SEQ ID NO: 182 - DNA, 629 bp, Neisseria meningitidis
cggcgatcaactactccatcaatgcatatattgaagtatttgatcaaattacctggggcgcactggcgtgtgtaggactggtactgatgatttggctgtatcaggcgctgaaattcagaaaccgcgcgctggcgctggagtcttaataggccagcaccgatgcctgatgcgacgcttgacgcgtcttatcaggcctacgtatttcctgcaatttattgaatttgcacaaatttgtaggctggataaggcgttcacgccgcatccggcatctgggctcgattgcctgacgcgtctgttatttccccttccgcgccgcctcatacgctgccaacgtttgtactctcgcttctttgtgctcgactatcggttgcggataatccagcgtcacacctgctttctgcgcccacttccacggctcatgcaccactttccctggcacatcgcgcagttccggtagccactggcggataaactcgccctcatgatcaaatttctcgccctgggttgtcgggttgaaaatacgaaaatacggcgctgcatcggttccggttgaagcggcccactgccagccaccgttattggctgccaaatcaccatcaatcagctgcgacatgaaatatcgctcgcct

SEQ ID NO: 183 - DNA, 657 bp, Neisseria meningitidis
cccagctacttgggaggctcaggtgggaggatcacctgagccagggaggttgaggctgcagtgagccattactgtgccacagcactccagcctgggtgacagagcgagaccccatttaaaaaaaaaatagtctttaaactaataataataccactaccttgcatctgtaaagggccaccttttccaaatttccccttcatatgccaagctgtgtaagaaacaactctttgagatttttagggcagctactattgattccactttacagcaaatctgaagccaaggccaggcgcggtgactcacgcctgtaatcccagaactttgggaggccgaggtgggtggattacgaggtcaggagatcaagaccatcctggccaacatggtgaaaccagtctctactaaaaatgcaaaaaatagctgggcgtggtggcacatgcctgtaatcccagctactcgggaggctgaggcaggagaatcgcttgaaccagggagtcagaagttgcagtgagccaaggtcgtgccactgtactccagcctggccacagagcgagactccgtctaagaaaaaaaaaaaaaatctgaagccaaaagaagaaaggtcacatttccaaaataagcataagaattttatctcatcctaagcaagagactctgttt

SEQ ID NO: 184 - DNA, 176 bp, Neisseria meningitidis
atggcttgtactacattgtgaatatataaaaatccattgaattgtaaactttaaatgggtgaattttatgtcaattaaagctattttttaaaaaagacctatatgaaaaacttgaattttggggagttagttgtattaaccaggccctatccagtctttttttcaaaattagagat

SEQ ID NO: 185 - DNA, 532 bp, Neisseria meningitidis
ccggaagaaagtgaactctgagtagagcaggggaacaccgaagatgctccagtgcagatcaggaaggagcaggggatgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcatttttttttttgtttttttttttgagacgagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacgcctcggcctcccaaagtgctgggattacaggcgtgaggaaccgcatctgg

SEQ ID NO: 186 - DNA, 632 bp, Neisseria meningitidis
ccatgacaggtcctttttttctgtctgtatacaagattaggggagtgtttggtgggaatagtctgctctgatgaggaggcagtcattctggtgttcctgtttgctgcgtaatgtgggaacacattttgtccagcacttctggataaaacacacaaaccaggctcgacaaactcccccagtgccacatcacttgttcatttcaagaaagatagctgaggccgggtgcagtggctcacacctgtaatcccagcactttgggaggccgaggagggtggatcaccaggtcaggagattgagaccatcgtggctaacatggtaaaaccctgtctctactaaaaatacaaaaaaattagctggggtggtcacatgtgcctgtagtcccagctactcagaaggctgaggcaggagaatggtgtgaaccggggggcggacttgcagtgagccaagatcgctccactacactctagcctgggcgacagagcgagactctgtctcaaaaaaaaaaaaagaaagccaaccttcaatcacttcagcatcctggacagttccgagcacattgcaggcataatagctgtttgagggcaataaatagcagtcctcaaagccattgagcaaatacctgcttcccctct

SEQ ID NO: 187 - DNA, 680 bp, Neisseria meningitidis
ccgaatcctagctagatttgtccgccaacaatatctgaacccctggcctcttggaaaaaaaagagagagagagagaatataaaatgtactatacagggttaaattgacacttccttcttgaagtatttagaagtactaatggagagttgaaaagggaagcatgatttcctccctatgtggcaatgttgtttaatgcaatgcaggacagcttcccagtgcttcaagtcttccacctcctgaaacactgatgtggagggggaaacacaggccttaaagatcagaggcctgaattcgagcccctgctctgccacatacttgctgtgtcaccttgaacaaattacacagcctccgtgggctttggggataaatgtgagacggcatagagaactcatctcctctgctgactgattctgatcctttggtttgactgcctgagcaccatgtgatgagctctgtgagggctccatggagggaaaatgcagtcatctattggtgatatctgctatggacaacatgagttggaaattctgccagccagactatgtcttcaaggactgtgaacaaggtgtcttctgaagtcacttccagatcaaaggacttggtgactcgttccaatgggactggaatacgagagggactctatatcatcatggttattttctaaaggccctgaagaatct

SEQ ID NO: 188 - DNA, 680 bp, Neisseria meningitidis
cccaggctggtctcgaactccagaccttgtaatccgcctgcctcaggctcccaaagtgctgggattacaggcattagccaccgtgcctggcttttggtgtccttctcgtttagtccacactcctggccacttcccaggatgcaaactggctcacaaggattggattaggacccattccaatcaaataataataacaaacatttgtttatttttggcttctggatattaattttaattactttgaaacaacataatttactaccagatgtttaacaagcacccattataattgctaaactgtgaatttagttttaactgtgtctgaccaactatacaaaactcatcaattttaattttgacaaaaggtagtaggctgggcatggtggcttatgcctgtaatcccagcactttgggaggccaagatgaatggatcacttgaggctaggggtttgagaccagctggacaacatggtgaaacctgtctctactaaaaaaagaaaaattagatggccatgatggtgcacacccgtaatttcagctacttggaaggccgaagcagaagaattacttgaacccaggaggcagaggaggttgcagtgagccgagatcatgccactgtactccagactgggctgagctacagagcaagactctgtcttaaaaaaaaaacaggcgaaagt

SEQ ID NO: 189 - DNA, 610 bp, Neisseria meningitidis
ccggtattaggaaagagacaaaccactttgtcctgggctgggagggaacaaaaccgtctccctcaactccctaaaatcaaattcagagaggactgtcaaggtggacccatggagccccagtcaaggtccagaaacaaggattcaaagccttcaacataaagtcaccacgaggctagaagagaccagatgaatgggctggcctggtacctgagtcagaaagtgggagtgcgtgggcattggtcatggtgccataatggagacagtgagcacaggagttaaacaagatggctctgaggccaggtgccctgggttcaatcccagctgcgtaactttcacgtggccttttccagttcccttacacactctgtacctcacatgaatgaactggaaaatgaagactacagcactactgacttcagaggattgttggattaagttattaattcacttagaacacaacctggcacatagtaagtgttcagtaaatgtttgttattccacaccctccctcccttggccccgcgatggaggaagcaggctaggaccagccctcggagctgcagctgcccttcatccctccctcggcctctctaacgagatcctgctccag

SEQ ID NO: 190 - DNA, 1279 bp, Neisseria meningitidis
aaatttactcaaccattctggaagacagcgtggtgattcctcaagaatctaggactagaattaccatttgacccagcaatcccatttctgggtatgtacccaaaggattataaatcatgctactataaagacacatgcacacgtatgtttattgtggcactattcacaatagcaaagacttggaaccaacccaaatgtcctccaatgatggactggattaagaaaatgtgacacatatacaccatggaatactatgcagccctaaaaaaggatgagttcgtgtcctttgcagggacatggatgaagctggaaaccaccattctcagcaaactatcacaaggacagaaaaccaaacaccgcatgttctcactcataggtgggaattgaacaatgagatcacttgggcacagcaaggggaacatcacacaccggggcctgttggggggtggggggagggggtggggatagcattaggagatatacctaatgtaaatgatgagttgatgggtgcagcaaaccaacatggcacatgtatacctatgtatcaaacctgcacgttgtgcacatgtaccctagaacttaaagtatatttaaaaaaaaaaaaccttccctttcttgaatgtaaattggttcaaccattgtggaagacagtgtagcgattcctcagagatctagaactagaaataccatttgacccagcaatcccattatcgggtatatacccaaaaatatataaatcattctgtcacaaagataaatgcacacatgatcattgcagcactaatcacaatagtaaagacatgtagtcaacccaaatgcccatcaataatagactggataaagaaaatgtggtacatatataccatggaatactatgcagccataaaaatgaacaagattatgtcttttgcagggacatgaatggacctggaagccattatcctcagcaaactaacgcaggaacagaaaatgaaacaccccatgttctcacttgtaagtggaagctgaacgatgagatcacatggacacagggaggggaacaacacacactgggtcctattgtgggggtggggtgggggagggagagcattaggaaaaatatctaatgcatgctgggcttgatacctaggtggtgggttgataggtacagcaaaccaccatggtacacgtttacctatgtaacaaacctgcacatcctgcacgtgtaccccagaacttaaaaataaaaaatacccccaaacacactccttaggtatatgtaactatttttcccgggtac

SEQ ID NO: 191 - DNA, 1025 bp, Neisseria meningitidis
gtaaaccaaattcgaggattgtgtctaggacttgaagggccataggcattgcaaccaccgccaactccctccttttactaatcgtagtgctttatggccataaagcactctttctaaatctaaaaatgatttagaagaaggaaaagaccaatatgatgataacaatgtgggagattccttttatcttttgtagccaaatgacagtaaggaaaacagacagtatgctgacctcatcgtttctctaggttgccagtttttttcactaagatgtatataaatgaaacccttttgctctgcaggctattatactattccttttaaattcagcatctcttccctcctccgttcatgcagattgtggaagagaacatcattgggagagagagtttattggttactgctcacctgagtaagcagtaagcccaagtggcagaaaaacccattcaaactggcttgaagcaaaaagggaattattggaacatgtaattgaatagttttaggtgtagggctgacttcagacgcagctggatccagagactcaaatgatgccatcagaaacatctttggctctttgtcttatatgctgaaaaccactgaattgtgcactttatttatgtaatttttttttttttgagacagagtttcactcttgttgcccaggctggagtgcaatggccccatctcggctcactgcaacctccacctcccaggttcaagtgattctcctgtctcagcctcccaagtagctgggattacaggtgcatgccaccacgcctggctactttttgtatttttagtagagacagagtttcatcatattggtcaggctggtctcaaactcctgacctcaggtgatccgcctgccttggcttcccaaagtgctgggattacaggtgtgagccactgcacccggcccaattgtgtactttaaatgggtgaattgtaaggtgtgggaattatatctcaacagagctgcccccacttccccaaaaaaggaccaagaggtgaggaagtggagacaatat

SEQ ID NO: 192 - DNA, 2140 bp, Neisseria meningitidis
catgtcaaaatcctaatctccaaggtaatggtattagaaggtaaatctttggtaggtgatcaggtcatgagggtggagccctcatgaatgggattagtacccttataaaagagaacccagagagctcatttgctgcttctgccatgtgaagatacagtgaaaaaagaagcaggcccttgccagatacgagtttgccaatgccttgatcttggaattcccagcctccagaactgtgagcagtaagtttctattgtttataagctacccagcctatggcattttgttacggcagcctgaatggactaagacagtctacctagaccattatttccctttcatcatccaccagccaattccagcacatcttttagatctcagcttaaatactccctccaagacctccctctatctctaatatgaatgaaatccatatctcaagttcttcacagaatcctctactctttccttcatggcatttgtcataatttgtaattatatatctagcaaagttctttgttgttaaacatctacctcctccactctcctagaaactccacaaggacatccctgcacccagtgcctaggcaatgccagacacatagcagatgctccattaattatctgtcgaatgactgaatggcttccaagttagttaactgggcacccttgataacagattctggcctatttgaaggatcaaagaagaaagtggtgctaccttctcccctgccactatcttgcccacttgtggtgccagttcaggaggtttggaatggatgtggctaatgatagacgtagacctattgcctttcttggatcataattctgccaggctctgagtccatgtggcatcgatggctaattgtcctccaaaatttatcctctcttcttccatttataccctcccatggagttttaacagggcatgtggtcaccctactgggatctcacttctcagcttcccttgcaactggatgtggccttgtgactaaattctcatgaacagaatgtgagtgcaagtgatgtgtcagtatcttcatcactttcctaaaaagggaactgctggtcctccacttcctctctttcacccttccaatgagccagaacatgcatgtgatgctggtgagtcagcttcagtcacatgaataaaaacaaactccaggagatgactaagcaataagacagaaggaacccaagtccctagacgagttcacagaaccaagctacctatccaaccctgggcccacctggattataacatgagaaaaacataagtcctaatcatatttttgaagcactgcattttagggcttctttgtgacagcagcctaccctctagtctaatcaatatacctcaccaagtctcctgctcctaagggagacaaagaagcaaaatgagtctcaaaacatcatccaaatggaatagatacagacctgtaatcccaacactgtgggtgcccaaggcgggtggatcacttgaggtcaggagtttgagaccaacctggccaacatggcaaaaccctgtctccactaaaaatacaaaaattagccggacgtggtgttgtgcacctgtaatcccacctacccacgaggctaagccgggagaattgcttgaacccaggagggggaggttgcagtgagccgagatcatgccactgcactccagcctgggtaacagagtgagactctgtctcaaaaaaataaataaaaataaaaataaatagaccattaattaatagatatagccttggtctgtgaccaaagctcagaatgttatgatattcctttcctatgtcacctcaacttgcccctgtcatcagacaggacaaattccccactggtcctttgcactcacagctgttacatttgaaatgggagcttagccttccctgccctggttcctccttagactcatttgggaaaacaggaaacgtaattatttctgccattacctttatctcatggagcctgacagagtgtaaccaatggtaggaattaaaacactctaattgccaactcacaacaactcccgaaaaaaatcattttaactcattatacatattaaattatgacatgcttaatgtccaaacctaatagattcagtactcaggaaatcccttatacaggtagacacgggtac

SEQ ID NO: 193 - DNA, 866 bp, Neisseria meningitidis
cttagattaatgggcaaaaaagttacaatcatgggatgtttggcttccctataaagactaatgttcatagattgtttttcaaaaatgaggactccccactaaatgggtccagctacacacatggtcctgcaacacgactcagataagggggacctgaaggctaaactcttaacacttttctcagttctaaatttcttcctaaggggagtagaggaagtcacaccccaggccagaactaacattccactgatctcaaatttttagacaaggcttctcctcctaagccaattacaaatcaawacatctttaaatctacctttgacccatgggttcccactttgagacgtcctgcctttttaggtcaaaccaatgtagagcctcccatatattgatttataactttgcatgtaacctctgccttcctgcaattacaaatccttacctataagccatccgggagcttgggacttaagcattaactaattatctttgcttggtgcccctccaataaataccccacttcctcttgctacaatcccaatatcaatgtttggttttgctgtgctgggcagggggacccaagttaggttcagtatcagcaagaaggcaagacagagtgtgtgctagcaagacagaagtccgtgtgtttggtaacctaatctcaaactgaaatgccatcacctttgctgtgttctactgattaaaagctagtcacccatatgttcattgcagcactattcacaaaagcaaagacattgaatcaacctaggtgcccatcaatggagaattggaaaaagaaaatgtggtacatatataccatggaatactacacatccataaaaaggaacaaaatcataccctttgca

SEQ ID NO: 194 - DNA, 813 bp, Neisseria meningitidis
cccttttctcggtggaatgtgcttctccttcatacatgatataacttgatttgaacaatgtcacaaagatattttctctgttagattaaaattttgtttgcatgaatttttcaatagctttaagcagttgaatagcaatatatgcaggaagaagctgagagacttatgtaatagatatttcatgtatctataacccacactgctgcccaggaaatgtgcgctgcattaatagagaggattttttcctgctgaataccttgaggagttggccaacacgtttgggagtagaagtagaaagggccaggtgtgatggctcatgcctgtaatcccagcactctgggaggccaagtggggaggattgcttaagcccaggactttgaggccagcctgggcaacagagtgagactccatctctaaagaaaaaaaatcataaarractaaaattctctgccaaaatggacacagaaaaaactgacaatccagagaaagataatatgcaatgaagctagacatggccaaattagaaaatgatattgagagagaacaagagcaagaaagaggagccctcagcattgagagggctgaggaagcacagaaatgactgatgggttggttagttagttactttttgtgaagtgtgcaatgtaaatttcactttggtctccccaccggaatcatcaactaaagtctacactgctatatcggctatctattgctgtgtacaaattattccaaactcagtggcttaaaacaacacatttattatctcacagtttctgtgggttagggattcgaagatgggcccctgcttca

SEQ ID NO: 195 - DNA, 634 bp, Neisseria meningitidis
ccaaccaacatgtacagtatctcatgtacacagtcttctaaggattgacactgaggttgcttctggatttttgcaattacagatagtgctggatacaaatctttgcaaatataccttgcacgcatgcatgagaatatctggagaataaattcctagggtctaattgtgggtctatttaaattttgcataaaaatttgatacatgttttctaaccacctgctcctcccaagaggttgcaccagcttacagtcccaccaatcagggaagagggattttatttttttattttttttttttgggacagggtccggtcctgccacccaggctagaatacagtggcgtgatcatggctcatggcaacctggtcttccccagttcaagcaatcctcccgcctcagcctccccagtagctgggatgatagccgcatgccaccacacccagctaatttatattttactttttgtagagacagagtctcactatgttgcctaggtggatcttgaattcctgagctcaagcgatcctcccactttagcctcccaaagctctgggatgacaggtgtgagccaccatgccctgcctgagaattgtcttctcacacccttgttaataggactattatcacattttaaa

SEQ ID NO: 196 - DNA, 685 bp, Neisseria meningitidis
gtacccgtttcttttggtgccaatcttgagcgcgcgtaaaccagcttctccgcgctcttcatagaccttcagccacctggctacagaaccactaccagcaagcataaagtgagcagcagcctgattaagggacatgtgctgctcgatcacagctttcacgaccttaatacgcaactctggatcagcactaacgcctttaggtttgggaattaaacctttttctccatgtttttcatagagggcaacccatgtcctgacctgggttcgggggacaccaaaacgtgccgagatgatcctgtaaccatcatcagttgtgaagtagtgattcacgacttcaaggcgcttttcaaaagggtattttggctttgacatattaggggctattccatttcatcgtccaacaaaatgggtgcagtacactggagggctatcagtacactacctttacgcccgccaccctcgcgtctcggaagccttaatgagcgccctggcgagacccgcgagcaaggctacgccctggacagcgaagagaacgagcagggcgtgcgctgcgtggcggtgccggtgtggaacacgagtcccgcgtcatcgccgccctgagcctgtcgacgctgacctcccgcgtggacgacgcggagctggctaatttacgcgagcagcttcagcaggccgggctcgcgctctc

SEQ ID NO: 197 - DNA, 591 bp, Neisseria meningitidis
cctggatctaggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagcgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaacgcgccctccatcgagggg

SEQ ID NO: 198 - DNA, 698 bp, Neisseria meningitidis
gtaccgcggattattgttggttaatgctggtgttccgtactgaaccaccagttgccatgtctgaaacttaataaaatcgctgatcgacttggcgtacgattgcacaatcaccagtacgccaaacatggcgggcgtcatccctttaccggcacacgagagcgccaacagacccagcaaggcgctcacgacattactggagcctaaccaggcgctattgcgaataatggtgcgaaacgcgccatctgcaaaccaatgtttgatgttaaaacccgccaattcagcctgaccttatcgttgatagtaaaaagtatcccgccagccttaagttaaacttcggcggtcagaaacgatggcaaccagagaaaccgccttctgtgcctgttccagcacttcgctgtagggcgctctggaatcaatctcaagaatttttgtgccgttatagccaatcttcgacatgacaccgattttgtcctgcagctcggcatagtcatggtcaggcttgcgggagatggcagtctcaatatcaatgcccaggcgaataattaattccgggcgatattgcgccatttgttggtataaacgccgttcgcgctgcgccagaaacatgctgattttcccggtcgcacgtacgacgccaatccccggtccatcataataaaagcccgaaatttcagcctgcgggaagcgatcgctgacca

SEQ ID NO: 199 - DNA, 755 bp, Neisseria meningitidis
ccggattttcccatcaacggtaattttgtcactgcacgaccgacatttccggcctgttttcctaaatgaactctttcggcagcaccatatttttcgacaacggtaataagatgttcacacaccgttgacttgcctgaaccatcgctaccaataacggcaattaatggaggtgttattgactgcatgaatatatcctttaatttaaatatccattaaaaatatttatttggttaatatgtttttatgaaagcgtaattcaggtcaatgtcacaattaaccattgtcacaataaggttgaacggatattctgagcacggaccacgtaatattcaatacattatttactgccgggtttttcgtgaatcaacgtaatatgtcaataattaattccacgccaggcgtgttattgccattgtaggatgtgatggttcaggtaaatcgaccctcacggcaagcctggtaaatgaactggcagcaagaatgccaacagaacacatttatctcgggcaatcgtccgggcgaattggcgaatggatttcacagctccctgttattggcgcaccttttgggcgttatctgcgaagtaaagcggcacatgtgcacgaaaagccctcaacaccgcctggcaatattactgcactggttatctatctgctttcctgctggcgggcgtacaagtttcgcaaaatgttgtgtaaaagccagcaaggctttctgctcatcaccgaccgctacccgcaagttgaagtgccggg

SEQ ID NO: 200 - DNA, 909 bp, Neisseria meningitidis
gtaccggcgctacctggctcaagtccgagctgtgaacactgtacgatcgcactgacaaaactcatagtgtcacagtttcctaacgccggaactttacgaatttctgtggtggcgatacggatcatacgttcagccgtcatatggcgtggaagagctgctgccagttgctctttcattgatggctggttaataaaactaatcacgtcgctatttttaactgctgctggtgcacggtttccctgagttttttgcagatcggcttttgcgattggtggttgcttagtcatttgcatattccttagcccagcggggcagtgataatgtcttaatagctggccattcatcggtattcaggcagtcagacagggttcgcagattgcggtgatattcctgttgacctgccagtwttgcttcttcgcccatcatgaaaatttcaaccggataacgtccgcattcaatagttgtgctggcaaccagaaaaacgaaagttggctgcactccaaactgtgcttcataaccgtcactgtagaatgcatcctgaacgtgatagcggtagtcgtaataagcggttttgaatcgttgaatatccgccgtagttttcacgtccatgatccagtgaaattcagggataattttgtccggacggcaccgacacaaaattcctgtttcaggatcttcccagtaaattgatgattcagcgtgtccggcgctttcaacaagccattgccccagcggcaaagccataacgctttgatacatgagtacaattttccggccttcttccgcagtgataaccgtttttcctgtgcttgcgcattccatcagaaacgctttctcttcttcttttccggcgtttgtacggcggttaaattcaggtgctacgataaagcggttactgaattcttccgg

SEQ ID NO: 201 - DNA, 1206 bp, Neisseria meningitidis
ctgccacgaattttcctgtcgttaatgacctgcccgctgaaggtgagatcgattttacctggagtgaacgctatcaactcagcaaagactccatgacatgggaactaaaaccgggagcagcaccagacaacgctcactatcaaggcaataccaacgtcaacggcgaagacatgactgagattgaggagaatatgctactcccaatttctggccaggaactgcccattcgttggcttgctcaacacggcagcgaaaaaccggtaacgcacgtttcacgcgacggactccaggcattacacattgctcgggctgaagaactaccggctgttactgccctggctgtttcccacaaaaccagcctgctcgacccgctggaaattcgcgaactccacaaactggttcgtgacactgacaaagttttccctaatcctggtaattcaaacctgggactgataactgcttttttcgaagcatacctgaacgctgactacaccgatcgaggactgctgacaaaagagtggatgaagggtaatcgtgtttcacacatcactcgcacggcttccggtgctaatgctggcggcggaaacctcaccgatcgcggcgaaggtttcgtacacgatctgacgtcactggcgcgcgacgtagccactggcgtactggcccgttcaatggatctggacatctataaccttcatccggcacacgctaaacgcattgaggaaattatcgctgaaaataaaccgcccttttctgttttccgcgacaaattcatcaccatgcctggcgggctggattattcccgcgccatcgtggttgcgtccgtaaaagaagcaccaattgggatcgaggtcatccccgcgcacgtcactgaatatctgaacaaagtactgactgaaaccgatcatgccaaccctgatccggaaatcgtggatattgcctgcggtcgctcctctgccccgatgccgcagcgagtaacagaagaaggaaaacaggatgatgaagaaaaaccgcaaccatctggaacaacggcagttgaacagggagaggctgaaacaatggaaccggacgcaactgaacatcatcaggacacgcagccgctggatgctcagtcacaggtaaattctgttgatgcgaaatatcaggaactgcgggcagaactccatgaagcccggaaaaacattccatcaggaaatcctgtcgatgacg

SEQ ID NO: 202 - DNA, 1334 bp, Neisseria meningitidis
ccgtgtttgcatcaaatgactggcctgttcaaggacccattgacccagcaatgtgtggttattatgaaaccagaggcagaacgagctttctctcttttacctagggggctgggagtatttcaagtgtcttccgatttttataacccgcagtcctagaattaaccccgcaccccactgccatttactctctcaatgtagagttgctttgagtaggtaacagcttaaattcttagaaagctgagccccctagaggaaatttctaaggtcaagcactcatttgcaactttttattcgctaaaaatgtagagaagggagaagtcaagaataacactgctaaaagggaattttattttattttatttgtttatttatgaaatggagtctcgttctgtcgtccaggctaaagtgcagtggcgtgatctcagctcactgcaacctccttctcccagattcaattgattctcctgcctcagcctcttgagtagctgggattacaggcacatgccaccatgcctggctaatttttatatttttagcagagacgaggtttcaccatgttggccaggctggtcttgaactcttgacctcaggtgatctgccttgcctcagcctcccaaagtgctggtattacaggtgtgagacaccgcacccagcctaaaaaggaatttaatatggacaaagagtacgatccacaaaggagagacaactttatgagcccctttgagcacagcataatactgtctcaaaatatagaatgtgccggctgccgtggcccatgccagtaatcccagcactttgggaggccaaggcgggaggatcacttgagcccagaagtgcaagaccagcctgggcaacatagtgaaacctcatctctacaaaaaaatttaaaaattagccaggtgtagtggtgtgtgcctgaggtctcagctacttgggaggctgaggtgggaggatcacttgagcccaggaggtcgaggctgcaataagccatgatcacaccactgcacccaagcctgggtaaaagagtgagactgtgtcttggccgggcgcagtggctcacgcctctactcccagcactttgggaggctgaggcgggtggatcatgtgaggtcaggtgttcaagaccagcctggccaacatggcgaaaccccgtctctactaaaaatacwataattagctggatgtgcacatgcctgtaatcccagctactcaggaggctgaggcaggagtatcacttgaacccgggaggctgaagttgcagtgagctgagattgtgccactgcactccagcctgggtgacagagcgagactccatctcaaaaaaataaaaataa

SEQ ID NO: 203 - DNA, 1091 bp, Neisseria meningitidis
cccagtcctgagtatttaaaatgtttcatttctgtgctgagagacagaattagcacttgataaggttgcataaaatgcctggcacacaggagatgctcagaaagcatttatcctttcacccagcttcataacctcttcataaaaaaagttgcagacacctctcctcacatgcacagagaaatatgggactattcaaagagatggaccagccacctcccttccctccctgggtgttttgctgctcagagaattctgatgcttagatcacatcttgggaaagggctccaaggcccagagctcatgcgcttgcctgtggatggtggaggtattcctcatgttaaagttggaggagctgatcctctccagaaacgcctgggccagctcaggtgtgatgtcatagaccatgtccagctgcttggtggcgttgtcatagctgataaacagcccaatctagttggtggacaaggacgagaatatcagtgaggagggtggaagtggcccagtgtggccccaccctggtggtctgcactgtgccccatcatggacacttggatacacctcctggttctcattgtcattgatgtctttttttcttttctttttttttttttttttgagatggagtctcactctgtcgcccaggctggagtgcagtgacatgatctcagttcactgcaacctccacctcctgagttcaagcaattctcctgcctcagcctccggagtagctgggactacaggtgcccaccaccacgcttggctaatatttgtatttttagtagatatggggattcaccatgttgtccagggtggtctcgaactcccagcatcaagtgatccacccgcctcggcctcccaaagtgctgggattacaggcgtaacgaccatgcctggcctcattgtcattgatttcttagtggtctgtaactgctactttagtttcctcctcaacctaactattctttaggaaagaattattttttaatatctgagaaactgggctttttaaaagctaatctttgcacatttatttctagatttgttatatggaggtcagagaatgtggtccacaaactttctgcgttgaagaa

SEQ ID NO: 204 - DNA, 1157 bp, Neisseria meningitidis
ccctggaatagcatagttaggagtgtgggcccaaactggatttgaatcctagttccatcacttagttgtgtggcttgagacaatttgataaattttcttgtgcctcagtttccctttatatgaaatatggttaacaactgtgagattaaaatttgttcacacatgaaaattgcgtaagactgtgcccaacacacagtaaatgcccatgaatagccttttctcatttttatttttttttttggagacagagtctcactctgttacccaggctggagtgcagtggtgcaatctcagctcactgcaacctccgcctcccaggttcaagcgattctcctgcctcagccttccaagtagctggaattacaggcgtgcaccaccacatccagctcatttttctatttttagtagatactgagttttgccatgttggccgggctgggctggaactcctggccttaagcgatcctcctaccttggcctcccaaagtgctgggattacaggataagccaccatgcccagcctatgaaaagccttttgtaatcttacgtttgcttctttgtttgtttgtttgtttgttttgcgatggagtctcactctgttgcccaggctggagtgcagtggctcaatcttggcttatcacaacctcagcctcccgcgttcaagtgatcctcctgcctcagcctcctgagtagctgggactacaggtatgcaccaccatgcctagctaattcttttgtacttttagtagggacagggtttcactatgttggccaggctggtcccgaactcctgacttcatgatccgcccaccttggcctctcaaagtcctggaattataggcatgagccaccgcgcccggcctgtaatcttataaagagatggatggatggatggatggatggatggatggataaattaataaacaaataaaatacttagactgaaagaatatatccaaaagtacccattggtgttatcttagggaaaggagtggttatgggagtctttcactttaacataactgggtatccctgatatgaggccccaagacccctatttcttatcgatcatagtactcatcatattagaattgtttattaatattggcgtttccacactacctagttccctgccccatgtccctggtatctgtcgg

SEQ ID NO: 205 - DNA, 855 bp, Neisseria meningitidis
ccaaactaaattgtttgagctgctgtcatctgggggtctttttgttatagcagctcagcctatatcctaatataccatgtctccatcaaaggtgggaaaatgaaagaaagacaaaatagcttatatcatgtttcaagaaaaactggacagaacccttttccttgcagaagcaaagactatctctacatccagcccacttctccaacttacctggcccctgagtttgcaatccctgagcactgagatgggaacatatagatgggtctcaggtacacacctgcaggctggggatggtgaaggcaacattccgggaattcagataggccaggactctgtgggacaggtcatccgtccacacgtgggagcttcagttgaagacagacaggaaaagatcacaatgacagattctcctacaagcactactgtactagctaagtgcccaggggacaggtagggatggaccaggggtgttaggactttgtacttggaagtgggaggtttctcttttcttttctttccttttttcttttctctttttttgaaacagggtcttgctctgttgcgcgatcacggctcactgcagcctcaatctccccagcccaagtgatcttccaacctcagccacccaagcagctgggatcacaggtgcatgccacaacacccagctaattttttgtagagatggggtctcactatgttgcccaggctggtctcaaactcctgggctcaagcaatcctcccacctctggctcccaaagtgctgggattacaggagtgaactgctgcacccagcctgaagtaaaaaatttcttaaccaggcacagtgataggatagtttccaattctaggaatctg

SEQ ID NO: 206 - DNA, 646 bp, Neisseria meningitidis
aactctacaaaaaaatacaaaaattagccaaatatggtggcacatgcctgtagtcctagctacttgggaaactgaggcaggaggatcacttgaacctgggagttcaaggtggcagtgagttatgatggagtcactgcatttcagcctgggtgacagagtgagactctatctctaaaccaaattttaaaaaagtatctatatgtaatataaaaaccacaagtgggccgggcacagtggctcacgccagtaatcttagcactttaggaggccgagatgggtggattacttgaggttaggagttcgaaaccagcctggccaacctaaaaaaatttttaaaaaatacaaaaaaaaaaccccaaaaaaacccactaaaaatacaaaaaaaaaaaaaaattagccgtgcatggtggggggtgcctgtaatcctagctactcgggaggctgacgcaggagaactgcttgaacctggaaggcggaggttgcagtgagctgagattacaccactgtactacagcctaggtgacagagtgagactgtctcaaaaaaaaaacaaaaaaaaaaaacacaagtgagctcatactatacatgctgtcctgtttatatatatagctaagatatatatatgtataaaactatatatatagtt

SEQ ID NO: 207 - DNA, 722 bp, Neisseria meningitidis
ccagccaacagagaaaagctgggacaagagacaaatgacatcatttgcacccctagatcgagccatgcctgaagtccctctctgaactttccagttacctgaacaaaaaattcccttttattgcataagccagtttcagtttcagttctgttgctttcaaccaaatatcaacctgatataattggcttcatgtttgtctattccctctcccaccatgagattataaggtcttataaattaataggaatttctaaatcttcagatagaaaatttagctatctgagaactagcacacagcaagtactcaatgaacttttttttttttttgaatgaacgaagacaataagagcaaaaaaaggtagagggaaataaagaaggagagaaggagagaaacaatgtccagatcatgtttgaaaagcagggccaccctgcaggcccaaaagctcacacatgccaggagaaacgcctactgctcccctcaactctgattcccctggagcctggcacagccgcaaagccaggccagatgggacctgcctcactgacactcattcaggcttgggttgctttggcttggtttttagataacaggaaaagcgagaaggtctgtctcaaatgtctgtgtgatactcagaattgaaatcctggatctcaagggcttaactctctaaggcatcctccactctgcctctggttcctgaagaaacccagtggggagagaa

SEQ ID NO: 208 - DNA, 877 bp, Neisseria meningitidis
catgacaactcaccagcctgtattccacccgaatgtaagcttctgtgggcaggaggctcatctgtcttgttcgctgccatgttgctactgccaagcagtccccagtaggctggtcatggctggtgtccacgaacatatttgtgcagcatatgggtgaacatacacacgtcctttctgaaacaaaattgaactcagtaggacactcactcaggcaaagattgggaagctttagatccattctggaggagggggagatagaatcagaatatattcatttaacaaacatttatggggaacctacttttttggcagacctcatgctacagaaacaacagtacacaaagccctgctttcatgaagcttacagtctaccggggactgggagaggcggaccataaacacacacatgcacacatatacatgttcacatccacacacccctgtatcagatagtgataaatattatggagcaaagaaatctggaggaaaggatcgagagctccagatggtgatggtagggataggggtggtgcagaacaagctttaataaaacattaggtggtcagtaaaggctctgccctcaagagggatacaatcgcttcttaaaggtcccacctctcaatgctcccacttttgggattcagtttcaacatgagttttggggggtcatttgaatcaaagcacatggtgtcctaccatcagctctaagtttacagcctaacacttccgcaataacaagaaagagagagagagagagagagagagagagagagagagagagatctttcctagttacttcagcaaaagtccccaggttaggtctgattgggcttgcttgaggcaggtgcccatttctgatctgaccactgtggcccgg

SEQ ID NO: 209 - DNA, 758 bp, Neisseria meningitidis
ccgcttctcttcttactatttcaagatggctgcccaattcatgtgcagaggaaagagaagttctttctctttactctgacagttgaataaaaaatccaaagcctggctctctttggtccatccctgaatcagtcattatggcctggggaatggagtatgctaattgacttaagggaatcagggcccagcactggagtgaaggtggggctaatgccacctaatccactggagagtaccaaaagtgtgcttccccaaaggaaattcacaatactgtgggaaaggatgaattgatgctgagtcactatgaatgacaaatgcaaaagataaacataccaggccccactccttgcaggaagcaaaagatcctagagggagaggctgacatggaacaggatgtctgaccaataaaacttcttccaatgaggattcacagacatagtcataccttccaggttaagtaaggctcaattccaggcagctgtctgtctcagctcctcatgcacatccgtcgcttctgtctacccagcatttgtttctcccttattcagttctcattgctgtgtaacaaattgacagaagtgcatcaactaaagcaacacaaatgtattatctcacagctctataggtcaaaatccaagcacggctcaaccggattctctgctcagggtctcatggggctgaaaatcaggtgtcagctggagctgtagtcttatctaaagctcaggggcttcttccaggatgattgggttgttttcaga

SEQ ID NO: 210 - DNA, 670 bp, Neisseria meningitidis
actacaggcatgcactaccatgcccagctaattcttttagttcttgtagaaatgggttcttgctatgtttcccaggctgatctcaaactcctggcctcaagcaatcctcccatctcggcctcccaaagtgctaggaatacaggcatgggccaccatccctggccacacaattgttttttaatttagttatagtagtctgtaccactgtaggatgacaatagttaacaataatatatagtttcaaatagctagaaggaagatactgaacagaaagaaatgagaaatgtttgagatggtagacatgctaattaccctgactgatcaccatacattatacacatcaaaacatctttatgtaccccataaatatgtacaattattatatgtcaatttttttttttttttttgagatggagtctcactctgtcacccaggctggagtgtagtggcgcaatctcggctcactgcaacctccgcctcccaggtgcaagcgattctcctgcctcagcctcctgagtagctgggataacaggcatgcgccaccacacccagctaatttttgtatttttagtagagatggggtttcgccatgttggtcaggctggtctggaactcctgacctctggtgatcagcccacttcagcctcccmaagtgctggggatgccggcg

SEQ ID NO: 211 - DNA, 923 bp, Neisseria meningitidis
atacctctccaaccccatgtcctactgttatatcctcttcgtgcaatttactgaagaacatgcaaattatgctcctaatatcaaagcctttgcactgtcattttcttttctttctggaactttctttctccagatattcccgtggttcattccttcacttcctgaggtctctgcttaaatgtcacctcctcaggtcttccctgaccaaactgtctataatagtacctgctccttctttggctcctttttcctaccctgttgtatttttctccatggcactcatcactccctgacataatatagttatttgattatctattttctgcctggttcattccaacacaccagcagggagttagttttgtaaactgctgtattctcagagcatagaataatgcctggctcacagcactactcaacaaatatttgaagaatgaaagcatgaaataattacacaaacataaatatgtattatagctgtgcttggtgctataaaagagaagtattggccttttcttctggctaattgctttggcctggtcagagaattcagggaaggcttcattgaagacttgaaatttacaatgaattgatcttagccgggcaaagaggaaggggaagaatcctctgggccgaggaacagcctgtgagagggtcttaatctggggaggatagcaccttggagggacagacagatggcccgggcaggaaccttggggaatgaggggcaaagaggagggtgatacagccactggaaaagctttgggctttatcttgagggtaatggggagaggcggagggtgacatgagtttattgagatggtgtttttcaaaacagcatctgtttgaaaacagcaatctggtttctttgcttattaataaacttgtatacagagctgactttgtgtcagccctgtttgaag

SEQ ID NO: 212 - DNA, 808 bp, Neisseria meningitidis
ctaaaataaagcctgttttataataaagtgttgaatatctcacataattcattgaacattgtactgaaggggcaaaccagaatggttgtatgggtacttgaagtacagtttctactgaatgcacattgtttttgcaccattgtaaagctgaaaaattgtagatttaaccaatgtaagttggagaccatctgtgttttgttcctccttaakgcatacaaaagtgtagccaaagagtgtttcaaagctggattacataatgaattattattatttttttttgagatgaagtctcgctttgttgcccaggctggaatacagtggcgtgagctcgcctgactgcaacctccgtctcctgggttcaagcgattctcctgcctcagcctcccgagtagctgggattacaggcatgcctggaattacaggcacacgtcaccacacccagctaatttttgtatttctagtagagacagggtttcgtcatgttggtcaggctggtctcaaactcctgacctcaaatgatctacccgccttggcctcccaaagtgctgggtttacaggtgtgagccactgcacctggctgaaaatccagatttttgtccaagattgcagaataaattgcctgggacaagtcaatgagtgaggagagataagtcaatggactgagaaggggtaaactcagtcttgcataaacagaatacagaggggatttgggtggatggggagcagtgagtgaatgggcaaagataggacaaaaccaagcccacttaaagaacaataatattacaaaggacaaagttgagaataagag

SEQ ID NO: 213 - DNA, 768 bp, Neisseria meningitidis
taatgtttttcttcttttcaaagatgtaatatttctgttaacactatagaaagataagaaagataagaaccttcagggctctttgaagacaaaattgtattctgaattgggcattcattagactgagcggataaatctctaaatctgggttttatgattttaggtttgtttgtttaatggatttctttgcttaaacttcaggtgcatgcatgataattttgaagagcagagagatggacaaatgtgatttgatttataagtcttttcaaaggcatttgaaaatgtatttcaggtttagttaagcttatttttcacactcttagttgaaggcaggagtgattgttttcctccctccacacctcgaaagatggaatggtttttcacttataaatttttccatctcagaaaaggaggagcagaggttttccagaagggttaagaataaaggtggggaaggcaagcccttgttaccataagagcaggaatccatacggaagagtggctggtttagatttgctggcttgagagtggattattttatccaactcttgatcagtgttgtgagaattaagtaagataatggatttaaggggcttagaagtgtccaatcaatgttagctactgttgttattctcagtactacctgtaggcttgatggatatatttggagacatttgtaccaagggttatggggcaataagtgcgtggttcccatttggcccagtgaacttttcaggacttaggatgaggaaggcgggaaaagccctg

SEQ ID NO: 214 - DNA, 736 bp, Neisseria meningitidis
ccggcgcgatcacagctcgttgcagcctcgggctcctacagcttatgcaatcctctcacctcagcctcccaaacccacaccaccaagcccagctaattttttgtatttttggtaaatacgaggtctcactttgttgcccagactggtcttgaacccccggcccaagtgatcctcccaccttggcctcccaaagtgtgtctccccacctacactcccattctttcccttaaaaaaagtctgagtctgggtgcagtggctcacacctgtaatgccagagctttgggaggctgaggcaggaggataccttgaagccaggagtttgagaccagcccaggcaacacagccagactccgtctctacaaataacacttttaaaaaacttacccaggatacccaaaggactataaatcatgctgttttaaagacacatgcacacatatgtttattgcggcattattcacaatagcaaagacttggaaccaacccaaatgtccaacaatgatagactggattaagaaaatgtggcacatatatgccatggaatactatgcagccataaaaaatgatgagttcacatcctttgtagggacatggatgaaattggaaatcatcattctcagtaaactatcgcaagaacaaaaaaccaaacactgcatattctcactcataggtgggaattgaacaatgagaacacatggacacaggaagggggacatcacactctgggggctgttgt

SEQ ID NO: 215 - DNA, 891 bp, Neisseria meningitidis
gtacccttctttaaaatcttcaaatatctaatcaggggttcaaatttcctcaattgtctcacaattttttgggtttttttgagacaggatcttgttctgtcactcaggctggagtgctgtggcatgatcatagctcactgcagccttgaattctggagctcaagagatcctcccatctcagcctcctgagtggctaggactacaggtgtgcatcaccacgccaggctaaattttaaatgtttttatagagatggagtcatgctgtgttgcccaggctggtctcaaactcctggcctcaaacaatcctccgccttggcctcccaaaacactgggattaggtgtgagccactgtgcctggcctaattttttattttattttatggtattttttgtttgtttgctttgtttctttctttttttttttttttttggagacagagtttcactcttgtcatccaggttggagtgcaatgggatgatctcggggsactgcaacctctgcctcccgggttcaagagattctcctgcctcagcctcccgagtagctgggattattagcatgcgccaccatgcccagctaagtttttgtatcttwagtagagatgggttttcaccatgttggccaggctggtctcaaactcctgacctcaagtgatctgcccgcctcggcctcccaaagtgctgggattacaggtgtgagccaccgtgcccagacatgacgtgtttgaatcaggatccaaataaagtctagattctacaagtgatcaatcttttgtttttgagttaatagggtctctttctctctctctctgtaatatattggctaaagagactaggttgtttgttttggggagtttccacagtcttgaattctctggctgcacctagtct

SEQ ID NO: 216 - DNA, 2033 bp, Neisseria meningitidis
ccagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcaaagtcctggcctccggtgatccaccagcctcagcctcccaaaatgctgggattagaggcatgagtcaccatgcccagcctaaacttggcaagataataaatcacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcgtcccccagcatcaccggctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagcacaggggctcatgatgagtgccaacctattagataatttaaaaaaaaaagtgttgaatgagtggaaaaacaaggtgatgtttgagtctatagtggtcaagggcttcagaaaaggacagacccaagttcaaatccctgtactttgaatttctacttcatgccatgcaaaattactttaccccttttaacctcagttttcttctgtgtgaaacaggaacaatagtttcattcgtcattcagtttctctcaagatttcacgagatcatacctataaaacatccaagtcatttaaatgtatcatcatttctgtcataattagtgggatccatttcactattattggatatacagttctgtgcctgaaacctacaaaaaaacaaaatgttaagtctaaaaagcattagtgatttctcatttttatattactaattataaccctatttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggtttctgctgcatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccggagagctgtgacttctctgtgccctgggcccaaactatgaagacctgacacactatgctaaaagtccaacgctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaagg

SEQ ID NO: 217 - DNA, 666 bp, Neisseria meningitidis
ccacaaatataactttagcaaatatttagcataactatcaaaattacaaatcatattaaatttgtataaatgtatgcaattttcggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggca

SEQ ID NO: 218 - DNA, 691 bp, Neisseria meningitidis
gtaccattatgttccttaaaacaaatgactcccctgtctactaggcattgttctagagtgctcattggggggtggtttgaagacagtgcatgctgctagctgcaggtactttattgctggtgctttctagcccatcctggtttattctgggatgcctggtgttcagaacctggcaggtgcacatgtgaataggagacacagggagttctcaactggtcagcagcttcctaaagcacaggaagtaaaactccagccctgccaccaatgtctttgcctctcatctgcctcatggggtgtagagaatcatctggagtgtgagagtggggctctggaattaccttgacactggttcaaatccaggcactgccacttagcaatggtctagtcctaggtaactcacatagcctgttaagcctccatttccccatctgtaaaatgggattgtggaatgccttcctgatagggcctcacagtgttgggcacacgctgagtgtgcatcagtgctaacgatcattctcttcttgcaggctctgttcctgtatgagcttctgttaaagaccaccagaaggcctgaggagcttttgaggtaggaaaatgtaactcggcctgggtgctgaacaggcctttcagagccttctgccagagcagcctacttttccaggtgggagagttaggcagtcacatctgtagc

SEQ ID NO: 219 - DNA, 721 bp, Neisseria meningitidis
ccgggcaactcttcctgctcgaacatgtaggtcttcctcaaagcaggtctagcttccatccatttgctcagttattggcttgcccacctgggcaggtcttttaatatagttcagtggtttgtaccagcaaactgattagaaatgcaaagtattaggcctcaccccttacctactatatgtaaaactctgggagtggggcccccaatttgtgtttttacagccttccacacaatgctgatgcaagctcaactttgagaatcactaacagaattaacagtccaagggaatgagagagcttcattaaaactttgcatattcctgtaatgatcttgaaggattatacaccaagcactctatgcttcctggttttctgggagataatttactctttggaaattcttcattctggtctgaaacacaaggccagagttgagaaggtgctttttaatatccattacaggagtctgtaagccagcggttcacaccaaaagttcaaatgctgtaaggcctgtgtttactagcttagacactgaaaaatcagtcactggctgggtgaagtggctcatgcctgtcatcccagcactttgagaggctgaggcaggaggatcacttgagcccaggaatttgagaccagcctgggcaacatatcaagaccctatctctgcaaaaaataaataaattagccaggcatggtggtgtgtgcctttagttccagctactc

SEQ ID NO: 220 - DNA, 1367 bp, Neisseria meningitidis
cctgaccccatcagcagagcctaggtcacaagcctctaaattccaaggcccatcacctgtttccctgtgtgatttgaaatggggtcaagctcccatttctccttgaagaactgagcacctactttgaatatctcatcaggaaggcattttattgctgatggctggaaatatggcatcaaatccttgtcaagcatccggagctctgccttagttaatccagctggggagaaaaaggaatcacgggggtttagttcaagccatcagaactccgcttgttttattaatggtgctgcataatgttcagatctgagtgttctaggcaggcatcattccttacaaaaggccctggaaatcacactggggaatcaagttccttcatcaactcagaaaaaaaaaatgtgggtcacattagccctgattggcctcctacagtgaaacgcatgcccagaaggaacttcaatttacacactttcaaattttgtataaacctacttaggggccaattaaatcacattctaaactagcggttttccaaactttagtgtacacaagaatctccaaaagagcttgttttaaaagcagatttgcagacccaccctctgcaacttcaaatcatgaaatgtaggttctactgtaacgccactgatgtttgctacacatggccaaggataatgttttattttgtgtccccacatttaagtttggaaagagagagaaaggtatgctcagggtgagtcttacctgcaatggtcccaagctcctgcaagacagaactggtccactcagtgggatccccaaacacaacttcagccttcctcttaaactcggctaagacatgtgtgctgcagagcagggtcccaattctggccactaccaccctggtagtggttaaagagggagggatataatatgagcttggactcttcagccaaaaacaaacaaacacacacacacacacacacacatacacacacacactgcacagtaggctcagcagggacagcagatccagcttatcccattagcccagtgggattttagcccagaaaggtgccaagtgtcaggaggtggaatatctggatggatggatggatagatggatggatggatggatggatggatggatgaattaacccatttgccattttgcacattcatattttagttacctgaattctgagatctttataagtgggatttcagtgatgtttatagcacacagggttgcaccaagtcctaccaaatgaaagctcttcaggtcctggatactgtatcctgaatcatccaggtacccttgcaaaatggattcagcctaaaaaatagtaagaataaaagataaaccatccagggatgatccagggtcccca

SEQ ID NO: 221 - DNA, 1180 bp, Neisseria meningitidis
ccggaatctgtctcttatcatgtttttgaactttgcttttctttgtgttggcttcattgagagacaggctctatgcctgcatgtggtaggttccagcagatccttgtgtatatccttctaagttcaagtccagagtaaagaaagctcttcccctaatgctccactcaaagttctggttgactctggttaaatcacatgtccaatccagaaccagtgactgcagctaggctaaggtatgaattgaaattcatcactcctggaacttggtgcagttagctttgactgaaccacatgaagcaggaatacaagagaggtggttctccagaggaagttatgaatgatgaatagccactgtgctagaattatggagacttatgtgtcagccgccttaaatcaaggcttagtttaaaatagtttaacaccaaagcattttgtgtgctactcttggaattgaagagtaaacattggaattgaaggggtgaacatatttctgtaggaccacagaggaagaaaaaatcattaaggggtaaacatatttctgtaggaccatagaggaagaaaaaatcattctggctgaaacctcatgaagaaggtgacatttgagttgaaccaaagaaaaaaaaaaaagaatgtctgcacttggaagtgcagaagggcatttcagatgaaaggactggtttgaacaaaggcaaagagacaggaaattataaggttttgttggaggttgtggaaaggctgggtgcggtggctcatgcctataatcccagcactttgggaggccgaggtgggtggatcacttgaggtcaggagtttgataccagcctgggcaacatggtgaaccccgtctctacaaaaaatacaaaaagccagatgtggtgatgtgcacctgtaattctagctacttgggtggctaaagcacgagaattgcttgaacctggggaggtggaggttgcagcgagctgtgccactgcactccagcctgggtgacagagcaagactccgtctccaaaaaacgaaaaaaaaaaaaaaaagggagaagaaacgttgtggaaaaagatgctggaaaagtttggatcctgatgcagaagaagttgtatgtccaaactgtctgagggtcataagagtgactgaaggaaataagcagcagacacacaggacacaagtgcctttaatattggtg

SEQ ID NO: 222 - DNA, 707 bp, Neisseria meningitidis
cgaagccgatatatgccaccatataagcgaaaaagagtccgggattttttgctcgccagacatacaccggttccgggcatttttaacccgtttatcaatcgcgcctgcgcgccacctttccatgcttcgcggaaacaaaatatcgggataaggaaaaaaacggcaacgacaaaaaactgctgtacatccataactactttccttgtttcttttgtaattcaagtaactgttcgggtgtgacggcgggatacccctgcgcatcttccggtacctggtgcatagccggaatagggaccagcggccctaaaaaacgcggttcacgtttaaaaatataaaggtcagccagcgcaccgaaacgggcggcaaattcacgaatacgtactgacagcatatctttcggtgacggtacggcataacactgagcctgaatccccatatgcagcgcaataaataatgctcgctcacagtggaaacgttgggtgataataatgaaatcattagtatcgaaaactttgcgtgtacgacgatggaatccagcgtacgaaagcctgcgtaatcgagaacaatatctgatgggtcgacaccagcagcgattaaatctttgcgcatggtcatcggctcattataactttgcaatgcgttatcgccgctcagtaatagataatttaccttaccgctgttataggcattaatcgctccttgaatgc

SEQ ID NO: 223 - DNA, 737 bp, Neisseria meningitidis
ccgatgtatgtttcacgcgttgcataattaatgagattcagatcacatataaagccacaacgggttcgtaaactgttatcccattacatgattatgaggcaacgccatgcatccacgttttcaaaccgcttttgcccaacttgcggataacttgcaatctgcactggaacctattctggcagacaagtacttccccgctttgttgaccggggagcaagtctcatcgctgaagagcgcaacggggctggacgaagacgcgctggcattcgcactacttccgctggcggcggcctgtgcgcgtacgccattgtcgaattttaatgttggcgcaattgccgcggtgtgagcggaacctggtatttcggtgccaatatggaatttattggtgcgacaatgcagcaaaccgttcatgccgaacaaagcgcgatcagccacgcctggttgagtggtgaaaaagcgcttgcagccatcaccgttaactacacgccttgtggtcactgccgtcagtttatgaatgaactgaacagcggtctggatctgcgtattcatctgccgggccgcgagacacgcgctgcgtgactatctgccagatgcctttgggccgaaagatctggagattaaaacgctgctgatggacgaacaggatcacggctatgcgctgacgggtgatgcgctttctcaggcagcgattgcggcggcaaaccgttcgcacatgccttacagtaagtcgccaagcg

SEQ ID NO: 224 - DNA, 675 bp, Neisseria meningitidis
ctgataaagacatagctgagcctgaggaagaaaaagagatgtttttgtttgtttgtttgagatggtgtctcgctctgttgcccaggctggagtgcagtggtgcgatctcggctcactgcaacctccacctcccgggttcaagcagttctcctgcctcagcctcctgattagctgggattacaggcacgtgccaccatgcccggctaattaaaaatatttatagtagagatggggtttcactgtgttagccaggatggtctcaatctcctgacctcatgatccatccacctcggcctcccaaagtgctgggattacaggcgtgagccactgcacctggccaaaaaagaggtttaattggacttacagttccacatggctggggagccctcagaatcatggcgggaggtgaaaggcacttcttacatggtggcggcaagagaaaatgaggaagatgtaaaagtggaaacccctgataaaaccatcagatctcgtgagacttattcactatcatgagaacagtatggggggaacctaccctatgattcaaattatctcccaccagtcccccccccaacaacatgtgggacttacaggagtacaattcaagatgagatttggggccaggcgtggtggctcatgcctgtaattccagcacttttggaagctgaggccggt

SEQ ID NO: 225 - DNA, 1517 bp, Neisseria meningitidis
aaaaaattagccaggcgtggtggcaggtgcctgtaatcccagctacttgggaggttgaggcaggagaatcacttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattataaaaactcttcaagtgattccaatgtcagccagaactagtgaccaacaataattcacatcccatggagctccacatgggcactcctgtgagtgcaaagcaccttccggtctctggacacactgaactcaaccatgaacagaaatacggactaatgtacagctggtatttgagttaattatgccaatcatggaaaaaaacagacacagcttctcaccaaagggtgtaacttccaacttctcctaaatagcgctgttctaaagctaggcacgcccatgtgggcagactgaattcaaccttctttcccatgaccaacactctcctgacctctaggaagccacaaaatcgttgcagagaaggaaaagccttctatattctttcccccaccaaaaaaaaaaagaagaagaagaagaaaagtcaaagcctaaagtttttaaaattctagattaataagttggtttgggctagttacaactcaacccttggaaagaataaaggaaatactgttaattaccccatatgagattttaatagagaaaggcttaagggaagaccaccacctagtgaccaaaggcaggatgacattttcagagcacctagctgggctggcaggcagcaatctgttttctctccaagtgtactgagaagggaacgtgggccaggcacagttgttcacacctgtaatcccaacgctttgcggggcaggaggcgggcagatcacttgcggtcaggagttcacaaccagtctggccaacatggtgaaaccccgcctcttctaaaaacacaaaaattagccaggcatggtaatctgtggtcccagctactcgtaagaagtaatgctataaagtgtacaagtggtaaaatgcagaaattaaacagttatgcttttccattagccacgccctcacagacagcatctggcttacaaaaacaaacactgaaagttacaacaacaaaagtgaaacatacttcaccaaacccaaattcaaagccttggaaatagaccaattatgctaagtgctaaatgacatggcagcaaattactcatataaggaatcgttttcaagtttgctaaactattttaattctttcaatctaaagccttaacaaagatgagcagcactagctgtttccaccctttgattatgataaacttcatctccactttcattaataaactgctaaccatattaaacaatccttccgtggaatctgtcccaccacaagtttgatttgctgtttcttcagcatcttcaatatctgccgggatgc

SEQ ID NO: 226 - DNA, 679 bp, Neisseria meningitidis
gggcttggctgatccatggagatatctgcagcttgccagcagctgaagtctttatttgcctttatctccgttgtggcctctgatgagccagactacagagatgctgatgaaatctgggaggcaatggtggaggctgtagtttcccaggagaactctggccctggggaattccttccagtctctgagtccctgtggcacatctccatgtgtggcggactaggtgattgctcctagtgattctgcttagttcctttattagaattataagctttttgccatgtgactttgtagtacatctcaataggtagagtctaattccttgcccttctaactttgggctttggtcattggaatgtgagcagacacattttcccccagcagaagttttaaatgtgctgcatgatttgacttgacctcttggcaattgcgtctcatgtgaagggacatgtggagcagacctgaactcaacccaaaccttggagccaagctgagctcagcagaacctagctgagcgcagccaagccaaacccagtgtaatcacagccaatctggagactcagaagcaagaaacaaatatatgtgatagggatctattgggagttgagagcaatttctcttttttaaagtaattgtgatcttttgagatggagtctcactttgtcacccaggctggagtgca

SEQ ID NO: 227 - DNA, 627 bp, Neisseria meningitidis
caataactttttttgtatagccattcattgtctagatcaatgacagaacaacatattttctttttccctcaaaagcccgagtgatcattaaggaaggcgatgtagatgtttcagattctgatgatgaagatgatagtaagtataaaaaggtttaaagcctgggcacagtagcttacacccataatcccagcattttgggaggccaagatgggaggatcacttgaggccaagagtttgagaccagcctgggcaacatagtgagaccttgtctctgcaaaaaaacattttttttcaaatattttcttaaaaaaggcttaaagtagaactaggcagggtagtgtgtgtctttagtcacagctacctgggaggcttaagtgggtggattgcttgagcccaggagttcaagctctgcctggtggcaagactctgtcttctttaaaaaaaaaaaagtaaagcacagaatacctggcatctattctaataagtagactgcaacaaatgacaacttttgatgtaatctttttgttatatttaccattgatatgcagtcagttgtcctgaatgcattatttatataaatagtccatttaattttcattgatgctggtggagaaaagtcttgaaatt

SEQ ID NO: 228 - DNA, 695 bp, Neisseria meningitidis
ccgggaggccgaggcaggcagatcacaaggtcaggcgttcgataacagtgtggccaatatggtgaaaccttgtctctactaaaaatacaaaaattagctgggcatggtggtaggtgcctgcagtcccagctaatggggaggctgaggcaggagaattgcttgaacccgagaggcagaggttgcagtgagccaagatgacgccattgcactccagcttgggcgatagagtgagactcggtctcaaaaaagaaaaataaaaataaagacagaaaaagaaagaaaaagacctaatatcatctaaaatgaaatcatacaaacaacttttccatgatgttctcaatgaaaagatttcttaccagtgttctctctgattttcgaacaaatggaaatttttccaccagtattggcatgagaaaccacggtgccctatttttaaaaaattaaatcaatccatgttgactttactttctagaaaaggaataaaaaggaaaactaccattctaaaagcaaatatcgatagacataggaggcaaacaggaacccttacctcaaagaactggaactttttttgttttttgagacggagtttcgctcttgttgcccaggctggagtgcagtggtacaatctcggctcactgtaacctctgcctcccgggttcaagcgattctcctgccttagcccccaaacagctggg

SEQ ID NO: 229 - DNA, 715 bp, Neisseria meningitidis
accctgatgataaattaacaacagaataaaggtcactctggttttaccctaacaaaactcaaaaggaagcatcaaaaggatcaagctgatttgaaagtaacttaagtgtatgacagaacaaagcccaatactcttcaaagaaatacaactaaatcaaatactcaacaatgtaaaatccacaatgctcatcacccaatcaaaattgctaggcttgcaaacaaaaaaagaaaatatgactcataactaagagaaaaatcagtcaacagaaacagactcaaaaatgaccatcatgagggaattaacagtaaggatatgaaggcagctcttataaatatggaatagttaaaagacccagaaacatccacccacctgtcccggggtccattctgtttgccagcttagggaagccacagtgtctatggagctgaggtccagctgctccagctcactctcattaagagccagagcaatgcgccccagggagacgatatggtgttctctccagtaagatggcatgtcccaaacctttaggcaaaaaaaggaaatagattagactgaacactgtgatggtatttacaatgatttgaatgtttgtgcccctctaaaatgcatatgttaaaacctaatctccaatgtgatagtattggaaggttgggccttgggagatgattaggtcataagggtggagcctcatgagtgggttagtgccttgtaa

SEQ ID NO: 230 - DNA, 603 bp, Neisseria meningitidis
cctgatccaaataacaatataacaataaaaaacaatacacataaaaatacagtagcatttttgacataacattttgtacatatttacatagcacttatattgcatcaggtattataactaatctagagatgatttaaagtatacatgaggatgtgcatagattatatgcaaatactacactattttatataagggacttgaatatccatggattttggtatctttaagaagtcctggaaccaatccttggtggaggtatccacaggggcaacttcattttatttatggttagttcttatttatttagctaattgttagactttcaggttgcattaaaaaaatgcctcaatgtatgcctttatacatatactgttgggtacttgtctcatttactcaggctaaattcccagaggtggaatttctgggtcaaagaatataaatactttaaaagcttttgatacagatagccaaattgccctctcaagagtatgtaccaacttatattctcaactacaacaaatgaggggtacccttaccttgtatctttccagtatcgtaaatggtgataagtctttatacttcttgacatgtgaagaatcaaca

SEQ ID NO: 231 - DNA, 640 bp, Neisseria meningitidis
  misc_feature (43)..(43): N is any nucleotide
cgaaaactgtctaatgcgtaaccggaaaaggcgttcacgcgcnatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcat

SEQ ID NO: 232 - DNA, 710 bp, Neisseria meningitidis
ccggcaatggctggaacagaaagagatcccggatccctatcgtaaaagtcaggacgcatttgaacatgtctacggtatgttggagcgcgccagtcaggaatgggcgacgcctcagccggtaatttgagtttataaaatacgatgacaactaaaaatatgaatacgccaccaggcagcactcaggaaaatgagatcgatctgcttcgtctggtcggcgagttatgggatcaccgtaagtttattatcagcgtgaccgcgttattcacgctgatcgctgtcgcttactcgctgttaagcacaccaatttatcaggcagatactctggtccaggttgagcaaaaacagggcaacgccattctcagcggcctgagcgatatgatccctaactcatcgcccgagtctgcaccggagatccaactgctgcaatcgcgcatgattctcggtaaaaccattgctgaactgaatctgcgcgacatagttgagcagaagtattttccgattgtgggtcgcggctgggcgagattaaccaaagaaaaaccaggtgagctggcgatcagctggatgcatattccacaactgaatggtcaggatcagcaactgacactcacggttggggaaaacgggcactatacactggaaggtgaagagttcaccgtcaatggtatggtcggacagcgtctggaaaaagatggcgttgcgctgactatcgc

SEQ ID NO: 233 - DNA, 658 bp, Neisseria meningitidis
  misc_feature (145)..(145): N is any nucleotide
  misc_feature (502)..(502): N is any nucleotide
acccggcggaaacacccgcagcagccgctcggtgccgaacagtttgaccagccccgaaaacaggacatacatcagccccgccgcaatgaggccccccgccgccgctgccgggcccatctccttgatgaccagcgccgtcggcgantaaaaggcgaacgaactccccaggaaaatcggcacctgcccgcgcgtgacaggtgaaaaatcagcgtggcgaccccggccccgaacagcgccaccgagggcgacaaccccaccagaatcggcaccagcaccgtggacccgaacatggcgatggaatgctgcaaccccagcaccacccggcgctgcggcgggagatcgggaagggggggcggcgcggcagtctgcgtcatggggaaagtgtagtgggcagggggaggagacgagagacagaaacatgcttctgctgtggccttcttttcgctgctccacgtccaacggagaaacgcagaacgccagggccgtcgtgcacgaatgcggnagcctcgcgtctgtagaaatcacgagcatccagaccaccccacgcacttgaggaacactgacctgcacgcgccatcaccgcaaggtgcatagcgccacgtttaaggcccctgcccctctggggtaaggggtttaggggcggggcaaaaagctaaag

SEQ ID NO: 234 - DNA, 339 bp, Neisseria meningitidis
cccggctgaacaacctgctgctggtgctgatcgggctggtggtggtgctgacggtgcagctcgtggggaccaccctcagcgtcacctgctgatcacgtccagcgccgccgcccgcctgctctcgcggacctgcggaccatgatgctgctcgccgccgctctgggcatcctcggcggggtcaatgggctgtatgccagttattacctcgacaccgcgccgggggcgaccatcgtgctggtgaacacggctatttttctgctggcgctcgcgtttcggcggaagtaagggcgcttccctaaccctccacgggcaacaagcgcaattcgcccgtgtccgcct

SEQ ID NO: 235 - DNA, 540 bp, Neisseria meningitidis
gtaatcccagaactttgggaggccgaggcaggtggatcacaaggtcaggagatcgagagcatactggtcaacatggcgaaaccccatctctaataaaactacaaaaattagccaggcgtggtagcgcacgcctgtagtcccagctactcaggaagctgaggcaggagaatcacttgaacccgggaggcagaagttgcagtgagctgagatcataccactgcactccagcctgagtgacagagccagactccatctcagaaaaaaaaaaaaaaaaaaaaaaatatatatatatatataaatataaaaccagtctaggatcagacttcaagtttcactgagctggaagtggctgccaatgctccccagctctttagcaaaagacatttacacacgatattgtattggaggcatttggggaaaatgaaggaagtggggagcatttacagggtgcagtgactctaacatcaagagctaattacaagagccgtgggcaatgacagatgccaaaacaagatggaggaatcaacttttatatagact

SEQ ID NO: 236 - DNA, 755 bp, Neisseria meningitidis
ccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccacttacttggtctctccttttacaaccaccacaaccgaaatctagggctgcttttaaaaaattatttttttgagacagagtctcattccattctgtcacccaggctggagtgcaatggtacgatctcggctcactgcaacctccgcctcccgggtccaagggattgtactgcctcagcctcctgagtagctgggattacaggcgtgtgccaccatgcctggctaatttaagtatttttagtagagacggggtttcacatgttggtcaggctggtctcgaactcctaacctcgtgatcgcctgcctagcctccaaagtgct

SEQ ID NO: 237 - DNA, 737 bp, Neisseria meningitidis
cctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttsctggccctgtcctctgctaaacttcccacaggccttctgcacgatcacacagagtatgcccaaactctctcaggcctctggcagctgaaaaccac

SEQ ID NO: 238 - DNA, 557 bp, Neisseria meningitidis
cggggggaaaaaagaataaaaggatttaaaaaatacaactatgttattttgggatggaaattcatctgatatacacacgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgtcaggtagcctcaacaaattcaacatttattctagctctgatatggtctggctctgtgtccccacccaaatctcacttttataatttattttttttgaggcagagttttgctcttgttgcccaggctggaatacaatggcaagaacttgggtcaccggaaactccggcccccaggttcaagagattctcctgcctcagcctcctgagtagctgggattacaggcatgtgccactgtgcccagctaattaagtatttaaagtagagatgggggtactccatgttagtcaggctggtctcgaactcctgacctc

SEQ ID NO: 239 - DNA, 655 bp, Neisseria meningitidis
cgggtcaggaagggattcctacggaagtgatttttcctgtttggcctttcttaagggcagattataattataaacagttaaaactttgtttaaggaggcccgcactaaggtgcagtgggaatgaaaggaagtggtagattctagtgacattgtgaggaaaggtgaactggtccttgagactggtttggaggaggggaggcagacagtaagggaaaggaatccttcaatagttgctccctgtggaatcgaatcttggtgttgccattaatggtagttagaaatatgaagaggaggctgggtgtggtggctcacgcatgtaatcccagcactttgggaggccgaagcgggcggatcacgaggtcaggagatcgagaccatcctggctaacatggtgaaactctgtctcactaaaaatataaaaaattggccgggtatggtggtgggcactatagtcccagctactcgggaggctgaagcaggagaatggtgtgaacctgggaggtggagcttgcagtgagcccagattgtgccactctgctccagcctgggtgacagagcaagactctgtctcaaaaaaaaagaaaaaaaaaatatgaagaagaggcagttggaagagtagttccatcttggccaggttcagttgctggtgggcagc

SEQ ID NO: 240 - DNA, 733 bp, Neisseria meningitidis
cggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgtcaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctatagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacagaggttgcagtgagccaagattgtgccattgcactccagcctgggggacagagtgaaactctgtctcaaaaaatatgtgtgtgtgtgtgtgtgtgtgtgtgtgtgtgtgtgtgtgtgtgtgtgtgtgtgtatgg

SEQ ID NO: 241 - DNA, 709 bp, Neisseria meningitidis
cctgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgcgtggaagtgaagcgtgtcacctcgaggcaaaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctaacaggcatgcaccatctactccacactctgtgatgcagactagcctgccgtcagaacacgaactggtggtcagacacaggtaggtttcagttccagctctgcctct

SEQ ID NO: 242 - DNA, 720 bp, Neisseria meningitidis
aagtaagttcggaaaagtacatttatatgtcaccattactaatacacttggggtaaggtgtattctcaaactctaatgttcatccagccagtcaaggtgccttggaaattgtgtaccctcctcagcccaatagaccttgggcctctgaagaaaactattggaagaaagtttcaagtgggcagtcatgggattgttttagtgtggaagggctaagaaaagaaaaagaattgtggacaactaagatcacatctctgatgtgagcaaacatgatttaaagggattgttggctatgaaccaaaaatcatttaagggtatttttgtactggagaaggccaaggacaaaagatataaagtttcccatccttgggatcatgaactcaaagcaaaagcaaaatggattaatagctacttctatttatagctacttctgttaatagctacttgagcatgagcaatggttagattttaattctagagtttacagtggagaaatacacacattctaggattacttaactcactagtcaacctgtccctctccttatgatgttgacccaatgacactaaaatcccttgggcatcatgattcttgaatgcggtctccaaagaatgctgccaacacaaaggggatcatgaagagactgtgggccttgcttccaatttttcttcttcttcttcttcttttttaagtcatatgtgccctgactcttctggccagtg

SEQ ID NO: 243 - DNA, 1040 bp, Neisseria meningitidis
gtacccctactaaaaacacaaaattagccaggcatggtggtgcatgcctgtaatcccagctacttgggaggctgaggcaggagaatcacttgaacctgggaggcagaggtttcagtgagccaagatcgcaccattgcactccagcctgggcaaaaagagcgaaactctgtcaaaaaaaagaaaaagaaagaaagagagagagagagagagaaagcagagaggctactgcagagaaaagtctagaaggatgggttcatgggttcatcgagagacaatagcttaacaaccagcacaccatagttggcaaaacactatcattgaaaaaaaaacatgctcaaaaggggaaatgccagtttgggtaaatatgcttttgtgttggagagaaagaatttggaacaggcttttcagacccccttaaggcccaacaaacaaattataatttagacaagtctgggattcttcacagctcagcttgtggtgatggtattagcttcacaactccaaacaagttaagctgtctgtgtgaaatctcctcaacaacacctcactggcaaacctggaggtgctgaaaacagagctttcaattcttgtttgcaaccaagggagttgagttggcagatgggcactgtgtccagccttgggaaaggacatcgcagactttgcatcctaagaactcataaccacaacggcaaggtaagacacaagctcttgaaagtttccatcacagtgcagcacaaatgaccttggctatgtgccctgttattgctggtccctgcttaaaaatctcctgtgacttccaaccacacaaatttcctacctggttgcaaaaatgcccttgataattcacccctccctctatcttgccccctttacaatgtggcttggcagctcctcccatcaagagttaaaatctatttcctcaccccttgaatctaggctggccatgggacttgctttggccaatagatgtggcagaaattatggcgtgacagttctaagcatgagtctcaagaggctttgcatgcagcaactttctctta

SEQ ID NO: 244 - DNA, 689 bp, Neisseria meningitidis
aggccaaaccccttaggttttagggtttttttctttttttgagatgggaatctccctctgtcgccaggctggaattcagtggcatgatattggctcgctgcagtctccgcctcctgggttcaagcaatttccctgcctcagcctcccgagtagctgggactacagaagtgcactaccacacccggctaatttttcgtatttttagtagagacggggtttcaccatgttggccaggctggtctcaatctcctaacctcatgatccgcccaccttggcctaccaaagtactgggattacaggcgtgacccacctcacctggccaagtattggtttcttaacagattttgccattggacagaacggacctgatagagcaagatgtcaaaagactccctgacaagtaaaaaaggggccaggcatggtggctcacacctgtaatcccagcactgtaggaggccggggcaggtagatcacttgagcccaggagtttgagaccagcctgggcaacatggcaagaccccatctctagaaaaacaaaaattagtgagcagcacaggcctgtagtcccagctacttgggaggctgaggtgggaggatcccttgagccccagaggtggaggctgcagtgaaccaagatcacgccactgcatgctggctggggtaatagagcaagaccctatctaaacaaa

SEQ ID NO: 245 - DNA, 848 bp, Neisseria meningitidis
cagaacaaaggggtctgggaagaatgacagcatgactgaagggctccgtctggaaaggaaggatagtgtgccaccaggagaaggagagccaccccagacaccaacagctgagacaatcccagccctgggttcatggcccaaagtcacagcccactcaccaaccccaaawacataccccytgtgacatgtggctgagcaccagacatcttcctctcaccttgctgaggataccttgctgctgggcaggtgacaagtcggatacatactgggagacggcacttctcaggacctgcgagatgtccttgcgtttcatgctgcagaaggcctgggtgctgaccccagccagcagtgcgcccatctggctgacattgtagaaagacagcacctggaagaggagcggtgcgcagtcaggctctgctcccgcctttcacctctccaacgtgcactcagcccatctatgtgccaagtatagggatgggtgacaccttaggggcacagcagtgagccagacagatgctgcctccacaggccttccttccttctatcaagaaagagagttggccaggcatggtgctcacgcctgtaatcccagcactttgagaggccaggcgggtggatcacctgaggtcaagagttcgagaccacctggccaacatggtgcaaccccatctctactaaaaatacaaaaattagccaggcatggtagcaggttcctgtaatcccagctacttgggaggctgaggcaggagaattgcttgaacccaggaggcagaggttgcagtgagctgagattgtaccattgcactccagactgggcaacaagagcaaaactctgtcagaaagaaagg

SEQ ID NO: 246 - DNA, 694 bp, Neisseria meningitidis
gactacaggtatgcaccaccatatgctgcccaggctggtcttgaactcctggagagagatacatacacacacacacacacacacacacacacacacacacacactttttttttttttttgagacacagtttcgctcgtcacccaggctggagtgcaatggcacaatcttggctcattgcaacctctgcctcctgggttcaagctattatcctgcctcggcctcccaagtagctgggattagtaaggcactgccaccatgcctggctaattttgtatttttagtagagacagggttttgtcatgttggccaggctggtctcaaacttctggcctcaggtgatccacttgcctcggcctcccaaagtgttgggataacaggcatgagccactgcgccgggcccatacatatgcattttaaaaaatttatttatttatttcgagacagggtctcactctgttgcccaagcaggagtgcagtggtgctatctcccaggctcaagcaatcctcagcctcccgagtagctgggactacaggtgtgtgccatcacacccagataattttaattatttttattttttaaattttttgtagagatggagtttcaccgtgtcacccaggctggatatttttgtatttttgataggcctgtacagtttccaaagttgcaacctttccccctccctgagagtaggg

SEQ ID NO: 247 - DNA, 707 bp, Neisseria meningitidis
ctgtttaacacagtaagcaggagctcgataaatattaggaatcatattacgctaattgttttacaaggtttgcttcacttacacgtataaattaatgaaaaaacatagcatcctaatgactctgaaagttaaacgccaagagtgctatgggggttagggattttaaaagtggagcaaaataaagactgcgaaacaaatacgtgtgtcgaaacaaatttcaaacaaaaaagatgtaatattcaatttgccatgagtgacaacgttcggctgataacccacatagcccagggaaatcccttccaaatttggacgaagaagagggaaggaagaggggtcaaggcgcagaaggcagtacccaggcctgggaaatcacgaagagacacagtcgggaaagtgggcctccagaacagagaacatactcacttttccaggccccacccatgtctattacccagttaggaggaatgagctcatttctgtgaacgtgagatgaccctcgaccccgtgctcctatcacacgccattagctttgtcccacatcctttcaatccgctcctctaagcgcggtcctgagctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccatt

SEQ ID NO: 248 - DNA, 752 bp, Neisseria meningitidis
caaaattggtgcttaacgaatatttgttgggtggatgaaagcaagcactgactgtcaactactatcactgggggtgattaactttgtctcctcatgcctggccccagtctgcacttagtaggtgcatggtaataataataaaatatctaacacttggacaggcatggtagctcacatctataatcccagcactatgggagaccaaggcaggaggatcacttgaggctcagagttcaagatcagcctgggcaacacagtaagaccctatctctacaaaaaaataaaaaattatccagatgtggtggttcatgcctgtagtcccaactacttgtgaagctgaggtgggaggatcccttgagtccaggaggtcgaggctgtagtgaaccatgattgctgcactccagcctgggtggcagagcgaggccctgcctctataaaatcaaattttaggccgggggcagtggctcacgcctgtaatcccagtatttcgggaggccaaggcaggtggatcacctgaggccagcgttcaagaccagcctggccaacattgtgaaacccgtctttactaataatacaaaacttagccaggcgtggtggcacatgcctataatcccagctagtcaggaggctgaggcaggagagttgctgtaatctgggaggtggaggttgcagtgggccgagatcatgccgctatactccagcatgggtgacactccagcaagactccatctcagggaataaaaaaaatcaaa

SEQ ID NO: 249 - DNA, 714 bp, Neisseria meningitidis
ccagaaatctgcccccatgatccaatcacctctcactgggccccacctccaacactggggattacatttcaataagatttgggtggggtacacatccaaactatgtcaaatataaagtttagtaaaaacttagaaatagcaccaaaccaaaaaaggggtaggtacacatacattttttttgtttttttctgagacagggttgtactcccatcacccaggctggagtgcagtggcatgctctcgactcactacaacctcagcctcctgggctctggtgatccttctgtctcagcctcctaagtagctgggatgacaggctcatgccaccacgactgactaatttttgtatttttagtagagatggggtttcaccatgttggccaggccagtcttgagctcctgacctcaagtgatttgcctgcctcgacctcccaaaatgctgggattacaggtatgagccaccacacctcgcctaacctacattttttgtcgatattaccagattgctctgctaatagtgcacagtttgacagtcccacggaaaaatgaatgtgcccagcattaagtattagcacttcattttatttttgacaatctgatgggtgaaaagtgatttacttatgttttttagactttattggattttcattgaagttgagtatcattttataggattctatatagagaccacattagtgggactaggggatagat

SEQ ID NO: 250 - DNA, 376 bp, Neisseria meningitidis
atcagagtcacttcatcttctgtgaaatttgcaaagatgctaggaggttcccctcctgctgggacaccccagcccagacacaaaccattaattcacaattacatggagtttcactgtctgcaaggctgctccatttaagctctgggtcatgaacacataactctaggcatactgacactagctgggagattttccaccaaaaaaaaaaaaaaaaaatgccatttcatgactattaatccaaaataggtaaatgtgtctggcttatagaataccagcctgattacaaatgcttggtgttggaatggcccagctcacagtggttgtagaagtccagtaggcccaggctttgtggctcactcctgtaaccccagcactt

SEQ ID NO: 251 - DNA, 518 bp, Neisseria meningitidis
ccgccaagccgggctccgcagttgaggcgcgcgcgggggcctgggcggaggactcacggggcaaagcgctgggggagcgggtgggcgcccaccgctgggcctccctagggaaggggtgcaggtgatggatggcgtgggggacagaccgagagaaagagggtgggcaaagtgtgggtgcagcggctttaagggctcctgggattggagggcacttggaggggggggacgatgaaacttcgagaaaagggatccaaaactacttagtaatataataacagcgatgacaactgttgcaataactatcacaatgattatttgttataataatatagcagcagtaaaaacaatagcattagtaataatagctacgattcattgcattcttatatgtgccagtgctgggcttagttctttatgtattttatgtataaagtaatgcctacctcataacagttgtgtggaagaaatggaaaaatgcaggtaaaggccggggctcacacctgtaatcccagcacttt

SEQ ID NO: 252 - DNA, 703 bp, Neisseria meningitidis
cggtacccgaccatcatcatcgtgggactgactttggtggaagtccttggttacatgtcattattgcatttccgacaagttataaagttgtcattaccctctggatagtttacctttgggtgagtatactaactttctgtagaggtatacttgtaatcacaaataagaataaattatataaaacaattcacatttctggacttcattatgaatatgtggttttacccaaaaaatcagggaaatgatttattagtataagaattatgaaaacatctgccatttgcattatgaaaattaaataggtcggtgtttgtttaatagaatgtcaacagagcttttggtcaaaaataagtttttttaacctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggctgatgcttaaagagcaccctcttctgaggggagagggagatagatggagatgtaggccatttagaggggcagcaaatgatttttaggggaaatgaaagag

SEQ ID NO: 253 - DNA, 576 bp, Neisseria meningitidis
ctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgctaaggaggtaatggtatagatgactagatgacaaggacaaagatgagaggtgcgaagttgtccaagtccaacagctcaactgaactttcctaagtggaattgttaaaaagtggtaaatttaaaaacttcacctggctcacgtggtggctcacgcttgtaatcccagcactttgggaggctgaggttggtggatcatttgaggtcgggttttgagactaagcctggccaacatggtaaaacccc

SEQ ID NO: 254 - DNA, 725 bp, Neisseria meningitidis
cggcgcaaatcacctggatgggtgtgaaagattccgaccatacccggaaagacggaacgcgcattgaaacggaaggcgacggaaatgtgcaaacgcgacttggggtgaaaacctacctgaacagccatcaccagcgtgacgatggtaaacagcgtgagttccagccttacattgaagcgaactggatcaacaatagcaaagtctacgccgtgaagatgaatggtcaaaccgtagccgtgaaggtgcgcgtaatctcggtgaagtacgtaccggggttgaggcgaaagtaaataacaaccttagcctgtgggggaatgtcggtgtgcaactaggtgataaaggctatagcgatactcagggcatgctgggagtgaaatatagctggtaaaccgtataagccgcatgtcgagatggcatgcggcttaatattgccgacttcaaacggcgcatcaacgccttatttaaatcctcctttttatccgcgatcgcggatatcgcagcgtttatcccgtagagcggataagatgtgtttccagattgacttatcctcactaaaggataaaacgcataatatccccttaagcggataaacttgctgtggacgtatgacatgatgagctttcagaagatctatagcccaacgcaattggcgaatgcaatgaaactggttcgccagcaaaatggctggacgcagagcgagctggcgaaaaaaattggtattaagc

SEQ ID NO: 255 - DNA, 730 bp, Neisseria meningitidis
ccggcttaaccgtccatgcaacctcaacacattgctttcaactgccgtcaccacgttctccggaaaatctgtcggtaatgaagtcttcacgttatccagtgctgctggaatcattctggcaaagtcactcaggatttcatgcatctgcacttccgggaatctcagcacctttgctgtcgccaaaaaatgtcgcggataaattttatcgattgccgtttttttgcctttggatgcgttaagccccattgccagtttgagatcgctgatgtgtattcccgtaccgccaaggaccggaaatgctgaaatgatgtcgtaaaatggcgtgagtcgataactgccgccagcctgaataaatacggagaagttttttgcatgaccgtccgttgcgccaatcaaccactggaagacctggaatttcataaaatcatagcgatctttcagcgcctcgctggaccccatcaaaaaagccatgatccgcgcgatgcctgggcctccatctgattcatatttcaccgatgaaggtaaaccgaatgtctgacacatatcctcctgtggcaagcgaagtaaaaccgttcgctcagcattccaacgcctgtcaaaacgttcgaccgctaacgcgcgcacatttcccgctttaatgatttctgcgtccggaacattcaacccaagttctttcgccagcagcagacagtaatactcattatcaccgctttggctgagatcgagcgtc

SEQ ID NO: 256 - DNA, 687 bp, Neisseria meningitidis
gtaccccatacagatcacctggggatcttaaatgcagattctgattcaggagctcttggttgaggcccaggactcccatcttcctcttcttcctccttcttcccttggcctcccaaagtgtttggattacaggtgtgagccattgcgcccagctgacgctgcacttccaacaagcttccaggtgattctggaaccgctgctctggtgagcacacctggagcggcaggagataaagcagtggttctcaaacctgcctctagattagtaacatccctgccaggtgccaccctcagagaatctgatgttattgttctggggtgtggcctgaggtatggcctgattttaatgcttctcaggtgatttcaatgcagccaggattgagaacactggattgcagggtggttatgagttcccaagaccagatgagcaaacacgctctctctcattttccttcctctccatctctctcttcttccttccagtcaagtctcaattctacccccttccattccactttttgtggcccttttcaatttgcttaaaatcgaaacgatgacatgaaaataatattaaatgaaattttgataaagccatcaataatttcacagcagtatcccacacatcaccataaagtccccaaacacatttgacatttgagagtgtggtcatctatttaggtcagcgcat

SEQ ID NO: 257 - DNA, 697 bp, Neisseria meningitidis
cctttactcttcttaaaattatctcttgcacctctttgcacatttctatgatcattttaataattattttattgcaatatgcctgcctaatgatagtaaagtgtgcgttacagctgctttcggtaaggaatgtgataaagtcacctactatacaatgagctctgtaacaaaaaacaagaatggttcatattttaacacccgaatttacgtaataacgtagtcatttcaggcaggtgcacaaaacgggtttctggcaatattgaaatagccactggggggcagcagagtgaagtagaagaaacaactgtcaaagcgcctgggttctctaagttcggcaactgccttacctagaaatcagtttccacatctgtaaaacgaaggggtggactacagtggcagctcccaaagtgtggagcacacccagcggcatctgcaacacctgggaacttgttagaaacgcagattgccaggctgctcccggacctcctgaatcagagactgggtggggctccgaaatccagggatccccagactccgggtcacagatggggaccaccgggaccctggcctgttaggaaccagccacagcaggaggtgagcagcaggccagtgagcattaccgcctgagctctgcctcctgccagatcagaagcggcattagattctcctaagagcaaaccctattgtgcactgtgca

SEQ ID NO: 258 - DNA, 466 bp, Neisseria meningitidis
aaagttggagggtacttttgtgatgggtttggtttaaattggtttaaaatataagacacatagtccatagagaattcacctatggactatgctgctaagagaatctcaaagagatgcactgttatgctccagagttttgtgagaggccactaaggtcaggagacacatgccatatatatcaagatgctgtcaacagagaaaaccagtgaggtttcaaacagaagccccgctccattcaaccaggcagccactcctcattgcaggtgctgacctgggctttggctgcttctcacatgggcaactctatacactctattcctgggagaagggcagcaaagacccacttattaaatgatgtttaacaatcctcggccgggcgcggtggctcacgcctataatcccagcactttgggaggccgaagtgggcggatcatgaagtcaggagatcgagaccatcctggctaac

SEQ ID NO: 259 - DNA, 575 bp, Neisseria meningitidis
attttcatggacagcaactcatcttcctggtttttattttttattttattttgacacagggtctcaccgttacccaggctggagaataggtgtgatcacggctcactgcaatcttgacctcccaggctcaggtgatcctcccacctcagcctgctgggtagctgggactacaggcatgtgccaccatgcctagctaatattttgtagtttttttttttttagaggtgaggtcttaccatgctgcccaggctggtcttgaattcctgggctcaagtgatccttctgccttggcctcccaaagtgctgggattaaagacatgcgccaccgcacagcccatcttcccatttttataggaaggctgctgcataattttggaatctttatgctgggctgcaaactcaaaggcatagggggtaagataggcaacagaaattgtgtatcgagtgcttactgtatgcgtggcactgttctaagtgctttacatataacacatttagttttcacaaccatcctatgaggcgattttatttccattttatagacaagaaaactgaaatacagagaggttaaatag

SEQ ID NO: 260 - DNA, 695 bp, Neisseria meningitidis
ccctctactaaaatacaattattagccaggcatggtggcttgtgcctgtagtcccagctactcaggtggctgagacacaagaatcacttgaacccgggaggcagagtttgcagtgaacaacagatcgcgctgctgccctccagcctgtacgacagagcaagactctgtcttaaaagaaaaagaaaaaaaaaagaaagaaaagctaaaacaggccacaaagggaccttttccttttatttatttatttgagacagagtctcgctctatcaccaggctggagtgtagtgacgcaatctcggctcatggcagcctccgcctcccgggttcaagcaattctcctgcctcagcctcccgagtagctggaactacaggtgcatgccacctgtagagatggggtttcaccatgtgggccaggctggtctcgatctcttgacctcgtgatccgcctcccaaagtgctgggattataggcatgagccactgcacccagcctatttttatttatttttgagacaaggtatcagctctgacgcctaggctagagtgcactggcgcaatcttggcttactgcaacctccacctcccgggttcaagccattctcctgcctcagcctcctgagtagctggaactacaggcacatgacaccacgcctggctaaagtttgcattttgagtagagacagggtttcaccatgt

SEQ ID NO: 261 - DNA, 694 bp, Neisseria meningitidis
  misc_feature (173)..(173): N is any nucleotide
tgaaataatgatgtgtttgtatttcataatctatgttgtgtcctagtttttcagtggaatataaataatgatggtaacttagattcaatgtgaaccttgagtaggggtacaagttcaaaatctgtataaaaaaatctatattaaaatgagagaagaggctgggcgtggtgctncacgcctgtaatcccagcactttgggaggccaaggcaggaggattgccggaggtcaggagtttgagaccagcctgaccgacatggtgaaaccacatctctactaaaaatacaaagattaaccgagcgtggtggcgggcacctgtaatcccagctactcaggaggttgaggcaggagaatcgcttcaaccggggaggcagagattgcagtgagctgagattgcaccactgcactccggcctgggtgacagaggcrrctccgtctcgaaaaaaaaaaaaagagagagagacagaagagaattttattaggaaatctaggcaataaaacacagaaatttaactctgagcgtcctggctaccaaagcaggtaggtcaggatttatttatttgatggatgttgcttaaagcctccttgtgtcctagagcagtcaaattcatagagacagaaattagaatggtggtacagtttcgattttgcaaggttcaaaatattctggatatggctggtagtgacggttgcagg

SEQ ID NO: 262 - DNA, 632 bp, Neisseria meningitidis
ccattacactccagcctgaggtgacacagcgagaccctgtctcaagacgaaaaaagttctacttgcaacactccacacaactagtgcaattcttggtatgtcaaaataccaagaatgagaactgctgatacaaaatacagtggaacacaaagaaaatgtccctttgtatctgggaaaggaggcaggggtcaggaaaagctttaaagagaaagtgatgcttcagctgtctttaaacagtaacacagttgagtcttttctggaagttctgcttcttacagaaggaaaagtatgtattcagaaaactgaaaaatgttcagtatggctggcatgtatagtgaccaagccaacagataataaatctggggaacaaagaagcaccaaatagaccatggagggccttgtaaaccagatctgtaactagagagatctggaagtgtgggaaatagactcaatgaaggaacaaccatgtgcttagagagaaccagggaaagctccatgaaagatggagcccagccaagagtggacatgataagtttggagcatctatgatgattctgggtaaatgcatctaacagacagttaagaaccaagtctaggccgggtgcagtggctcacgtctataatcccagcac

SEQ ID NO: 263 - DNA, 699 bp, Neisseria meningitidis
  misc_feature (587)..(587): N is any nucleotide
ccgaacagtctctgactcaaagtaagggcagtaattgtcatctgttgtttttgttccagctgactgtgctgtatcatttctcactcacatttaagtccactgttcttatcactgtagtaattaccctgacagattacccatgttttttttttacatgctgatttcagtggactttttttgagacaaagtctccttcttgtcacccaggctggagtgcagtggtgtgatatgggctccctgcaacctttgcctcctgggttcaagcaattctcctgcctcagcctcccaaatagctgagattacaggcacccgccaccatgcctggttaatttttttatttttagtagaaacggggtttcaccatgttggccaggctggtcttgaactcctgacctcaggtgacctgcctgcctcggcctcccaaagtgctgggattacaagtgtgagccactgagcccagcctcagtggacttacttttttaagccttgtattccttgtatcagccgacactgttggccacccacttcttaaaacttcagtgtttctgatcctcctgtcttctgatcctttaatctctctctttttntttttttttttttttttgctctgtcgcccaggctggagtgcaatgacgcaatcttggctcactgcaagctccacctcccgagttcaagtgattctcctacctcagcctcccg

SEQ ID NO: 264 - DNA, 693 bp, Neisseria meningitidis
ccttgccttttaggaagaaataatagatggaagctatctgaatggtaatgtgcccccttgatctccacttgcttcttctaagaatttcaaacagaatgtagctgtgatctctctggaatgattccttttaaagatgtcttttcattttactcccattgtagcactgctggatctcatacagtttcaaaggtaaaatgccctagaggagaggggaagggatggtatagatttttaataaaaattcttaatggaagtctcttaattgtaaaaagtaatatgtgctcattacaaaaaatgtcaatcaatgcacaatgtgttaaaagtcaacaaacacccttgctccacgggcatcattcctcctcactctagcataagggccaattttttttctttttttgaatggagtttcgctcttgttgcccaggatggagtgcagtggtgctatcttggctcactactgcaacctctgcctccggggttcaagcaattttcctgcctcagcctcctgagtagctggggtaacaggtacctgtcaccatgcccggctaatttttgtatttttagtagagatgggttttcaccatgttggccaggctggtctcaaactcctgacctcaggtgatctgccggcctcagcctcccaaagtgctgggattacaggtgtgagccaccgcaaccggcctaagagctgaa

SEQ ID NO: 265 - DNA, 587 bp, Neisseria meningitidis
gtaccctgtctaaatttgccgtccgttgaggtagaaggcaaatttggagttttcttgtttagaaaaaaaactacagatgactactgtgcacctgaaaacagcactcagcttcactaacgagacatgcaagctagaatcaaattgctgttttgttttgttgcctgtcgtgattgttagctgaaaccaaatcacaaggtctttttctccctctgtattagctcagcatacactgagcttacaaacgtatgaacttcacgttgtcgtggaatcttacagcctgctacttcctaagtatcctttagagaagctgccttggtgaccaatgaatgtggttagcctagtgatactcttctgggccatatactgtgtgactatctgcatggacctttattgaaagcatttctgcaaataatttttttaagtgttttttaaatgtgtgataatttgtgcttttaaagatatcttacacttttcacttatttgtacctttaaaaatcttttttttttttaaaccaaaggtttgcagtatcctcagagtctgaaatttgagcggatagtgatgagccagccaaatcccctgaagattt

SEQ ID NO: 266 - DNA, 695 bp, Neisseria meningitidis
ccagttcgagaccagtctggctaacgtggtgaaacccatccctactaaaaatacaaaattagccaggtgtggtggcgcatgctgctaatctcagctccttgggaggctgaggcaggagaatcacttgaacccgggaggtggaggttgcagtgagccaagatcgcaccactacaccccagcctaggaaaaaagagtgaaatttcatctcaaaaaataaaataaaataaatatgacagtaatctctgtttattaaacacataatgtgccaggtactattgtggtcaccctgcaaagacatggaccccaccacccaaaatttgttttagatgtcaagactgatgatacaccacatgcaccaagagggtaggaaaaggtttattgctcatataatgaagctttctgagagagcagggcagattcccaagcaggtccaaaaatggtttcagaaaaccaggcaaggaaactcccttagcatttatggtggttagggatggggatggggatggggatgcgatggggatggggatgaaatgtgggtctggtgggagggctagggcttgttgggtatgaatttccagctggtgccagaggagagagcagcaggctttcttagcttgcccagatgtggggcagagggggagaaggagggtggaagatgttagcagtcccatatcagaagtggaggcagactgttt

SEQ ID NO: 267 - DNA, 683 bp, Neisseria meningitidis
ccgaatgaagtaatctcttcattgtatttttttttttttttacttatgctgagatttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccaaggcaggtggatcatgaggtcaggagttggagaccagcctggccaagatggtgaaacctgtttctactaaaaatacaaaaattagccgagcgtggtggcaggcgcctgtaatcccagttactcagtagctgaggcaggagaatcgcttgaacccgggaggcggaggttgcagtgagttgagatcatgccactgcaatctagcctgggtgacagagcaaaactttgtctcaaaacaaaaagaaaagaaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcgtgtaatcccagcactttgggaggctgaggcgggcagatta

SEQ ID NO: 268 - DNA, 701 bp, Neisseria meningitidis
  misc_feature (3)..(3): N is any nucleotide
ccntgtcgcccagactggagtggagtagcatgaccataactcactgcattgcggaactcccatgctcatgtgatcctcctgtctcagcctcctgagtagctgggaccacagacatgcatcaccatgcctggctaattttttaactttttgtagagacaggatcttgcttgctatgttgcccaggctggtctcgaactcctggcgtcaagcgatcctcctgcctcagcctgtccaaattcttaacactatactattctgcctcctatactaatcccacagaaataaatttcttttatcaaattaaccttaaaacagaccattcattctcacaagacagatagtcagaaatacaggatcgatctgtgtttcatggtaatacctggctccttccaagttccttatccttcaggactgtagagttgaatccaggttgcctccttaaatcaaagagagacacttccttaaagaaagccccttgtatctccacgatgcctggggcagtgtcttccgcttggaccatctgccagaagcgagaagcaacaaaacaacattgtaaaaaatgcattgagctttgaggaagggccaggcactacatcacaggcaataaaatccatcagaaccgctcagcaaccctaggaagtggagagtagcatcatccccatttcacaggtgagggaacagagacttaaagtgtgatgagt

SEQ ID NO: 269 - DNA, 776 bp, Neisseria meningitidis
gtaccccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttagggtgattggccaaataggacatgttcaccaacacgtctcaagagaaagacagtctggtggacttcagtattccctgatgcatccagtcaagtcctatgggtgaataattttgttcttggggaagggtttcaacagcatccttgtccaaagatatcttcatgggccactgaaagaaactggcctcctagataggtctattacctttaaaagggtttttcttcagctttaacagatacaatagatttggaatgcaaatgaaaaaaatgacaaacctacaaaaagaatcaaaacagtatacaacactgtcctctatccacaaaacaaatggatctttaagtgcaaccacacaaaagagatgacaaaagccttacatacagggttttatatataamamaggagacactttattctaaaatcaccacttagaaatataaacatcttgcacagagtaggaattttattcactttaaaaacatgccaaaaacatatgggagatatttctgacttgagacaatgctatactcttttttaagcatgatattaaaagtactcggcaaattaggctacttacataagagaaataaatttagctcttg

SEQ ID NO: 270 - DNA, 523 bp, Neisseria meningitidis
cctgcactccagcctgggcaacaagggagaaactgtctcaaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccatctctactaaaaacacaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaagtcatcaaaccagatgacacaaatccaatggcatttcactttggtttgg

SEQ ID NO: 271 - DNA, 598 bp, Neisseria meningitidis
ctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagacctaaacaccatcccgacggcggcaaaagccggtggtaactacctctcttccctgctggtgggtagcgaacgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtaaggcggc

SEQ ID NO: 272 - DNA, 616 bp, Neisseria meningitidis
gttgccaggctggcataagcacgcaggcaaaggagacctgacgttcacgatttttcggcgtccaggctttgtcacctcgagcgtcctgcgcttcacgacgcgccgccagttcggcatcgcttacctgtaactgaatgccacggttcgggatgtcgatagcgatcaggtcaccatcttcaatcaggccaatgctgccgccgcttgccgcttccggtgagacgtggccgatggaaagaccagaggtgccaccagagaaacgaccgtcggtgatcagcgcacaggctttgccgagacccattgatttcaggaagctggttgggtagagcatttcctgcatccccggaccgcctttcgggccttcatagcgaattactaccacatctccggcgacaactttaccgccgagaatcgcttctaccgcatcgtcctggctttcgtacactttcgccgggccggtgaatttgaggatgctgtcatcgacgcctgccgttttcacgatgcagccgttttccgcaaagttaccgtagagcaccgccaagccgccgtctttgctgtaggcgtgttccagcgagcggatacagccattggcgcgatcgtcgtccagcgtatcccaacg

SEQ ID NO: 273 - DNA, 4918 bp, Neisseria meningitidis
gggggatgaaaaccagctcccgtccgtcggaataggggcggtgctgtccgttttgtcacaaaaaaccgttttggacggagaaacgcaccaaaggctggccggcttccttccggaacacagtttcagcgtcacgcaaatccacccgtgttggcgcaaaacaccgcccatctgtcgttcagccaccgcttcggcgacaacagcggcatcggctgccttgcccgtgccgccgtatcgggcgatgaaggggcgtgggcattgtttgaccggtttccggacgaactggaacattcggaatgcagtccgaacgctcgagtcgaaaggttgtaccgggcacacaaagcctattggcaggcggtaaaagacggcaatatcgaagccgcatacgcgggcatttcggatatcgtggttctggcagcttggcggcaggatgcggaagacttcaacgaagcctattgccgccatgtacgccgcaaaatgaacataccggaacatttggcatattttgccggagagccgattatgatcaggcagaacgactacgcgcttgaactgttcaacggcgacatcggactgattatggaagatgtcggacggcagggcagccttgccgcctattttgccgatgcggacggatttaaaaaggtagcggtaagctgcctgcccgaatttgaacccgcattcgccatgaccgtccacaaaagccaaggttcggaataccgggaagtatggctgctgccgccttccgccgcaccttcggacgaaggggacgatgcattgtccggattgagtaaggagctgttatataccgccattacccgcgcgagagagaagttcgtattcttcggcggggaagaagccttccggcaagctgccgccaccgtcaaaacgcgtcagacggcattgggcagtatgctcgagcgggtattttcacaagaataatccgcccgaatgccgcgccgccgccccttatgcctttttcaaacggtataggaaagtggtttcccgggttcgcgcaaaagcaagcggatcgctcggattcgcggcttttttgtgcttcggcttggttttcatcatatcggcaacacgcaaacccgcctgagcaaatgccttatccagaaaatcggatggacgcaggtgcagatgttcggcaagatcggaaatgatcaggcggatttctccgtcgggattcagatgtttcggcgcatcccgcaaaaacgcagccagcatcgcagattcggggtcgtataacgcggattcgacggcggaagtcggcttggcgggaagccagggcggattgcagacaatcagatcggcaaacccttcgggaaacagatcggtttcccgtatctcaacctgtttttcaaagcccaaacgggcaatattggcacgggcgcaggcgacggctttcggattggtatccgtgccgatgacggaaggaatgccctgtttcgccaaaatggcggcaagcacgccggagcctgtcccgatatcgaatgccgtctgaaaacccgttgacggcgcatgggcgagcaggtcgaggtattcgccgcgcaacggcgagaatacgccgaaaggaacgtgtatgctgccgcccagctgcggaacggcaacccctttcttatgccactcgtgcgcacccataaaccccagcagcagattgagcggcaggaaaaacggtttgccgtccgcctctccgtacacgtcgagcaaagcggagcgtatatcgggcgcgcgtttgttgtccaacacaaaaccggggcggatttcaacggcaagcatattcagaatacggctctgctgcgcctgcttcatacggtgggcatggaaaagggcggcgatatccgcatcggaacggacggcggcaggtttgcgaaccctcttcttcattgcagaaagcacctgtttggcattgtggaaatcgccctgctagacagttgcaatattttgataggcagccttcaaaatgccgtctgcaccgctttcgcggacataatgccaacctttgggcggcttttgcagactttcgttgcgccattcgaacccgtcatcgggaaaaataaaagaagacatgggatacctgcgtcatgttttgaaaatagggcggcagaaccgcaaaccatacggatggtacagcaaggagcggcaacacagaacagttttttgttcccgccttgtctttccaagcccatgccgtctgaagccggaatgtttcagacggcatcgcatcaaactccataaataaaccacatatgcttgaaataataccttcaaccccaatgtacgcgaaaatcggcaatctgtcagacacaagagagtacctatgacacaaaaagaaaagcattttgaggaatatgccgccttggcaacccttcctttgcgggatgtcgtcgtttacccgcatatggttctgccgctgtttgtcggcagaccgaaatccatcgccgcactggaaaacgccattacccgcgaggagccggttttcctgttggcgcaaaccgatgcggcggtagaagaaccgattgccgccgacctgtatcagaccggtacggtcgcacaagtcctgcaagtgttgaaactacccgacggcacggtaaaagtattggtcgaagggctgtatcgcggacgtgttctgaccattgaagacacgggcggtctgttcgtttcccatatagagacggtcgtggaagaagacacgggcggcaataccgacctcgaagccgtgcgccgcaccctgttggcgcagtttgaacaatacgccaaactcaataaaaaaatccccgccgaaattatcggcagcatcaacggcattgccgaaaacagccggctaaccgatacggtcgcagcgcatttgcagttgaaactggcgcaacgccaacagattttggaaattcccgaaatcggcaaacggatggaattcctgctggcacagctggaatccgaactcgacattatgcaggccgaaaaacgcatacgcggacgcgtcaaacgccaaatggaaaaatcccagcgcgaatattatctgaacgaacagattaaagcgatacacaaagaactgggcgaagaagacgaaaacggcgaactggatgccttggaagcagatatcaaaaaggcgggtatgaccaaagaagcggaagaaaaatgcctgtccgaactgaaaaagctcaaaatgatgccaccgatgtctgcggaatccaccgtcgtacgcaactacatcgacactttgctcgagctgccgtggaagaaaaaatcccgcgtcagcaaagacatcgccaaagccggactggtgctggatgccgaccactacggcctggaaaaagtcaaagaacggattttggaatacctcgccgtccaaaaacgtatggacaaactcaaaggcccgattctgtgcctggtcggccctccgggcgtgggcaaaacctctttgggcgaatccatcgccaaagcaacggggcggaaatatgtccgcatggctttgggcggcgtgcgcgacgaaagcgaaatcaggggacaccgccgcacctatatcggctctatgcccggtaagattttgcagaatatggcaaaagccggcgtgaaaaaccccttgttcctgctcgacgaaatcgacaaattgggtaacgacttccgaggcgatcccgccagcgcgttgctcgaagtgctcgatcccgaacaaaacaacaagtttgccgatcattatgcggaagtggattacgatttgagtgatgtgatgtttatcgccacatccaatagtctgaatattccgactccgttgctcgaccgtatggaaatcatccgtctgtccggctataccgaagacgaaaaaatcaatatcgcgatgcagtacctcgtaccgaagcaaatgaagcgcaacggtgtaaaagaaggggaattggcaatcgaagaaagcgcggtgcgcgatattatccgttattacacccgagaggcgggcgtgcgttcgctcgaccgcgaaattgccaaaatctgccgcaaggtggtgatgcagattaccttggacgaagataagaagaggttgtctgaaaccaagaaaaccagcaaagccaaacctaaagcggttaaagtaaatgagaaaaatctgcacgactatttgggtgtgcgccgcttcgattacggcgttgccgaaagcgaaaaccgtatcgggcaggttaccggtttggcgtggacggaagtcggcggcgaattgctgaccgtcgaagccgcagcattgccgggtaagggcgtgattcagtgcaccggccagttgggcgatgtgatgaaggaatccgtgtccgcagcgtggtcggttgtccgctcccgtgcggaatcagtgggtttggctcctgatttttacgagaaaaaagacatccacatccacgttcccgaaggcgcgacgccgaaagacggccctagtgcgggtattgcgatgaccttggcggcggtatctgcctttaccaaaatcccggtacgcgccgatgtggcgatgacgggcgaaattaccctgcgcggcgaagttttgcccatcggcggtttgaaggaaaaactgttggccgccttgcgcggcggcatcaaacacgtcctgattccgaaagacaacgtcaaagacttggaagaaatccctgaaaacgtgaaaaccggcctgaccatccatccggtcaaatggatagacgaggtattggctctgggtttggaaagccagcctgagccttgggcagaaccttctggtgcggaagcggcggcggaatccgcttcaaaaccaaaaccccgcagcagggcaaccaaacattgaaacgcaggaaatgtgttgtaaaaatgcggtttcgtcctgaaagcctgtcaaatagggtgattccgtattttttgcttgacacggcaatttcagaattgctataaagcgaaagttgctcaagcagtacaaacccgg

SEQ ID NO: 274 - DNA, 766 bp, Neisseria meningitidis
aaaatcccgtcattcccgcgcagcgggaatctagacattcaatgctaaggcaatttatcgggaatgactgaaactcaaaaaactggattcccactttcgtgggaatgacggaatgtaggttcgtgggaatgacgggatgcaggtttccgtatggatggattcgtcattcccgcgcaggcgggaatctagacattcaatgctaagacaatttatcgggaatgactgaaactcaaaaaactggattcccactttcgtgggaatgacgagtggaagttacccgaaacttaaaacaagcgaaaccgaacgaactagattcccactttcgtgggaatgacgyggwgcaggyttcygtatggatggattcgtcattcccgcgcagcgaaatctagacattcaatgctaaggcaatttatcggaaatgactgaaactcaaaaaactggattcccactttcgtgggaatgacgcgattagagtttcaaaatttattctaaatagctgaaactcaacgcactggattcccgcctgctcggaatgacgagtagaagttacccgaaacttaaaacaagcgaaaccgaacgaactggattcccgctttcatgggaatgacgggatgcaggttcgtaggaattacgtggtgcaggtttccgtacggatggattcgtcattcccgctcaggcgggaatctagacattcaatgctaaggcaatttatcggaaatgactgaaactcaaaaaactggattcccactttcgtaggaatgacggc

SEQ ID NO: 275 - DNA, 546 bp, Neisseria meningitidis
ccaaagaagtgacggagttgatgtgcacaggactatgtaaaacgggcttgccgtttaacccatacaaagaagaaagccaagggcaggaagttcagcaaagcgcgcacaacattcggacagggcgcaagttgccacattgggcggaaaaccgtagcagaacctaatgtacgataattgggaagaacgcgggaaaccgtttgaaggaatcggacgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctggagcgtttttctttattgaatatcatcctagccgtatcaaggctgtatgaatatgttttttaccaatgaatataatcgggctggacatctcaaaggacaccatagacgcaacattgcataaaacaaacggaagtatccattacattaaatttaagaat

SEQ ID NO: 276 - DNA, 642 bp, Neisseria meningitidis
tttacctgctcttttaattgcagcttcatcaattcgatgacaccttgacggtgtgcctgctctgcggcttctgtggtatcaaacaggcgcagggcgatgcggccgtctttttctttttgtaggccgagatagccggtgagctgttgtttgccgcgtgcgaatttgatggattcgggcagggtgccgatgtcccatgcggtgacgttgtcgcgctcaaattcttgggtgttgtcacggaaggtaacggcggcagcttgaccgagttgttgttgcaattcgtgcagtttgcggccgccggcaagctcttgtccgccgtcgtcgataatgcggaggttgaaatagcagtgttcgggcagcctgaacgcggcccattcgtcttggttgatttgctcgaatatgcggatgtcgcctgcggttttggcgatggcttgggcgagttggggcaggatgggggcgttgcggtcgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcg

SEQ ID NO: 277 - DNA, 9133 bp, Neisseria meningitidis
cattaaaaataagtttttccttaatttttcttagtgcttgtttttatctgcttatttgttgcaatgccgtctgaagcaatgtgcgtttcagacggcatttggaatttcagttgggcagggtatcggacggtacggtttccggctcttcttcatccgtaggcggcatttctatcaaatcgggcaaaaccagttcgcccagttcggtcagcggcggcagttcttccaagctgttcaaacccaaatcgctgaggaacgttgccgttgtcgcccacaatgcgggttttcccaatgtgtcccgatgtccgatgacttcaatccacccccgatcctgcaagtctgcatcacgttctgcgacaccgccacgccgcgtatgccctcgatgtcgccgcgcgttacgggctgctggtaggcgataatcgccagtgtttccatcacggcgcgggagtagcgcggcgcacgctgttcttgcaggctgcccagccgctcgaatgccgtctgaacaatctgaaaacgccagccctcttgcgtatgcaccagttgcaacgccctatcctgccaacgcgttttcaactgcgccaacacatcaatcagtttgtcttgcgacaacggcggcacacacagttcgcgcatagatttttcggtcagcggttcggtttgggtcagcagtgcggcttcaatcagcgcgtcgggagaaattttgtcggtcatacgggtatccgtgctgaaacggcatgggtttggatatgccgtctgaaatcggttggagtagagagaagctgcctgaaaaatatttttcagacggcattctttatgcttccgaagcttctgccctttacgctctgcttttctggcttcgcgtatggctttgagttcggcttctttctgacgggcttttttgagccaagtttcccattggttcggcgtttcgagggtgattctgccgattttgccttcacggaagtcggtgaggatgttttcggcggctttttggtagttgatccgtccgccgctgaggactgcgccgcgttttttggctatccattcgagccaaacgttttcgtcccagtggctgctggggtctttgtcggcttggtagcgttcttgcaacatagggaggtagtggcggcggaggtagtctaaaagttcgagggcgacttcttcttcgtccaacgcgttgcgtccgactgcgccgccggcggcaaggttgtagccgccttcttcgacgatgattttcggccatagcattccgggggtgtcgtagagccagaagtcatcggcgaggaagaggcgttgttcggctttggtgatgccgggttcgttgccggttttggcggattttttgcctatcatgccgttgatgagggtggacttgccaacgttggggatgccgcagatgaggacgcgcaggggtttatctatgccttggcggtggggaatcatggcacgacaggcttgggtaattttgccgtgtgcgcctgtttcggaggaatcgagggcgatggcgcaggtgtcggggcggctgttatagtgttcgagccagattttggtgcgctcggggtcggcaagatcttgtttgttgaggattttaagtttgggtttacctttggaaagctgggcaagcagggggttttcgctggaggcgggcatacgcgcgtccagcatttcaatcaccatatcaacgctttttgcacgctcggcgatggcttttttcgccttgttcatatggccgggaaaccattggattgccatgtctgttctttcttttcaatatttgaaatgccgtctgaaacggaggacggggtttcagacggcataatggtttgacggaattagcggtctgacaggttttgcgcctgtctgtgccgtatcagcaattcataacgccctttcaaccttcgggcgagtttttcgacaatatagaccgaacggtgctgtcctcccgtgcaaccgatggcgacggtaacgtagctcctgctttcatcctccaaacgcggtaaccaatgcgtaacaaacctttcgatgtcgtcaaccatttcctgcacaagcggctgtccgtccaaataatcccaaacgggcttgtccataccggtgtaaggcctcaactcgggatcgtaatacgggttgggcaggctgcgcatatcgaacataaaatccgcgttgttcggcacaccgtatttgaacccgaaggactccaaaatcaccagcagcccggtacgttcgaccttcagccactgccggactgcatggcggagctgttgggcattcatcttggaagtgtcgatacaataggcgatttctttaagcgggaacagccattcccgttctttctttaagctttccaacaaggtcatatcctgattgctcagaggatgtcctcgcctggtttcggaaaaccggcggaccaacacgctttcttccgcctcgacaaacaaaacttcaaccctgtgccccagtctgcgcagagaggcaatctgttcccgcgcctgtccgatgtcaatgccggaacgcacatcgacgctgaccgccaattcggtttcgtccgcacgttcgatatgatacgacaccagcgcgggcaacatttccaaaggcaaattgtccacgcagaaataacccgaatcttccatttggcgcagtgcgacggacttgcccgaaccggacaggccgctaatcaggacgatcttcattgtgttgttcgttttctttaagttgcgtctgatggcgttccaaaaattcgcgcgtactgtccttaccgcgcaactgcaaaatgtaattgcgtaccgccgcctcaaccaaaacggcgaggttgcgtccgacggcgacgggcagcgtaaccgaacggacgttgacgttgaggatggattcggtttcggtgcggatgctcaaccggtcaagctgcttcatatactcgtcgtccgcctcgactaaattgataatgagttgcaggatttttttggggcggatggaagtttcgccgaaaatatggcggatattgagtatccccaagccgcgcacttccaaaaaatcgcgcagcataggcgaacaacgcccttccagcgtttccgggccgatgcggaacagctcgaccgcatcgtcggcaatcaggctgtggccgcgcgaaatcagttccaatgccaattcgctcttacccaggccggaatgcccggtaatcagcacgccgatttcaaacacatcgagaaatacgccgtgtttgacggacgatgccgccaaggtgcgttgcaggtaaatccgcaacacgtccatcagataggggctttcgagtttggaagtcagcagtggaatatcgtttttatgacaatagtcgcgcagtcccggggaaaccggcaagccgtttgccacaataaccaaagacatagaaatatcgaacaggtcgccaaactgataacccgtttcccccgattcgaggcggttcagatattccgactctgccaaaccgaccacttggatttggttgggatgaatgaaattcaggtgtccgactagggcgaggacgggcttgtccgcctctacgccgatacggttgtccgcacccgaattgccggcggcccaagcgagttgcagtttgtattggttgtcatcaaacaggcggcggacggagatactgggcatattattcttcagtcaggatggcacggacttcttccgcagaggaaaccgtcatcagcgattctctgatgcttttttgggaaaacttgccggccagtttggataagacttccaaatgctcgccggttgcgttttccggaaccagcaagataaaaatcagggaaaccggcttgccgtccggtgcgtcaaatccgacgggttcgcgcgtgcggatgaacgcgcccgtcgcctgcttcacgccggcatgacggccgtgcgggatggcaacgccctgccccaaaccggtcgaaccgagtttttcacgggcaaaaagacattcgaaaacatcagcatgggacaatgaggattcgcgttccaaaagcaggcctgcttcctcaaacagcctttttttactgcctacctccatatccaaaacaatatgggacaaaggcaaaatttcgccgataaggctcataagcttctcttttcagacatcgcaaaacagaaagattgtaccgactgccggggcaaatctcaatcccgcatacggtacgggctgacataacacagcgttttaaaaacatattttaacgcttttcggcacagatagaaatgccgtccaaagcagtttacggctcttcagacggcattgccctgccttatttcgcgaaaaacgtatgggcaaaaatggcggtaaaccacacccaaccaattctgttgtttgccaaaaacgtttcaaaacagatttgccggacgcggcttttgatggcggcatattggcggtattgcagcagcaggacgatggggattgccgtccaatatgcccatgccgcaccgataaccgcacccaatactgccatcagcagggtaaagcctccgtgacacagcataacggcggcgatgtcgtaacgcccgaacgtgacggcggaggttttgatgccgattttcaaatcgtcttctttgtccgccattgcataaaccgtgtcatacgccagagtccataacacattggcggcaaagagtatccacgcttgaggcggcacgtttccggcaacggcggcaaacgccatcgggataccgaaggaaaaggcaagcccgagatagagttggggaatcggaaaaaaacgtttggtaaacgggtaagtcagcgcaagaaacagcgcgggcaggctcatcagccaagtcagatgattcagcggaatcaggcacaatgcggcaagcaggcacaaaaatgccgtcagcagcagcgcttcttttttcttgaccctgccctgtgcgaacggacggttttttgtacgctcgacagcaccgtcaaaatcgcggtcggcaaagtcgttgatgacgcagccggcactgcgcattaaaaacgtgccgattgtaaacgccgccaataccgccaaatcgggaatgccgtctgaagccagccacaatgcccagtaggtcggccacagtaaaagcagcgtcccaatgggcttgtccgcccgcatcaggcgcaggtacacatccaaacggtcggacaggcgtaaaaataaaggggatttaggattcatattgccgcgcagcttgaaaaaacggtattttatccgataaaacgtttcagttcgggcagaaaatactcggtcagcagcatttcctcgccgtgacgggaaaaccgagaacgccgcgcggcaaagtaccgtccgcatccttcgccggcaacggcaaactcaaacgccgaacgcgccccttccaaatcggcttgaaacagacgctcgcccaaaggacgcgtgccgcagtccaaaatgttttgccaaaacgccgaaccgatacggcattcgctccttgcctcaacaacagggatacggtccagcttcaacaaaacttcgcgcaccagcctccctccgcattccgtctccaattcgcccagtttcagcagttccaccgaaaatgtatgcggcaaggcgcgcaatgcggcggtcagcgaccgggtgtgcagcagccgcaccatcggcaggctgatgccgtctgaaatggcggcgggcaagtcgggcagccatttcccaaataggtgttccatatttttcccaatctttataccgcgtctgtttttgccaactccatccattccgcttcggaaaaatcggctttcagacggcatttcaagtagctcaggctgtcttgggcgatgtgtgcgtcgcggctgtcgtggatgtggttgaacacgaggctgtgcaagcgaatgccgtattgtttgagcgcggcgaaactgagtaaagtgtggttgatactgccgagccgtccgctggtaacgaggatgacgggatagccttgctgacggatataatcaatggttaacaggttttccgtcagcggaaccatcaatccgcccgcgccttcgaccaaaacgacttcgtactgcgccgccaattcttgtgtggcggtgcggattttgtccaagtccaaagccctgccatccagtcgggcggcgaggtgaggcgaagcgggatagctgaagatttcgggcatagtcagccgccgtttgtcggcttcctgcatcggtatgcccataattttgcggtggacggcgatgtcgtcggcaatgttttggcaaccggtttgcacgggcttttgcgtaatcacgcttttgccctgctgcaacaattgttttgccaacacgccggtggcgacggttttgccgatgtccgtgtctatgccgctgacgaagtaaacgcctttcatttgctgtgttccttcaagatttgcacggttttgtcggcaagtttggtcaaaacgccgtctgaaatgatatagggcggcatcagatacaccagcctgccgaacgggcgcacccaaatgccctgcgccacgcagtccgcttgaaaacgcgccatatccacgcctttttccagctcgatcaccccgatggcacctaaaacgcgcacgtctttcacgccgcgaatgtcccacgcggctttcagacggccttttaagatgctttcaatgcggcggatatttgcctgccagtcttgagacaaaagcagtttgaccgaagcgcaggcaacggcacacgccagcgggtttgccataaacgtcgggccgtgcataaacacgcccgcttcgccgcgcgaaatcgtttcggtaactttttgcgaagtgattgctgccgccagcgtcatatagccgccgctcaaacccttgccaatacacataatatccggcacgacctccgcgtgttcgcaggcaaacatcttgcccgtgcgcccgaatccagtggcgatttcgtcaaaaatcagcatgatatcaaattcgtcgcacaaatcgtgcaatccgcgaagatactgcggatgataaaaatacatgccgcccgcgccctgcacgaccggctctaaaataaaggcggcaatatccgcatgatgcacttcaaataaggcgcggacaggctgcaaatccgccccgtcccattcatcgtcgaaacggcttttcggattatcgacaaaataacgctgcggcaacgcgctgccgaaaatatggtgcatccccgtttccggatcgcagacggacatcgcgttccaagtatcgccgtgatacccgcggcgcaccgtcgcgatattctgcttcgccgtcaaaccccgcgcctgctggtattgcactgccatcttcagcgcaacttccaccgaaatcgaacccgaatccgcataaaaaatacggttcagcccctgcggcaaaatcccgaccaacaacttgcccagctccaccgctggctcgtgcgtcaaaccaccgaacatcacgtgcgccatttgtttcatctgcgtctcaaccgcctgattcaaaacaggatgattgtagccgtgtatcgcacaccaccaggaggacatcccgtcaatcagccgcgtgccgtccgccaattcgataaacaccccttctgcacgtttgacaggataaacgggcagcggatcggtcatggaagtatagggatgaagcagatgggtacggtcgaaatcaagcaatgatgatatgtgttgatgttcagacggcataagtttctctcttttcttcttactgtattcaaacgcaaaacgcgtattctactccgacagaccgtttcccacacctctccatccgtttcgggcgcaaaaccgcgaaacaaatcgtccgcagtataagcgcacaccgtttcgcattccccaagcccgattggaatcagacggcccaacgcccaataccgtttcacgcagcctccgcccaacgcttcaatcagtcatagatatagtggattaacaaaaatcaggacaaggcaacgaagccgcagacagtacaaatagtacggcaaggcgaggtaacgccgtactggtttaaatttaatccactataaaacggcaatccatacgatacagatcatagcaacagccatcgcaacagcgttagcaaaatcaggggactccgacataggcgcatagcacctaccgatgcacggctcctcattcggctctatgaataccatacccatcacaaaatccaccgccaaaaccaggcacggcttcttatacttatgatagatttccaccatcctgtcccatatataccaaacattcataccgtatatcccgcaggcaacaaattccgattgaaggttacagccctattttatagtggattaacaaaaatcaggacaaggcaacgaagccgcagacagtacaaatagtacggaaccgattcacttggtgcttcagcaccttagagaatcgttctctttgagctaaggcgaggtaacgccgtactggtttttgttaatctactatattttcaaaccggaaaaatgccgtctgaaccttcagacggcattccattcatatttattcgtcttttttgtgttcgatggcgtttcgggaacgattgccgccgtaaggctcttcaaccgtatattctccctcgataatatcgtcatcgcgggaaaagccctcttttctgcccgattggttcatgttgaaaaaattttccgcacctcctgcctgcaacactgcccctcccttaaacggcagcagcagcaataccgccaacaccgaggatacgaatcccggactcatcagacacacagccgccaccgtataacggataggccacaacatctgataaacggataccctcccgccgcttctcattgccgcgcccgccaataaaagaccggacagccccgtatgcctgagcatcagcacgccggcggcaaaacctgccgccatcaaaaacaacgtccagccgccgcccagccaatcggcaacccacacaatcgacataatctccaaaaacagcagcaccaaaaaaccgataccgaaaaatctcattgaccgtcatccttatatttaagtaaacagcaaaccgcccgaacaggactccaagcgagctgcctgtaaatgattacaaaaccatgtgcttcaagccgaaacaatgtgaaatctcgcaatatagtggattaacaaaaaccagtacagcgttgcctcgccttagctcaaagagatcaattctctaaggtgctgaagcaccaagtgaatcggtt

SEQ ID NO: 278 - DNA, 4891 bp, Neisseria meningitidis
gatgatgatcttcctatagaaataagcctgccaaactgggttccgggcagctatctgattcgggatttttcccgccacatcacttctatccatgcatcctgtaacggcacgtccatgccgctcgaacaaattgccaaaaaccgctggcatgccgccgccgtacgcggcgagtggcaaatccgctacaccgtatatgcattcgatttgtcggttcgaggttctttcctgacgacagaacgcggtttttttgacggatcgtgcctgtttttgaaagtcgaaggaacggaaacgctgccgcaccgcttggaattgacgggtattccgtccgaatggcgtattgccacaacgctgccggaaacagggaggtttgtctttcaggcggcatcttatgccgaattgattgaccgacctgtcgagatgggcttgattgaatttttagattttgaggcggcaggcattccgcacacaattgccttaagcggcatatatcccgatttcgaccgcaacaggctggtttcggatatcaaaaaaatctgcgaaacagaactggcggtgttttcctcccctgccccgtttcaaaaatatttgttcctgctccacgtcggcgaccatatttacggcggtttggaacacaccgacagcaccgccctgctcgccgaccgccacagccttccgccgtacggtatgaccgatgccgacgatacctacaccacattgctcggacttttctcccacgaatattttcacgcgtggaacgtcaaatccatcaaacctgccgcgttcgtcccttatgacctcgacaaagaaaactataccgaacaactatgggcattcgaaggtattacatcctattacgacgatttgtttttggcacgcagccgcaccatctcgcccgaatcttatttaaacctgctggcacaaggcattacgcgcgtacaacaaacccgcggccgtttgaggcagaccttggcggaatcgagttttaccgcgtggaacaaattttacaaaccggatgaaaacagccccaacgccatcgtcagctactaccagaaaggcgcgcttgccgcattgtgccttgatctgataatacgcaaccgaagcaacggcagacattctctcgatacgttaatggacaaactctatcgggagtggagggacacacactcgggtattccggaaaaacactggcaaatccgctgtcaggaaattaccggcttggatttggaagattttttccaaaaagcgttatacagtaccgaagatttgccgcttgccgaatgcctggcaaccgcaggcgtgggactgaccttcctgccgcttccccgacaacacggcggcggatacgcagaacacatctgccccgtcccgtcggcaggcgattttggcgcacgtttcaaacaaaacaccgaccacatcgtcctgacccatgtcttcaacggcggcagcgcggaatctgcggcactgtgcccgcaagacaaaatcattgctttagacggttatgcctgcaccgactttaccgcacaatgggcccgataccacgtcaatgcaaaaatcaatatccacttcttccgtgccggcatattgcgtcaaaccgtcttgacggttcaggcagcggcagcggatactgccatcctacatatcacagaccggaacctgttggacaactggttgttcggttaaactttcagacggcattgcacacaaaatgccgtctgaaaaacaaccgcaaagtaaaggaaacaaaatggccattctgaaacttgacgaacacctctatatttctccgcaactgaccaaagccgatgcggaacaaatcgcgcaactgggcatcaaaaccgtcatctgcaaccgccccgaccgcgaagaagaatcgcaacccgacttcgcccaaatcaaacagtggctggaacaagcaggcgttactggattccatcaccaacccgttaccgcacgcgacatccaaaaacacgatgtcgaaaccttccgccaactcatcggacaagccgaatatcccgtccttgcctattgccggaccggtacgcgctgctccctcctgtggggcttccgccgggcggcagaaggtatgccggttgacgaaatcatccgccgcgcccaagcggcaggcgtaaatttggaaaacttcagagagcggctggacaacgcccgcgtctgattacaagccgaaacgtttaaaccacaccttcaagcggcattccaccgcaacttgaaaaagaggacggcaaaccttactgccgtcctctgtccttctccgtttttacagtgggagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcagtgggtatagcggattaacaaaaaccagtacggcgttgcctcgccttaactcaaagagaacgattctctaaggtgctgaagcaccaagtgaatcggttccgtactatttgtactgtctacggcttcgttgccttgtcctgatttttgttaatccactataaaaattagaaatgcacattttcattattctcgcgcaggcaggactccagacttacccatttcagtaatgtttgaaaataaaagaaaaatcagatgtttgtattcccgcctgcgcagaaatggagacggtgctctgtcgtctcatttttgttttaatcaactatatatagctgattaaacataagaaatgccgtctgaaagactttcagacggcattcgttcaagcgtcgaactttattgcgccttggtttcggttacaaaaccgattttggtgattcctgcctgacgggcggcttctaaagctttgtttacataatcgtattccaccgccttgtctgccgcaatcgccacaatcacgttttcattctgctccttggcggctttcagacggctttccacttccccgatttccactttgcttgcagaatccccgccgacataatagccgccgttcgcatcaatcgtcaggcgcagggggtctttaggctgtttgtcctgcttgtttgtctgctcggacgcggtcggcagttccaaagggatggaatgcgtcagcaccggcatagtaatcataaacacaatcagcaacaccagcatcacgtccaccaacggcgtaacgttgatgtcggacatcggagaatcgtcgccggaattcatcgaaccaaatgccataatcagctatccttttgattaagcaggcggacgtgcaaatcgtgcgccatcgcatccaaatcctgggtcagtatttttgtgccgcgattgaggaagttgtatgccaacaccgccggaatcgccacgaacaaacccgccgccgtcgccaccagtgcctcgccaatcgggccggcaaccgccgcaatactcatctgcccgctttgcccgatattgatcagggcgtggtaaatcccccaaaccgtgccgaacagcccgataaacggcgcggtcgcgccgatggaggcaagcgcggtcatcccgtaatcaaaccggcgcataatctgcgccatactgttgcggatttgaatgaccaaatactcgttcaacggcaaagcctgcgccagttcggacgcttcgtttcggcggtagttgcggtaagactgcaatgcctcttgcgccagtttggacaaaggcgcatcgacggcgcgcactttttcgaccgcgtcgttcagcgacaaagtatcgcgcatatgccgtttgacggcggcattccctttgcgcgcccgatacagcttgatgcagcgcaagacaaccaaacaccacgttacgatactcatcaacagcatcaacacaaacacaccaatcaggacgggatcgcccgattcaaacactaatttcaaattcataatgattccaacactgaaaaaaccaatcaaacatccaagctgccgcaaaccgctgcggcaaccgcctaattcaattcaaacttgacggggactttaaactccgtccaggcattggcttgaaaatgcccgttttgcgccgccttgcgtgccgcattgtccaaccgggaaaaaccactgcttttcacgattttaacggactcaacatgaccgcccggagaaaccaaaacgctcaaaacaaccgtaccctgctcgtcattctccatagaaagcgtgggataagccgggcgcggaatgctgccgttggcgcgtaaaggattgcctttgctgctgccggctccttccccgtgttcgcctttgacaccgccgctacctttaccgctgccttctccgcgccccgttccgtctcctttggtaccagttcccttatcttccccattgccctgctcgctgtctgctttggcagaagcattgccgggatgttcggcaggtttttcagacggcttctcgaccggtttttccgccggtttcgggacaggcttcgcttccggcttaggctctggtttcggtttttcttcgggtttcggcttttcttcaggtttcggctcttccttaggctgctgaatatccgcatccgcctttttcgtaaccaccggcttcaaaaccggcttgggcggctcgacaggtttgggcggctcgggcacgggttgcggttcgggcgcagcaggcgcgcctgcaccttcgggggcgccgtcccctccgccaaaatcgcccaaatcgacaaattcaataacattgcctgactctatcacgggcagcttgtgcgcctgccagagcaatgccaccattgccaaatgcagcagtgcgacggaaaacacgactgcgggggttaaaattcgttctttatccataattcgggcataataatagcaggg

SEQ ID NO: 279 - DNA, 5556 bp, Neisseria meningitidis
acgaccaaggtacgcgcaatctggtggcggcaagtatcgccatcgatatggtcaaagtcctgtcccgcgaaggcgtgaaagatttccacttctatacgcttaaccgcagcgagctgacttacgccatttgccatattttaggcgtgcgcccttaaagccgtatcaaacagtttcagacggcatctaaggtgtctaaaaagcaaaacaccgccccatccgagccattctgatttacaataccggccgattcggattgaaccggtccttacaaaatccaactggagagttcaacatgacaacattacatttctcaggcttcccgcgtgtcggcgccttccgcgaattgaaattcgcacaagaaaaatactggcgcaaagaaatcagcgagcaagaattgctggctgttgctaaagacttgcgcgagaaaaactggaaacaccaggtcgctgccaacgccgatttcgttgccgtaggcgatttcactttctacgaccacatcctcgacctgcaagtcgccaccggcgcgattcccgcccgcttcggcttcgacagccaaaacctgtctttggaacaattcttccaactggcgcgcggtaacaaagaccaattcgctatcgaaatgaccaaatggttcgacaccaactaccactacttggtgcctgaattccacgccgataccgaattcaaagccaatgccaaacactatgttcaacaactgcaagaagcccaagccctcggtctgaaagccaaaccgaccgttgtaggtccgttgactttcctgtgggtgggtaaagaaaaaggcgccgtcgaattcgaccgtctgagcctgttgcctaaactgttgcctgtttacgttgaaatcctgactgctttggttgaagccggtgccgagtggattcaaatcgacgagcctgctttggctgtcgatttgcctaaagaatgggtggaagcctacaaagacgtttacgctactttgagcaaagtaagtgccaaaatcctgttgagcacttacttcggttctgttgccgaacacgccgcattgttgaaagccctgcctgttgacggtctgcacatcgacttggtacgcgcccccgagcaactggacgcgttcgccgactacgacaaagtcctgtctgccggcgtgattgacggccgcaacatttggcgcgccaacctgaacaaagttttggaaactgtcgagcctctgcaagccaaactgggtgaccgtttgtggatttccagctcttgctcgctgctgcacactccatttgacttgtcagttgaagaaaaactgaaagccaacaaacccgacctgtactcttggttggcattcaccctgcaaaaaacccaagaattgcgcgttctgaaagctgcattgaacgaaggccgtgattctgttgccgaagaactcgccgccagccaagctgctgccgactcccgtgccaacagcagcgaaatccatcgtgcagacgttgccaaacgcctggccgatttgcctgccaacgcagaccaacgcaaatctccatttgccgaccgtatcaaagcgcaacaagcatggttgaacctacctctgctaccgactaccaacatcggttctttcccgcaaaccaccgaaatccgccaggcacgctcagccttcaaaaaaggcgaactgtctgccgccgattacgaagccgcgatgaaaaaagaaatcgccttggtggttgaagagcaagaaaaactggacttggacgtactggtacacggcgaagccgagcgtaacgacatggttgaatacttcggcgaattgttgagcggttttgcattcactcaatacggctgggtacaaagctacggctcacgctgcgtgaaaccaccgattatctttggcgacgtaagccgtcctgaagccatgaccgtggcttggtctacttacgcacaaagcctgaccaaacgcccgatgaaaggtatgttgaccggccctgtaaccattctgcaatggtctttcgtccgcaacgacattcctcgctctaccgtgtgcaaacaaatcgcactggctctgaacgacgaagtattggatctggaaaaagccggcatcaaagtcatccaaattgacgaacctgccatccgcgaaggcttgccgctgaaacgcgccgattgggatgcctacctgaactgggcgggcgaatccttccgcctgtcctctgccggttgcgaagacagcacccaaatccacactcatatgtgttactccgagttcaacgatatcctgcctgcgattgctgcaatggatgcggacgtgatcaccatcgagacttcacgttccgacatggaactcttgaccgcgttcggcgaattccaatacccgaacgacatcggcccgggggtttacgacatccacagcccgcgcgtaccgacagaagccgaagtggagcacctgttgcgcaaagccatcgaggttgtaccggttgaacgtctgtgggttaacccggactgcggcctgaaaacacgcggctggaaagaaactctggaacaactccaagtaatgatgaacgtaacccgaaaactgcgtgccgaattggcgaaataagccgagaccgtatgaataaataccgtctgaaagcctttcagacggtattttgtcctgatttgcggcgcaagggcgcagttgccggaaaatcttttcattgcagcttgtttttttctaattcggctttatatgtgggaaacaggcaaatcggagttgtgtttgatagttttaaataatttatattatttgaactataaattatacaaatcattttgcatggggtagaatgcccagcgattcacaattatttctcaaaccaatctattaaggagcttaaaatggctttgcaagatcgtaccggtcaaaaagtaccttccgtagtattccgcacccgcgtcggcgacacttggaaagatgtgtctaccgatgatttgttcaaaggcaaaaaagtagtcgtattctccctgcccggtgcatttaccccgacttgttcttcttcacacctgccgcgttacaacgaattgttcggcgcgttcaaagaaaacggcgttgacgcaatctactgcgtatctgtaaacgatacgttcgtaatgaacgcttgggctgccgaagaagaatccgacaacatctacatgattcctgacggcaacggcgaatttaccgaaggtatgggtatgctggtcggtaaagaagacttgggcttcggtaaacgctcttggcgttactccatgctggttaacgacggcgtggttgaaaaaatgttcatcgaacctgaagaaccgggcgatccgttcaaagtatccgatgcagatactatgctgcaattcgttgctcccgattggaaggctcaagagtctgtggcaattttcactaaaccaggttgccaattctgcgctaaagccaaacaagctttgcaagacaaaggtttgtcttacgaagaaatcgtattgggcaaagatgcaaccgtcacttccgttcgcgccattaccggcaagatgactgcccctcaagtcttcatcggcggtaaatacatcggcggcagcgaagatttggaagcttacttggctaaaaactgatagctgtttgcttaaggcggtttaattaaactgtctgatataccggatagagttattcgggcggttctacactaccgctccgaataactctatatttataagagaatttggatattgttgcactcaatcgaaattttgtttttatttatctgaatgatgtttttgattgggaaaatatttaaatgccgtctgaaaccgatatgttctgtgtcggcaatgtttcagacgaaaacggaaggacaaagattatgaaaaaaattcaagcggatgtcgtcgtaatcggcggcggtactgccggtatgggtgcgtttcgcaatgcccgtttacattcggataatgtttacctgattgaaaacaatgtgttcggcacgacctgcgcgcgcgtgggctgtatgccttccaaactcttgattgccgccgcagaggcgcgtcatcacgcattgcataccgacccgttcggcgtgcatttggacaaagacagcatcgtcgtcaacggtgaagaggtcatgcagcgcgttaaatccgagcgtgaccgttttgtcggctttgtcgttgccgatgtggaagagtggcctgccgacaagcgcattatgggttcggctaaatttatcgacgagcataccgtccaaatcgacgagcatactcaaattacggcaaaaagtttcgtgattgctaccggttcgcgtcccgtcatcctgccgcaatggcagtctttgggcaatcgtttgattatcaacgatgacgttttctcatgggatacgctgcctaagcgcgttgccgtgttcgggccgggtgttatcggtttggaactgggtcaggcattgcaccgtttgggcgtgaaagttgaaattttcggtttgggcggaatcatcggcggcatttccgaccccgtcgtttcagacgaggcgaacgccgtgttcggcgaagaattgaaactgcatctggatgctaaaaccgaggtcaaactcgatgcagacggcaatgtagaagtccattgggagcaggatggcgaaaaaggcgtatttgttgccgaatatatgctggcagccgtgggccgccgtccgaacgttgacaatatcggtttggaaaatatcaatatcgaaaaagatgcgcgcggcgtacctgttgccgacccgctgaccatgcagaccagtattccgcatatcttcatcgcaggcgatgcgtccaaccaactgcctctgctgcatgaagctgccgaccaaggcaagattgccggcgataacgcgggccgctacccgaatatcggcggcggtttgcggcgcagcaccatcggcgtggtgtttaccagtccgcaaatcggctttgtcggtctgaaatacgcgcaggttgccgcgcaataccaagccgacgaatttgtcatcggcgaagtatcgttcaaaaaccaaggccgcagccgcgtgatgctggtgaacaaaggccatatgcgcctgtatgccgaaaaagccaccggccgctttatcggcgcggaaatcgtaggccctgccgccgaacatttggcgcacctgttggcttgggcacatcaaatgaagatgaccgttccgcaaatgctggatatgccgttctaccatcccgttatcgaggaaggtctgcgtaccgcgttgcgcgatgccgatgcgaaattgaaagcctgaccgatatggcaaaacaatgccgtctgaaattttttcagacggcattttgtttttggggatggggtcggatgctgataccgtgtcgggaagggggcggcaaaactaaaaatctttctatttaatctgctgtttccacgcgtgtttgtcaaaatctatcagtttgtttttaaaatacactgttcaaaatgggataaaacaggtaaattaacgtttatgtaacccagtgtagcaatgggtttacggtttttgagtcgatatataactacagaggaattgactatgtctgccaaaccgcgtcctgtttatctggatttgccgg

SEQ ID NO: 280 - DNA, 12893 bp, Neisseria meningitidis
gcatacacgccttaaccttaatttgcaaaatgaccgtgcctaaacaatgccgtctgaaagtggagattggttttcagacggcatcgcccgagagatgtcggaaatggactttatccccattccttttcggttgaaacccgtctgtttatggcgatagaatctaatcggagggtagtctcgttcgggcaacacgcagtgcggtgcttgatgtgccgtcccctgttgaaacatataaagctcggagaaagtatagtggattaaatttaaaccagtacggcgttgcctcgccttgccgtactatttgtactgtctgcggcttcgtcgccttgtcctgatttaaatttaatccactatatataagggcatcattcctgcaccggcaagaatccgaacccgaacgtttgaaaacaatcccgaatctccgaattcccgcctgtgtgggaatgacgaaaaaacaagcattcatttgccccgaagcagttaatcaaccctttccgccacacacctattccaatatccaatgaaaaccatcacagaaaccctaaatctcgccccgaaaggcaaaaacttcctgaccgccgattggcccgcgcccgccaatgtgaaaaccctgattaccacgcgcaacggcggcgtgagcagaggtgcgtatcagagtttgaacctcggtacgcacgtcggcgacaatcccgaagccgtgcgccgcaaccgcgaaatcgtgcaacagcaggtcggactgcccgttgcctacctcaatcaaatccacagcaccgtcgtcgtcaatgctgccgaagcgttgggaggcacacccgatgcggacgcttccgtagacgacacgggcaaggttgcctgtgccgtgatgaccgcagactgcctgcccgttctattttgcgacagggcgggtacggcggttgccgccgcacacgcgggctggcgcggtttggcgggcggcgtactgcaaaacaccatagccgcaatgaaggttccgcccgtcgaaatgatggcgtatctcggccccgccatcagtgcggatgcgtttgaagtcggacaggatgtgtttgatgcgttctgcacgcccatgcccgaagccgccaccgcatttgaaggcataggcagcggcaaattccttgccgacctttacgcgctcgcccgcctgattctgaagcgcgaaggcgtgggcggcgtatatggcggcacgcattgtacggttttggaacgggatactttcttttcctaccgccgcgacggagcgacagggcgtatggcgagcctgatttggctggacggcaatgccgtctgaacacgccgctgatataatctaccgactttgtgtttttgagaaaggcaagccatgaacaaactgtttcttactgccgcagtgctgatgctgggcgcgtgcggtttccacctgaaaggtgcagacggcatttctccgccgctgacctaccggagctggcacatcgaaggcggacaggcattgcggtttcctttggaaaccgcgctgtatcaggcttcgggcagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggtaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatgacgtggcggcacatatcggacgcattgatacggacgcgcctttgaaacccctgtacgtcatccacggcgaggaagaactgttgcgtatcgaggcattggacgcattgagggcggcggcgaagaaacaaggttaccttaatcgggaagtttatacggcagacaatgccttcgattggaacgagctgctgcaaaccgcaggcagtgcgggtctgtttgccgatttgaagctgttggaactgcatatccctaacggcaagcccggcaaaaccggcggcgaggcgttgcaggattttgccgcccgattgccggaagatacggtaacgctggttttgctgcccaaactggagaaaacccagctccagtccaaatggtttgccgcattggcggcaaagggggaagtgtgggaagccaaaccggtcggcgcggcggctttgccccaatggatacgcggacggctggacaaaatcggtttgggtatcgaggcagacgcattggcactgtttgctgagcgcgtggaaggcaatctgttggcggcgcgtcaggaaatcgacaagctcgggctgctgtatccgaaagggcataccgtcaatatcgatgaggcgcaaaccgccgttgccaacgtcgcccgcttcgacgcgttccaactggcaggcgcgtggatgaagggcgatgtcctgcgcgtatgcaggcttttggacggattgcgggaagagggcgaagaaccggtgctgttgctgtgggcggttgccgaagacgtgcggacgctgatccggcttgctgccgccctgaagcaggggcagagcatccaatccgtccgcaacagcctcaggctttggggcgacaagcagacgctcgcaccgcttgcggtcaagcggatttccgtcgtccgcctgcttgacgcgctcaaaacctgcgcccaaatcgaccgaatcatcaaaggtgcggaagacggcgacgcatggacggtattcaaacggcttgtcgtgtcgctggcggaataaagcggtaatccccaaaatccgaaaatactgtaaaataccgttaatcctgaaaagtattcaccaatccgtccgaaaacatttcagacggcacgaccacctcaataaaggaacattaaccctatggacaataagaccaaactgcgcttgggcggcctgattttactgaccaccgccgttttaagcctcattatcgtattgattgtcgattcctggccgcttgccatcctgcttgcagccgtcattgtcgctgccgctgcgggcggttttgtttggacatcccgccgacagcaacgccagtttatcgaacgcctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaaccgccgcaaggcatctttgcataaatgccgtctgaagcctgttggcgtttcagacggcatattctgattgaaaagatgatgacactgaaaaccgccccgctcaaacgccgctttgccgccatgctgtacgaaatgctgctggtcggtgcggcaacctgtttggcagcattgattgccggtattgccgccatttttctgaatcccgtttctatcgcggtttctgcattggtaacaagtatcctgataatgggagcatggtggctttatttccgcgccaactggcatggtcaggggcagaccttggcgatgaggacatggaaaatcggcttgtgcgaccttaacggcatacagccgtctttgcacctgctgcgcctgcgctttatttgggcgtgcatatttatcgtatttatccctatgttagcctatgccggattacgccacttcctcggcattccgcccaagggcgcggccggcgcggcattgatttggctgattttaccgtgggggttcgcactgctgaatcccgatcggcagtttctgtatgattttcttgcaggaacaagattggtggcggtcaaaggaaagccttaagcctttataccgcaaaggtttcaacctgaaaaaatgccgtctgaaagggctttcagacggaatttgcttatcggggaaaccgattattcgatattctgcacttgttcccgcatctgctcgattaagactttcagttcgaccgaggcttgggtgcattcggcggcaatggatttgctgcccaaagtgttggcttcgcggtttaattcctgcatcaggaagtccagccgtttgccgctgctgcctttgtgttcggtaacgatacggcgcacttcggcaatgtgggtgcgtagcggctgaactcttcgtcgatgtcggatttttggataaagagggcaaattcctgttgcaggcggtcgttgtcgatgctgccgaccgcttcgacgaggcgggcgcggattttttctttatgtgtttccaacagggtaggaaagagttcgcttaatgcatctatgatttcttccatagcctcaaggcgttgcagcaggtgctcgcctaatttcttaccttcccgcttgcgtgcggcagtaaagtcttttaacgctttttcggtcagttcggtaatgctttttgccaattcttccgtattttccctttggcttgccaatacgccggggaaacgcaggatgtcggcaacgcccagttttgccaaatcgtgatgcttgcggaggtctttgttgatttcggcaagctgtccgaccaagtcgcgattcagttccaaggactgactgccgttttccgcatcttgaatttggattttgcattcgactttgccgcgtgcgatatgggatgaaattttctcgcggataccgctttccaaatagcgcaaatcgtcgggcatcctgatttgaatatctagaaaacggtggttgaccgcacgcaggtcgagattgatgcgtttgctgccgcactctgccgccgcgttggcaaatccggtcatgctgtggatgtggatatttccgctgctcatgtcgttctccgaagcccgttaaaatggaatcaatatatcacatctgtatggcggcaagcgttttcgggtgtgaaaaattgaagattttgcagcggcagattggaatcacgcgcttttgttgctgcaaggaagggaaatgtatagtggattaaccaaaaccagtacggcgttgcctcgccttagctcaaagagaacgattctctaaggtgctgaagcaccaagtgaatcggttccgtacgatttgtactgtctgcggcttcgccgccttgtcctgatttttgttaatccactatatcaattccgccaatctgtcggaaaagcagctgatgcggcagtgtctggtgcatgtctgctttttgatttcggcaattgcaacggcgtggacggataaaatcgtgtacagcacgacgcacaaaccgcattgatgtttaccaaataaaatacccgacaaaacaatttgtcgggtattttattgcgtatatttcaaaccgcttcggcttcttcggtcaggaaaccacgcagtttctgcatggcttttgcttcgatttggcggatgcgttcggcagatacgccgtattcggcggcaagctggtgcagcgtcagcccgccgtcgtcttgaagccagcggctttccacaatacggcggctcctgtcatccagttgcgccaaagcgttttgtaaaccttctgtttgcagggcgtaatgcgcctgtttcgatagttgtcggctcggttcggaatcgtggtcggcaagccagtcgatgggggcgaaactatcctcgtcgtcgctgttgtctgccatgatggcgatgtcgtgtcccgtcattcgctgttccatttccagaacttcggaaagtttgacacccaaatcgtcggcgatgtcttgtgcctctttgggagacagggcgttgaggtttttacgcatgctgcgcaggttgaaaaacagcttgcgttgcggtttggtggtggcaacgcgaaccaaacgccagtttctcaaaataaactcgtggatttcggctttaatccagtgtacggcaaatgaaaacagacgcgcgcctctaccgggctcgtagcgtttgaccgccttcatcagtccgatattgccttcctgaatcaggtctgcctgattcagcccgtagccgtcatagccgcgcgcgatggaaacgacgacgcgcaggtgggacaggatgagttgtttggcggcgttgaggtcgcctttgtgttggcgttcggcaaggcgtgtttcttcctcttgggtcagcatgggaattctgttgacggtgtggatgtattgttcgaggctgccgttgccgctttggatggcgggtaatgcgaaagcgttattcatttgggacatttcctttcggctgaaactgcgtatcggcggtttgctgtgttgggatgcagtatatcactgcttggcttgtattttgtatatttggcaggagatatgcgctaaggtttgaaagacaggaaaaattttgtaaggcaagtttgattgattttgtaaacctgatggctcaattcgattttggaattatattacatacgtggttgtatgtaaatagccgttttgaaaaaagacagcccgtccggacgggctgtgcaggtatcagtgttctttgtttcggaagatgaaaagaatcagtgcggctagggccaatatgcccatcaaccaccatgaactgccggttttcatatagggcgtttcgccgacatagcctttgatgtgtccttccaatacggtttccgtatcgggttgggcttgggcgatgatgttgcctttgggggagatgatggcggttgcgccggtgttggtggcgcggaccatatagcgtccgagttccatagcccgcgcctgcgattgttggaggtgctggtacatggcgttggattttccgtaccacgccatattgctggcattggcaagcagggtggcatcttttgcggcggcaatcagttcgtcgccgaatccgtcttcgtaacagatgttgaaggcgattttttggtttttcatcagcagggcggattgcttgccgccgcctttgcggaagtcggaaaggggcatatccatcattttgtaaagcggcgtggtcaggaaaggcagcggtttgtattcgccgaaggggacgaggtggtttttggcgtagtaggggataccgtcctgattgttttcctgataaccggtcaggttgatgacggcgttttcgtaaccgttgccgtccgaagtgtattggctgatgccgacggcgagcgcgctgccgttgttttgcgcctgttcggcaaatttcgccagtatgttttccggcaggttttggcgcataacggggatggcggtttcgggcaggatgacgatgtcggcggtggttttgccgacttgttcgtaatatttctgtatggtcgggataacttggtcttcacgccatttgagggtttggtcgatgttgccttgaagcagggcgacggtgctgcggctgccgtcggggcgggtgaagtcggtttgtcgggcggtgtagcctgcggcaagcagggcggcaatcaggataatcggaagcaggcgtttgcccgaacgtgcggtgttattactcgccaaaaccagccagacaccgagaaaggcggttgccagtgtaaccatgtggatgccgcccaatggggcaaagccggcgagcgggctgtccggggtgatttgggagtagccgattgcgccccagccgaatccggtcaggaaacgttcgcgggcaaactcggtcagcgtccacaggatgggcagtaccaaaccgatttttatgccccgaggcagggtaaattttttccacagccagaaacacagtgccggataaagggcaaggtaggcggggagtaggaaggtcagcggtacggcatagaggtcgggcaggccggaaacgtcgtgcagggcggtgtgtatccagtagaactgtgtcgtgtatgcggtcaggccgaacaggtaggcggaagagacagcaaaacgcggacgcagttcgatgaggcggacgaaggcaccgaaaatcaagggcatcagccaaaagtggtagtagggtgcgaaggtaaagggggtggcggcggcaaaaaggatgagcaaaggccagtagagggcggggtgctgccagtatttgtccagtttggaaaccatattcatctgtctgttcggaagataccgtctgaacatctttcaaacggcatcggtatttgaaaaaggaatcaatgcctgccgaaacgattcatcagcggcaaggcgggggcgcaggcaatcgaaccggaaagcagcccgacaacgaggttggcgaagtactccgcccagccagcgtcccagtgttgcgcgtgcaggaaatcgtgcagaaggccgaggttgtgggcgaccagtacgccgccgataagaaacatggcaagcgtgccgaccacgctcaaaccgcgcataaagcaaggcataaaggcagtcagcatttgccccaaactgcgcgaaaaggtttgtgggcggcgcatcagcagcatgcctaagtcgtcgagtttgacgatgacggcaacgattccgtacaccaaaacagtcatgccgatgccgattgccgccattacgagcatgcgcgtcatgtcggtgcagaaacttgtgcagcagcttttctacgccttcaaagcacagataaatgccgcctgccgtcaaaagcggcgtaatgagttgcggcaggaaggcggaaagcagcagggccgcaggcaccaaaaccggcttgttggaaaaagaacctttcgccatcgaccaaacaatcggcaactcgcgttctgccgatacgcccgtaacccggttggcattgggtgccaaatcgtcgccgaccacgccggcggttttctttgcggcggctttggtcatcagggcaacatcgtccaaaacggcggtgatgtcgtccggcagggtaaatagtgaggcaaatgccattaaagaatcctgaaatgcggcgcaaagtccgacattatataggagaacgcggatttgggcggtttcaggcggcatgaaacaggaaaatgccgtctgaacgctgtggcggacgtgaagtaaagtttcgtgaaaagaaaataccgtgttacagtctttcgattttaatttcatgaattttaagggagaatcgttagcgtggattggatgggcagtctgttcctgccgggtggcgcactgttgtttctgagcgtggtttcgaccactttgtccgcacgtttgggaatgcctttgctgctggtttctcctgccaacgtgttggacagggcggcggaagccttggcgattgcggcgttcctgatgctggtcgcgcgtccgtcggcagtgttcggcggtttgtggaaattcaattacagcctgcgtgaaaaggcgtatagccgaatagaaatgcagtccgacaccgtgcttcaggcggggatttggcgtggtacatcctgcccgacggcaaggtcgatatagtgaattaacaaaaatcaggacaaggcggcgagccgcagacagtacaaatagtacggaaccgattcacttggtgcttcagcaccttagagaatcgttctctttgagctaaggcgaggcaacgccgtactggtttaaatttagttcactataaaatggcgaaatactttaccgagacgggtattagcgtccgtgagcattttgatttcttcggtgagtttgtcgtttcgccggcagcacgttcgggtgatttggcacttacttacggtttgaggctggaagcgggcgaagagggtttgagccttgccgagcttttcgataagcgttccgatagtcaggagccggtcgagggcggccgtattgacatcggcggctttatgctgaccgcaaaggaggttgacggtggcggcaatatcgggtctatggggctgaaagtgctgcgttagaaaggtttgatttgaatgccgtctgaagccggattgccggtttcagacggcattttgtctgtttagttttttttgctttttgcctgttttacgtctttttcggtaacgcttccgccgccgttgtcaaaggcgttcatgatataagtggcgacggcggcaatgtccgcatcgctgatggcggttgcgggcatgaatccgttgtaggttttgccgttgactttgattgtaccgttgatgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtagtatagtggattaacaaaaatcaggataaggcgacgaagccgcagacagtacaaatagtacggcaaggcgaggcaacgccgtactggtttaaatttaatccactataaggttgcacttgatgttgttgtccagcatagatgccatcatacgctaaagtagcgggaaaatgccgtctgaacacggcgttcagacggcattttagacatgggtcaaacagtttcaacgccagctgccaaggttttcttcggcaagtgcgacgagtgcatctatccagtcggggttgtcgttgaggcaggggatgtagcggtagcttttgccgcctgcttcataaaactgttcccgccccatcagggcgatttcttccatggtttccaaacagtctgccaaaaagcccgggcaaaatacgtccagctcggttaccccctgtttgggcagtttgccgaacaaatcctgcgtgctcggtgtaacccattttgccctgccgaattggctttggaacgatacgacatattggtcttcggtcagttccagtgcttcggcaagcagtttggcggtgtggcggcactcgtcgggataggggtcgccgaggtcgtggtgcttctgcggtacgccgtgaaaactcaacatcagttttttcccgcgcccgtgttccgcccaatatcggaggatgtggtttttcatcgcatcaatgtagccggtatcgtcataaaagcgcgaaacggtgcggacgctcatttggttccgttgcagcagtaattgttcgcacaccttatctactgccgctccgctgctggaagcggcatattgcgggtacatcgggatgaccagcagtctgcccgcgccttgcgccttcagttccgacaatacgtctgccaccgaaggattgccgtaggtcatggcgtggcggacgatgaggtcgggcatacgtttggcaagcgcggcagcttggcgtgctgtgtaaacttctaagggcgaaccttccttaaaccagattttttcataggcgtgcgcgctttttttggggcggagcgtcagtaccagaccatgcagaatgggataccacagccatttgggcagttcgacgacgcgccggtcggtcagaaaggacttcagataaggtcgtaccgcctgcgcggtcggcgcgtcgggcgtgccgaggttcaacagcaaaacggcggtacggttttgttgcgtataggaaagggagggttctggaaagaatggaagcatgatcggtttctgaaaaatagtgcgggtagggtaaagcggcaaaatgccgtctgaagcggcttcagacggcattgcagggaatcagtctgtgccgcgtgcgcggttttcgtggaatcgcgcctgccagtcggcaaatttgccttgttcgacggcttcgcgcatttccgccataatgacttggtagaaatgcagattgtggatggtgttcaactgtgcgcccaagatttcgccggtgcggtgcagatggtgcaggtaggcgcggctgaagttttggcaggcgtagcaggtgcagctttcgtctatcggacgcttgtcgagcttgtgtttggcgtttttgattttcaaatcgccgaaacgggtaaacagccagccgttgcgtgcattgcgggtgggcatcacgcagtcgaacatatcgatgccgtgtgccacgccgtacacgaggtcttccggcgtgcctacgcccatcaggtaatgcggcttgtgttccggcagaatcggaccgacggcgcgcagcatacggtacatttcgggcttgggttcgccgacggacaaaccgccgacggcaaggccgggaaaatcaaactgttccaaaccgcgcagcgattcttcgcgcaaatcctcatacatcgcgccttgcacgatgccgaacagcgcgttcgggtttttcaaatcttcaaaggcttttttgctccgttccgcccagcgcaggctcatttgcagcgattttcgcgcctgttcgcgcgtcgcctcgcccggcgtgcattcgtccaactgcatcgcgatatccgagttcaaaaccgtttggattttcatggaaatttcaggcgataaaaacagcttgtcgccgttaatcgggcttttgaacgtacagccttcttccgtcagcttgcgcatatccgacaaagaaaaaacctgaaaaccgcccgagtcggtcagaatcggtttgtcccagccgataaaaccgtgcaggccgccgaattgcccgataacttccaaacccggacgcagccacaaatgataagtgttgcccaaaataatttgtgccttgatatcgtgcaggttttgcgggttcatcgccttaaccgaaccgtaagtaccgacaggcataaataccggcgtttcaattttgccgtggttcaactccagcgtgccgcgtcgggcgagaccgtcttttttgtgtaaggtaaatttaagcataagattgaatgtcagttgggcgacaggggtcgaaatatattttaaaagacggcattataaatgatttcccacggtttttcagacgacatcccg

SEQ ID NO: 281 - DNA, 12077 bp, Neisseria meningitidis
gtattctgggacagccgtagacttacttattatcctaatgttattttttgccaaaagaaaaagtagaaaagacatcattaacatctatttaggacaatttctaggctctgttagtctgatattgctaagtttactttttgcatttgtcttagattatattcctagtaaagagattttaggtttgctcggcttgattccaattctcctaggcatcaaagttttgcttttaggagattctgatggagaggctattgccaaagagggtttgcgcaaagataataaaaacctgatttttctagtcgctatgattacttttgcaagttgtggtgctgacaatattggtgtctttgtcccatattttactaccttaaatttagcgaatttgatagtggctttacttacctttctagtcatgatttatctcttggttttttctgcccaaaaattagcacaagtcccttctgttggagaaactttggaaaaatatagcagatggtttgttgctgttgtttatttaggattggggatatatatcctggttgaaaacaacagttttgatatgctatggactgtgttgggctaggaaaaaatattatgaaaaagatagtatctgcaaagactgccatgtgcagtcttttttgttgccggtctttttgtgtctgatgccgtctgaagcagtctctgcacgacctttgtgcgaatatttgctacacttggcaatccgtccattttttctcacgcttatgctgacctataccccgcccgatgcccgcccgcccgccaaaacccacgaaaagccgtggctgctgctgttgatggcgtttgcctggttgtggcccggcgtgttttcccacgatttgtggaatcctgacgaacctgccgtctataccgccgtcgaagcactggcaggcagccccacccccttggttgcccatctgttcggtcaaaccgatttcggcataccgcccgtgtatctttgggttgccgccgcgttcaaacatttgctgtcgccgtgggctgccgactcatacgatgccgcacgctttgcaggcgtattttttgccgttatcggactgacttcctgcggctttgccggtttcaactttttgggcagacaccacgggcgcagcgtcgtcctgattctcatcggctgtatcgggctgattccagttgcccatttcctcaaccccgctgccgccgcctttgccgccgccggactggtgctgcacggttattctttggctcgccggcgcgtgattgccgcctcttttctgctcggtacgggctggacgctgatgtcgttggcagcagcttatccggcagcatttgccctgatgctgcccttgcccgtactgatgtttttccgtccgtggcaaagcaggcgtttgatgttgacggcagtcgcctcacttgcctttgccctgccgcttatgaccgtttacccgctgctcttggcaaaaacgcagcccgcgctgttcgcgcaatggctcgactatcacgttttcggtacgttcggcggcgtgcggcacgttcagacggcattcagtttgttttactatctgaaaaacctgctttggtttgcattgcccgcgctgccgctggcggtttggacggtttgccgcacgcgcctgttttcgaccgactgggggattttgggcgtcgtctggatgcttgccgttttggtgctgcttgccgtcaatccgcagcgttttcaggataacctcgtctggctgcttccgccgcttgccctgttcggcgcggcgcaactggacagcctgaggcgcggcgcggcggcgtttgtcaactggttcggcattatggcgttcggactgtttgccgtgttcctgtggacgggctttttcgccatgaattacggctggcccgccaagcttgccgaacgcgccgcctatttcagcccgtattatgttcctgatatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgccggtcgtccggagtatggaggcatcgctttccccggaattgaaacgggagctttcagacggcatcgagtgtatcggcataggcggcggcgacctgcacacgcggattgtttggacgcagtacggcacattgccgcaccgcgtcggcgatgtacaatgccgctaccgcatcgtcctcctgccccaaaatgcggatgcgccgcaaggctggcagacggtttggcagggtgcgcgtccgcgcaacaaagacagtaagttcgcactgatacggaaaatcggggaaaatatataaaaaacaacagattgagccgaatttctggattaagtgccggaaatcgcgtataattgcgcgattaaacctttatatagtggattaacaaaaatcaggacaaggcgacgaagccgcagacagtacaaatagtacggaaccgattcactcggtgcttcagcaccttagagaatcgttctctttgagctaaggcgaggcaacgccgtactggtttttgttaatccactataaatcagccgttttgcaggcatcacacaggagcgacaattattatgatgaccctctattccggcattacctgccccttcagccaccgctgccgcttcgttttgtacgaaaaaggtatggattttgaaatcaaagacgtcgatatttacaacaaacccgaagacctcgccgtcatgaatccgtataaccaagttcccgtgctggtcgagcgcgatttggtgctgcacgagtccaatatcatcaacgaatacattgacgaacgcttcccccatccgcagctgatgcccggcgatcccgttatgcgcggtcggggccggctggtgctgtaccgtatggaaaaagaattgttcaaccacgtccaagtgttagaaaaccccgccgccaccaacaaggaacaggcaaaagcgcgcgaagccatcggcaacggtctgaccatgcttgccccttcgttcagcaaaagcaaatacatcctcggcgaagatttttctatgattgatgtcgcccttgctccgctgctgtggcggctcgaccactacgatgtcaaactgggcaaaagtgccgcgccgctgctcaaatacgccgagcgcatcttccagcgcgaagcctttatcgaagcactgacacccgccgaaaaagccatgcgcaaataagtccgaaatgcttgcaaaacccaccgttttgcaggcattttcctattttggcgtacaacacggaacccattatgcccacttccaccaaaccctacatcctccgcgccctctgcgaatggtgcagcgacaacagcctcacaccgcacatccttgtctgggtcaacgaacacacgcgcgtccccatgcagtacgtccgcgacaacgaaattatgctcaacatcggcgcgaccgccacgcaaaaccttcaaatcgacaacgattggatcagcttttccgcccgcttcggcggacaggcgcacgatatatggatacctgtcggacacgtcctcagccttttcgcacgggagaccggagaaggtatggggtttgagttggaagcgtaccgccccgatacgccgcctgaaaacacctctgccgaaaccgcgccccgacccgccaaaaaaggcttgaaattggtcaaataaatctatgccgtctgaacggaatcgtgtttcagacggcattttgtccgatggggcgcaaacggaatctgtttatcggcaaaacccgtttcggcgtatcaaaaccgtgttgcccctgccgattcgatattgggatattgaaaatgccgtctgaacctgcgatacgggcttcagacggcattttgtccgatattcgggcaatcaggcggtcagcacggctttcaggattttgttgacttcgcccatgtcggctttacctgcgaggcgggttttcagcagccccatgactttacccatatccgccatacctgccgcgccggtttcggcaacggcagcttcgacctcggtacggatttcgccggcggaaagcatttggggaaggtagcggtgcagtacctcgatttcggcgttttctttgtctgccaaatcctgacggccggcttcagtgtagattttcgcgctgtcttttcgctgtttgaccattttggtcaggatggcggtgattttggcatcgtcggcttcggtgcgttcgtccacttcaaactgtttgacggcggcgttgatgaggcggatggtgccgagggaaacttggtctttggcgcgcatcgcggttttcatgtcttcggtaaggcggattttcaggctcatgatgtcctcgctgggatgtcggatggaaacggcgggtttcgatgccgtctgaaaagcaaaacacaccgcagagcaggtcttgcggtgtgtcctcatatcacagggctgacctgtaatctgtacttgaacgtttagtacattttgggcggcagttgttggctgcgcaggcgtttttgcaggcgttttacggctgccgcttttttgcgtttgcgttcggtagtcggtttttcgtaggcttcgcgggcgcgcagctcggtcagcaggccggttttttctacggcgcgtttgaaacggcgcatagcgacttcaaatggttcattctcttttacgcggattgcaggcattttatttcctttaataaattcggttgtttcatctgcccatcatatcggtggaaagggtagggcagacggtgttgaaagtttaccgtatcgctgtgccttgcggcggcgggatacgcgccgtgacggaaacatcacctcctaacgggtcggcttgtgccgtgtcaagctgcttgaaaaagcaggaaaaacaattttcggattgtcttatatttatggttcgccgtcaatgccgttcgggataaaaatgccgtctgaaagaccgggcgggtttcagacggcatcggtacgtcagcgtgcaggaacaatgcccatacgctgtttgagcgggatgtgcggcgcgccgaagagggcggcgtagtaggcggcattggccatcacttttttgacatagtcgcgcgtttcggaaaacgggatggtttcggcatataccgcgccttcgaggggcgtgtccgcctgccatcggcgcgccctgccgggaccggcgttatagcctgcggtggcgaggacttcgttgttttgcargcggcgtttggtgtccgccatataccacgtccccatacggatattgccgtcggcggtgtaaagttgtgcggcatccataccgattttgccggcgatttcgcgcgcggtggcaggcataacctgcatcagcccctgcgcgcctacgcgggattgcgcgcctataacgaagcggctttcctgacgaatcagcccataaacccaagccggatcgacattaacattttgcgcgtggcggattaccgtgtctttaaacggcgaaatatagcgcaaggtgtagttgagtttgcggtcggtgcgttccgcgctgttgaccgccatatcgtaaaaaccgtggtcgaacgcggtttgcgcggcggtcagcagcttgtcttcgtcaaagccgcgtgtggcaaaacgccattccgcctgagcctgacggcgcatttttgcatcaccggcagattggctgttttggaacagtaccagtgcgcgtttgactgcaccgtcttccgccatgcggcggacgctgtttttgccggcatcgggcacattgttgcgcgtatcgattttccgacccaattcttcccctgccagcaccgcataaaaattcctgcccgtcgctgccgcctgtttgtaaagtttttccgcctcttgcgtgttgcccgttgcggcgcggctgcgtgccagccagtagagccaggtcgggcttttttgcagtttttcgggcatatgcgagataacggaggccagctcgtcccaacgtcgggcgcgcaaggcggcgcgggcgtaccactcgatttggtcgtcggtcagttggcggcggtcggcaaccttgccgtaatagtccaaggcggcaggcacattgaggttttgcgactgataatgccccaatacgccccacgcgaaactgcgttgttcgaggcttaaaccgctttccatttcggacagcagggcggcggcattcggcgatttgcgtgcttctttgccgatgacgttcaacagggcatattcgcgcgaaccttgtgtaccgccgtcaaacgggctgcccaatgcggcggcaaggttgcgtgcgtctgtggtttggcggccggccagcagtccgcgcacgcgcctccaggcgtcgttgccgtccaacaagccggatgcggctgcctgttccaacagtttggtgcagcccgaaggcagtttgcccgtatttttgaccagttcagcggcacgcgtatagtcgttgcggctcgaatcggcgtagcattcgacttcttgggcgcgccctgccggttcgagtttggcgtattcctgtgcaaacagcgtccactgtctgcgtgcgcccaaagacttcagccactcgttgcggacattttccgccatcgcgctgtcgccggcgttttccaaataggcggcgacggcggcatcgtttttctgtttcactgcatccagtgcggacgggtagccgccgtaatctgccagcgtttttctttcgggttcggcagggcgggtgggaacgcttgccgaaaggtcggcagtttctatattgtctgccggggtcttgccggctggcagtgtgtttgtcgaagaacacgcggcaagcaccagggccgccagcagcggcagggaatgcttcatagagggtaggtacatcggatttccttaagaatcggaaccctgaacggtcagggttggaaaagacaaaatgccgtctgaacaggcgtttgcccgaattatatgccgaaactgcaccgcctttggaatgtttccgacataatttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatgtttttcaattatttgccgttttggtgcgaaccgctgcctttgcccgtttcagacggcattgtccgaaatggttgcccgcttcctgctttattgacaaaaaaatgctttcccgataatatcctacgaaaattaacctgccgatttgacacagcttgcgggcataacagctaaagcgttccgacaatttcagctttatcttccgcgcccgttgtgtccgacatcgggctttgttgtatgggaaagacaatgattattttggacaaggtttccaagcattaccaaacgcgcgacaagacccgttttgccgccgtcgagccgaccagcctcgaaatccgcgacggcgaaatcttcgggctgatgggttattcgggtgcaggcaaatccaccctgttgcgcctgattaacctgttggaacgccccgacagcgcaaggtcaacgtctgcgacaagagctgaccgcgctcgatgccgccgcattgcgtcaggctcggcagaatatcggcatggtgtttcagcagtttaatcttttgagcaaccgcaccgttgccgacaatgttgcctttcctttggaaatcgccggatggccgtctgaaaaaatcaaagcgcgcgttaaagaatgccttgaaatcgtcggcttgaccgaacgcgccggccactatcccgcccagctttccggcgggcagaaacaacgtgtcggcatcgcccgcgcactcgcgcccaaaccccaagtcatcctcgcagacgaacccacttccgccctcgaccccgccaccacgcgcagcgtcttggaatgtttggaagacatcaacaaacgcttcaacgtaaccatcgtcatcgtaacccacgaaatgagcgtcatccgccgcctgtgcgaccgcgccgccctcttggataaaggcaaagtcgtcgaaatcgtcgaagtacgcggcaaccaaatccacgcccaatccgacatcgggcgcgaactgattcgggaggactgatatggcagacttaacattccaacaagccgtttccaccawcgtcggcatgaaagacgaaatcttccgcgccttgggcgaaaccttcgtgatggtcggcttgtccaccacattcgccgtcatcttcggcacgctgctgggcgtgctgctcttcgtaacctccagccgccaactgcattacaacaagctggtgaacttcctgctcgacaacctcgtcaacctcatgcgcgccttccccttcgtcatcctgatgattgcgatgatacccgccacacgcgccatcgtcggcagcaccatcggtccggttgccgcctcgctggtgttgagcgtgtcgggattgttttattttgcccgactggtggaacaaaacctgcgcgaagtccccaaaggcgtaattgaagccgccgccgcgatgggtgcgccgccgattgccatcgtctgcaaagtcctcttgaacgaagcgcgcgcgggcatggtttccagcattaccgtgcttgccatcgggcttttgtcatacagcgcggcggcagggatgataggcggcggcggcttgggcgacctcgccatccgctacggctactaccgctaccaaaccgaagtcatcatcttcatcgtcgccctcctcgtgctgctggtcatcctgattcaaagcaccggcaacgcgttggcgcggaaactcgacaaacgttgaacccgaatgccgtctgaacgccaaaacccccaccgctatccgaaaaatgctataaaatccccctgttcgcggcaaatgccgtctgaacgccgaatccggacggcaggactccctgcccgtcatttttgtttgaaactgccacaacatcaggagaaaatatgaaaaccttcttcaaaaccctttccgccgccgcactcgcgctcatcctcgccgcctgcggcggtcaaaaagacagcgcgcccgccgcatccgcttctgccgccgccgacaacggcgcggcgaaaaaagaaatcgtcttcggcacgaccgtcggcgacttcggcgatatggtcaaagaacaaatccaagccgagctggagaaaaaaggctacaccgtcaaactggtcgagtttaccgactatgtacgcccgaatctggcattggctgagggcgagttggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaagacggcatcaatccgttgaccgcatccaaagcggacatcgccgagaacctgaaaaacatcaaaatcgtcgagcttgaagccgcgcaactgccgcgtagccgcgccgacgtggattttgccgtcgtcaacggcaactacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataaggcagtcgtataaaatgatgccgtctgaactgtatccgtgttcagacggcatttttgtcctttaatccgccattccctgccattccgccgaatccggcgtatcgattccgaacagcgacaaagcgtgtgcaacactgtgcgccactatgtcgtccgccgtctgcggtttgcggtacatcgcaggaacagggggaaacaccacgccgcccatttccgttacccgcttcatattgtccaaatgggcaaggttcagcggcgtttcgcgcaccatcagcaccagccgccgcctttccttcaaaaccacatccgccgcacgcgtcagcagattgtcgccgaagccgtgcgcgacagaggcaagcgtccgcatcgaacagggggcgaccagcatcccatccgttttaaacgtaccgctggcaatgcacgccccgatattgccgatcggatgcacgaagtccgccaaggcatatacctcgtctctcgcataagccgtttccgaagcgcgcgccatctccgcacctttcgataccacaaggtgcgtttcgacatcttgcgcgcgcaaaagttccaaagccttcacgccgtattggaaaccgctcgccccgctgatgccgattatcaaacgccgtaccatcatccgcctttcccataaaaccgcctgcaacggcaaaccggctattatagtgaaaaaacagaaatccgataaacgcggatacaaattgtcggcaacacccaatatccgataaaatacccgatttaacatcctatctgaataggcacgggagggcggtatggcaaaagtaaaaggcggattggggcgcggcttggattcgctgctcgccaacggcgcggacaacagcagcggcgaccgattgaccacggttgcggttaaagatatccggcccggccgctatcaggcgcgtgttcaaatcgatgacgaagccttgcaggaactggcagattcgattaaggcgcaaggcgtgatacagcccgtcatcgtgcgcgaacacggactgtcccgatacgaactgattgcaggcgaacgccgttggcgcgccgcacagattgccggcctgaccgaaatccccgccgttatcaaaaccatcagcgacgaaaccgcattggcaatgggtttgatcgaaaacctccagcgcgaaaacctcaaccccatcgaagaagcacaaggcttgaaacgccttgccgacgagttcgggctgacccacgaaaccatcgcccaagccgtcggtaaaagccgaagcgcgatttccaacagcctgcgccttttaagcctgcccgaacccgtgcaggaaatgctttaccaacgccgcctcgaaatggggcacgcccgcgcattgctgaccctgcccgtcgtcgaacagctcgaattggcgcaaaaggccgtcaaaaacggctggtcggtgcgcgaagtcgaacgccgcagccaggccgcccttcaaaacaaacgtcccgagcccaaaaagactgccgccgccgacatcggccgcctgaatgatttgctgactgaaaaactgggtgtcaacgctgaagtcaaaaccgccaaccacaaaaaaggcaggattgtcctgtatttcgatacgcctgaaacgttcggccacctgctggagcagttgggcatagattaccggccttaattttgcgggatataccgtctgaaatatagagaatagctttccagattttaagtgggaaatataattctattgacatttttctgcttcacgtaagaatcgttttcctgttttcatttttaattttcgaagaaattatgaacacacgcatcatcgtttcggctgcgttcgttgcgttggcattagcagttgcggctcaatcaataatgtaaccgtttccgactagaaacttcaggaacgtgccgcgtttgccttgggcgtcagcccaaatgccgtaaaaatcagcaaccgcaacaatgaaggcatacgcatcaactttaccgcaactgtgggtaagcgcgtgagccaatgctatgttaccagtgtaatcagcacaatcggcgttaccacttccgatgcaatttgtttgggaggcggaacgcacaaaggcaaaagtcaatgcaatgctttgcttaaagcggcaggcagttgctaatcctttattcggaaaaggtcgtctgaaaatattttcagacgaccttttatttattgagcaaattccccaaactgccgacaatccgaccgataaactgctacaatttcgc

SEQ ID NO: 282 - DNA, 577 bp, Neisseria meningitidis
ccgaagttggatcgctctagaggatcccctgccgatgtagcgcgctcctggtacgggcataatgccctgggcttcttcctgactgccggcttcttgggtatgatgtactatttcgtacccaaacaagcagcccgccccgtttactcctaccgcctgtccgtcgttcacttctgggcgttgatttttacctatatgtgggcgggtccgcaccatcttcactacactgcgctgcctgactggacgcaatctttgggtatggttctgtctttgattctgttcgcaccctcttggggcggtatgattaacggcatcatgaccttgtccggcgcgtgggacaaactgcgtacagacccgattcctaaaatcccggatggaaccctggtccttctacggaatgtctacctttgaaggcccgatgatgtcgattaaaacggtcaatgcattgagccactatacggactggaccgtcgcgcacgttcatgcgggtgcgttgggctgggtaggctttgtaaccatcggttccgtctattacatgattcccgtctgttcggcaaagaacagatgcacagcaccaagc

SEQ ID NO: 283 - DNA, 7484 bp, Neisseria meningitidis
ttgaacaggttacgaatttgttgttgaatttgtccacgcggccggtggtatcaacgattttttgggtgccggtatagaacgggtggcacagggagcaaacctcgatattgaagttttctttttccatcgcggatttggttgcgaatttgttgccgcaagagcaggtaacgttgacttcgtggtagttcgggtgaataccttgtttcatttgatttcctttcaaaaaagcgggcataggggatgtacctatgctacagacaagtccgacattctcgctattttctgttgttacgtcaagagtatattcgataaaatgtatagtggattaacaaaaaccagtacagcgttgcctcgccttgccgtactatctgtactgtctgcggcttcgttgccttgtcctaatttttgttaatccactataaaaagttcttttgagggaggtttgatgggatcaaaattctttttcctgctgctgcgttttgccggttcggggttgccgccgtcacatatgcgcggcatcggcatcgtcggcagacgggtgcgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggctggtggtcggcaaaaatgtgatgatggagccggaatgtctgttttattcaaataaccacaagtttgaccgttcaaaaaacgctttgagggctacacggaaatccgtccgattacgttggaggacgatgtctggccggggcacagggtgattgtaatggcgggcgtaaccgtcggacgcggttcggtcgtgggcgcagcgcggtggttacaaaagacattccgccctactctttggcggcaggcaatccggcagtggtgaaaaagaatctgccggaaggttgaatgccgtctgaacgtgtcggggcggatgatctgaaaaaacaggaacatcgtttctgttttttgcgcttcagacggcatcgctattgcgccacgcgcgtatcgatatcttggtagagtttgccgaaatcgggttcgccgacgtaggttttgaggatttcgccttttttgccgataaggacggaagtcggataaacctgtgtgccgaacgcctgtccgacagctttgtccgcatcatacatgacggtaaacggcaaaccgtagtctttgacatattggcggacgctttctatcggatcgatgggctgggcgacggcaagtacttggaagtttttgtttttatagtcatttgccgttttaatgattttgggcatwtcgctcacacaacccggacaggagggaaaccaaaaattaatcagggttactttgccttgcaggtcggcgttggaaacggtttttccgtgcaggtcgggcagggagaaggcgggcgcggttttgctgtcggggatgaggacgatggcaaggaggatgccgatcagtgcgacgacggcggcggtgagtatttttttcattcggacaaggcttccaatgcgcgggcaagggtggcgggcaggctgacggtgcgttgtgtggcggcgtggacgggcatcagggtgatgtcggcttctgcggcggttttgccgtttggcagtgtaatcgtctgggtcagcacaatacggcgcgtgccgggggttttcaggcggcatgaaaactgcaatacgtcgccttcgacggcggggcggctgtatcggatgtcgatgcgggcgacaatcagtatgaggcctgccaactcgtgcagcagtccgcgttcttcaaaaaacgcccagcgcgcttcttcgaaaaattcgaggtagcgcgcattgttgacatggccgtagccgtcgagatggtagttgcggacggtcagcttcatcagttcaggttgatgggttggaaggcttcgcgggcaagcggttcgtgttcgaggtcggtgatgacggtagaaagctggatgtcgaaccattcgttgaaaatgtcggcatcgagcgcaggccactcgcgttcgtcttcgcaccagtcggcaagttcggcggcgaaaatgtcttcaaaacgggcttcgatttcgtcccatacttcgtcggcggtttcgcacgggcggacaaggtaggaattggcgtcggcttggatgtcttcaagagtcagtccgtcgaggtggttgcccggcagggtttgcagccagttccaaaaaggttctaaagggatgaggacgaatacgctgcggttgacttcgtacatggtttttcctttgctgtcgcgcggtatgcgcaaaaaagagattatagcccaatctgtggtttcggactgtccgttccgacagaagggaatgccgtccgaacacggattttcagacggcatggctttaaggttgtgttccaggttgcgtttcggcttcccctgctgcttctgcctgtgtttcggatacggaatcttcttgaacggcagtttccgccgcgccggtttcggcactttcgaccaattcgtcgatgtcgatgttatcttccgtaccttcggcaggtgttgcaccggtctgccgcgcacggactttcatatagaggtcgcgcgtgtagctgtatttgtcgatggcggcttcgtccagactgtcggtcaaatcgagcaggccttcgcgcgtactgacggcggatacggcagtcgtgccccagcgtccgacaggggtgcggaagacgatattcttgggcgaataaacggaggtaatacccgtgccgagcgcgtcgcggacggtggacggccctaagacgggcaacacgaaataattgctgtttttccatccccacgaggcaaacgtgtcgcccaaggtgtttttattgtcgggaatgccgcccgcgccggcgatgtcgataagcccgcccaaaccgaaagtggtgttgatgccgacgcggacaaggtcttcgcttgcgcgtttgatgtccaagcgcaagatattgctgccgaagctgaccacgtcgcacaggttgttaaaaaaattggacacgccggcgcggacgggtttcggcgcaactttgcggtagccgcgcgcggcaggggcgaaaatgtagcggtcggcttggtcgttgaatttgaaaacggcgcggttgtagccttcataagggtcggcggggcgggtttcggcaaatgcaggggcggaagcgaacccgatcagcaggaggaaggcataggcggtttttttcatgatttcagccagtctttgatttcgtacagttcggacagcgcgcgcacggattcgggaatgccggtcagcctgacgctgcctttgcaaccgcgcagcacttcgagcagcagcgacacgcaggcggaatcggcgcgtccgacgccgctcaaatcaaccgcgcaggtgtctttcagacgacattgctgtctgaagcgggtaaaagcggcggcggtcagggttttgacggtgatgtcgccgccgatgtgcaatattccgtttttgagttctgtatgcatagcgtttgctcggaaaacccataccgccctcggacggtatggtttgtcggttatttgccgccgtttttggctttcaactcggcaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccgggtacgccgacttcggcgcggacgatgatttctttgccgcctttattgacgatgggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttctttttcattaaagttccttgaatatccgatgttccgcgtttcgtcttcagacggcctgtcaatctgtaaacatccacgcggtcaatataaaatcgaccgccaaaatcgtcagggcggacgaaaccaccgtgcgcgtgctggcgcgcaaaatgccttccgaagtcgggacgcaatggaagccctgatgcacggcaatcagcgttaccgccacgccgaacgcggcggatttgatcagaccgttgattacatcgtaatgtatcgtgatgttgttctgcatttgcgaccagaaaataccgctgtccaagcccagccaggttacaccaaccaaatacgcaccgaaaatgcccgccacgttgaaaatcgaagccaaaagcggcatggaaaacacgcccgcccaaaagcgcggcgcaaccacgcgggcgacagggtttaccgccatcacattcatcgcttcgagctgttcggtcgttttcatcagaccgatttcgctggtcatcgcaccgcccgcgctgctggcaaacaaaatcgctgccaataccggacccagctcgcgcaatagcgaagccgcgaccatatagcccaaaatatcggcggatttgaatttcgacaactgcgtatagccctgtaaacccaagaccatgccgacaaacagccccgaaacggcaacaatcaacaccgacagcacaccggcgaaatacacttggcgcacgctcaggcgcggacggacgaaagccgtaccggacttcgccagaatgttcagcagaaacagcgtgatactgccgagggattgaataaggccgagggttttcgccccgacggaacggataaagttcataaatttctatgtgtaaagttcaacggtttcagacggcatcaactcatttatcccaacaggtcctgctgcaacgacgtttgcgccggataacggtatgctacggggccgtctgccagcccgccgacaaactggcgcacccaaggcgaatccagttcgcgcatttcctgcggcgagccggagaacataatttcgccgtgcgccaagaaaatcacctgatcgacgatttccaaagatttttcaatgtcgtgcgttaccataatactggtcgaacgcaaagccttgttgacgcggctgatcaagtgggcaatcacgcccaaggaaatcggatcgaggccggtaaacggctcgtcgtacaacataatttcagggtcgagcgcaatcgtgcgggcaagcgcgacgcggcgcgacatcccgccggacaactcggacggcatcaggttttccacaccgcgcagaccgaccgcgttcaatttcaacaaaaccaaatcccgaatcaccgcttccggcaggcgcgtcagttcgcgcatcggaaaagcgatattgtcgaataccgacaaatcagtaaacagcgcgccgtgttggaacaatacgcccatacggcggcggtgttcatacaactcgtcagccgaaaagcccgccaaatcccgtccttcaatcaaaacctgcccggactgcggacgaatctgtcctgtaatcagtcgcatcagcgtggttttgccgctgcccgaaccgcccattacggcagcaaaattgccttgcggaatgctgaaattgatgttcttcagaatcgggcggtcgccatacgcgaaggcgacgtctttcatttcgataaagggggatgggctcatgtacggacggacggtaggtttgacggcgtgtattttaaggcttatcgggaagacgggcaattttcagacggcatacggacggtaaatgttgtgaaaatgccgttgtcggcggcggattgtttgctgtggcgaaaaatgttatctttcaaatgataacctttatcagaaaactatggaaaaagcagaacatttgaacagcagccggttcgtcaatctagtcaaaagcggcggcggcagctatgtggagggcagctaccgtttcgatactttgtccaacggcatttccatccacggcggcacagtaacggcacggtgtgatttttgcagcagccgcctcgccgaaccttatgtgtcgttcgtgctcttgctggaaggcagtttggacttcggcatcaaccgctgccgcttccaaatcgatgcggacggcggcaagattgtcctaattgctgtcggggaagaagtcctgttcagccgctatctttaccgaggcggcaaaacggtcaaaatgaccattaaaggtatggaacaatggctgctgcgtccggaatacgcgcgtttcgcacccctgctttaccgcgaaccggtcaggatatgggatttgcccccgaacctgcgcggcttggcggcatcctgcctgaaagccgtcccaaaggggcatttgggcgaaacattgcgccgcgaggcggacgtgttgcggctgctgtcggacttgtgggacacggtttcagacggcatcgggccggcggcggggcaaacggcggaagcagacgctatgccgtctgaagacttcagccgcaccctaaatgccgcgtttgccgacggcgcacaccaagtcaaccggctgacagacgcgctgaacatcagtgaaaggacgctgcaacgccgtatgcgcgaccatttcggcattacggcaagcgaatggctgcaccacaaacaaatgcagcacgcgctctatctgttgcaaaacgggggaaaaagcataggcgaaaccgcatatttatgcggctaccgccacgtttccagctttactcaggcattcaggcaatatttcggcagcacgcctgcggaaaccaaaaaagaaaaccggtaagccgcatttgatttcaaacccgaaatccgcgtgtatagtggattaacaaa

SEQ ID NO: 284 - DNA, 4804 bp, Neisseria meningitidis
ctcgcacgtatggttacctcaggcgaggcggacttggcgattgttacggaacggatagacgaccatcccgaactgggaaaacttccctgctatgactggactcatgcggttatcgtaccgaacgaccaccccttgctcgaatgcagaaaccccctccgtattgaagatttggcgaggtttccgctgattacttatgaatttgcattcaatgcgggcagcagcatcgcgcgggcattttccaaagcccgtttggaacaacccgatgtcgcattggctgcggcagatacggacgtattgaagacttatgtgcgcttgggtttgggcgtgggactgatggcgaaaatggcgtacaacccggatacggacggcgatttgcagcttgtggatgcggcacacctgttcgagccgtcgccgacgtggattgctttgcgcagcgatacttatttgcgcggatatgcctacgactttatccaagcgttcgcgccgcacctgacacgcgagaaggtggataggattctgtacacgcccatcagcgaggatttttcgatttaggcggctgccggttttcagacggcactttgcggcagatacaacaaacaggacagatgttttcgtctgccctgtgtttattgagaatgctgtctgaaatgttcgtacgggttaatcaaatggcgtgcgagcagccggacaccatttttttcaacacctgcagattgaggattttgatgtgcttatgctcgacggaaatcaatccttcctgatgaaatttagataatgtgcggctgacggtttcaagtttcagcccgagataactgccgatttcttcgcgggacattcttaagatgaagtcgttggcagcaaaacctcgggaataaaggcgttgggaaaggttcagcaggaaggcggcaatccgctcttcggcgcgcatattgcccaacagcagcataacaccttggtcgcgcacgatttcacggctcatcatgcggaagaagtgcgtacgcaggctggggatgttttgccccagttcttcgatgtgggtaaacggcagttcgcacacttcgctgtcttccaaggcgaccgcgtcgcaactgtgcacatgggaacagatgccgtccatgccgatgagttcgcccgacataaagaaacccgttacctgatcgcggccgtcctgactggcgacggttgttttgaagaagcccgaacggatggcaaagagcgaggtaaaggcttcgccgacacagaacaggtattcgccctttttcaggcggcggctttgacggatgacggcatcgagttggctgagctcgttgggcagcagcccgacaggcaggcagagttcccgcaaagaacaggaagaacacagcgttttcatctgatgtgtagtattatgcgaagccataccgtacctttttgtgcgctttgccccatcatgattatagtggattaaatttaaaccagtacggcgttgcctcgccttgtccttatttaaatttaatccactatatgtgcttattgacacatatcaagacaggtttatcatactgtggcattctaccaaactatccaaaatttgactaacatcataaaaccgcacacacacaccatgaaaatcattcagatacagaacaatcacaatgtaaacgatgaccgccccgagtttgaccgcgcgctgattgccagcctgcccgccagcggcccgcgctacacttcctaccctaccgccgaccgtttccatgacggtttccgcgaaggcgaatatatcaaagctttacatttgcgcggtatgggcgcgttaaacaaaccgctttccctttacattcacattccgttctgcaacaccatctgctactactgcggctgcaacaaaatcatcaccaaagacaaaagccgcgccgatgcctacatcgaatatcttgaaaaagaaatggaactgctcgctccacatctgaacggacggcaccagcttgcccaactgcacttcggcggcggcacgccgacctttttgagcgacgaacagatcgaacgtgtcttccgcatgatacgcaaacatttcgagttaatccccaccggcgaatactccatcgaaatcgacccgcgcaaagtcagccgcgacaccgtcctcatgctcggcagactcggcttcaaccgcatgagcatcggcattcaggatttcgaccccaaagtgcaggcggcggtcaaccgcatccaaagttacgaagaaaccaaagaagtcatcgatgcggcgcgcgaagcggggttcaaatccgtcagcgtcgatttgatttacggcctgccgcaccagacttcggaaagcatcaaaaccaccatcgataccgttttgtcgctcgatcccgaccgcctcgccctttatcactacgcccacctgccgcacgtgttcaaaccgcaacgccgcatcgataccgccgccgttcccgacagcgaagagaagctcgatatgctgcaatactgcgtccaaaccctaaccgaacgcggctacgtcttcatcggcatggatcatttcgccaaacctgacgacgaactctccatcgccctcaaagaaggcttcctccagcgcaacttccaaggctattcgacctacgcggattgcgatttggtcgccatcggcgtgtcgtccatcggcaaaatcggcagcacctattcccaaaacgaacgcgacatcgatgcctactatgccgccatcgacgaaggcagactgcccatcatgcgcggctaccagctcaatcaggacgacatcctgcgccgcaacatcattcaggatttgatgtgccgtttcgcgctcgactatcggatttacgaaagtatgttcggcatcccgttcgaccgctacttcaaagacgaactggcggatttggaaaaactcgccggtttgggattggtgcgcctgaacagccacgggctgaccgttaccccgaaaggacgcttcctcatccgcaacatcgccatggtcttcgattaccacctgcgccataaagaaaccaaggcgaaatattcgcaaacagtgtgattgtggctaacgtacaaatgccgtctgaaaggctttttcagacggcattttgctgccggcaggataagtgttttcaagaacaggcggcggcatatcataacgttccgcacctttgtgtccgaccgttccgaaaccaagatatagtggattaacaaaaaccagtacagcgttgcctcgccttgccgtactagctgtactgtctgcggcttcgtcgccttgtcctgatttttgttaatcactataccaaacggcatatcccgacagaacagattgtgcataaggcacaagcccgcacattccatcaacaaaatgccgtctgaacacgggttcagacggcatcagtattttacaatcagaatactgcctgtaaaaccaagtagcagacaaccgacaatacggcggcggcaggcagggtaatgacccacgccaaaccgatgggcttcatcagtttccagttggcattgcggttgaccagaccgataccgagtaccgcgccgaccaagatatgcgtactggacacgggcagccccatcagcgacgcgcccatcacgacggaggcggcggacagttcggcggtaaaacccgaagcaggatgcatttccgccaaactcgtaccgacggttttaatcacctctttaccgacaaaccacaaaccgacaatcagcgcgatgccgaaagtcagcatcgcaatcggggggacgacattttgcgcggcaacgctgttggtacgcaaaacatccataatcgcggcaaacggaccgatggcgttggcgatatcgttcgcaccgtggctgaatgcgaagccgcaggcggtaaagacctgcatccatgaaaacatctgaaaggtcgatttgcccaagtctttacgcttgaggcttttggcaaaaacaaacgtccccatccacaccgccgcgcctatcataaagatggtcaggaagctgttgacgttgctcatccccaaatgcaggtttttcaagcccttgaaaatcagcatagcggaaatcatcatcgcgccgaacgaagcgataaagggaatccaagaatgcagtgccttgtaggaatcgacattgtttttacggttgtcgaacgcataaagaccgcggtaatactccgattgcagctcttgcggatcgaattcgggttcgtcgtaaatttgcgcgtcgtgcgccattttggtggcgtactcgactttttcggcttcggacaaaccctcgaaaaacaggcggtgccgttctttataggcctttttttcctgcttgatgcccttgagcgtgccttccgcccaagcgttgtaatctaagacgtttttcttgacgcgcgaaaacagaaaataggacaccgcgccgcccaacacgggcgacaatacccaagaaacaccaataccgcccagcttgccccaacgtatcaaatcgcccgatgcggcatcgttcattaccgccatacataccgcgctgccgacaatgccgccgataatggaatgggtggtagataccggaagcccttttttcgaggcaaacaacagccacaacgccgccgccaaaagcgcggacatcataataaacacaaactgtatgggttcgaaatcaacacccttcaaatcgacgatgcctttgcgtatggtattggttacctcgccgcccgcgatgaccgcgccgctgacctcaaataccgccgcaatcagcaaagcctgcgggatggtcagcgtacccgcaccgacgctggtgccgaaagaattggcaacatcgttgccgccgatgttgaacgccataaacacgccgg

SEQ ID NO: 285 - DNA, 11243 bp, Neisseria meningitidis
cgtggaatcggctccgtactatttgtactgtctgcggcttcgtcgccttgtcctgatttttgttaatccactataattattttttagcgtgtaaaacaaaaccggctgcatacctgcaaccggcctcaaatcagcacaattccttatccaaatccgccaacaggtctttcagagcgtctccgatttcctgaagcgtaaccggacggttgccgtccgaacccgattccgcaccttctgcatacggtgcaaacgtgctctgcaatttcaacagtttcaccacatccaaacgggtgtagcgttcgccgccgtaaccgacaaccacaccgtgatcatgctgccattgcgcaaaaccataggggctgatttgcaacagtccgcacaactcgtccagcgtgaaatagcgttttgcgggaaccttcaaatcaacgttgtttgtcatagtagtgttccaccatgcttttgagtttctggctggcatggaaagttaccacgcggcgggcggtaatcggcacttcctcgccggttttaggattacgacccgggcgttgcggcttgtcgcgcaactggaaatttccgaaaccggaaattttgatttcttcgccgcttgccaaagtgctgcggatttcttcaaaaaagagttcgacgatttctttggcatcgtttttggtgacgttgctgactttgtctaccaaaatatcggccagttctgctttagtgagagtcatatgattaccttctgttgtaacagttgtggattattaccaatttttatttaaaattcaagcgaatatttattttttaactgcgaagccgcgcccctgccgccgttgccgcgccaatcagttttccgataagcggctcgactgcctcatccgtcagcgtgttttccatatcctgcaaaatcactttgaccgccacgctcttcatcccttcgggcagtcccgtgccgcgatacacgtcaaacacgctgatttcctgtaccaacttgtttgccgcgcctttcaagacaagcagcaaatcatcatggctcatagcttccggcatcacaaacgccaaatcgcggcgcaccggctggaatttcgatacgacccgatagcgcgttttcccgcattccaacacggccgccatatcgatttcaaataccagcggcgcttgcggcaggtcgtatttttgcagccatttcggatgcagttcgccgacaaagccgatgactttgccgtctgaaacgatattggcggcacgtccgggatgcagggcgggatgtccggttttaacgaactcgactgctttgtttttcaacagattttccacgtccgccttgatgtcgtaaaaatccgcattgcgcgttttcccgccccattgttccggcatgaccgcgccgtaccacaatccgccgatgcgttcgttttggacaaactggccgtctgaacctttgctgaacacgcgggcgatttcaaacacgcacacgcggttttgtttgcggttcagattgttttgcagaatttccaccaagccgccgatgagcgtggaacgcatcacggcatactgcgccgccagcgggttttgcaggcggatggggtcggcgttggcggcaaaatcttgttcccactgctcgtcaacgaaggcatagctgaccacttcgcggtaaccgcgagccgccatttcgttgtaaacggcaaaacgcgggcggcgtgtttcgggcagttccagcattttcagacggcctgacgtgtaatcgtcggggatgttttcatagccgtaaacgcgtccgatttcttcaatcaaatcagcctcaatttcgatgtcaaaacggaagctcggcgcggtaacgcggaagccttccgccgttttctcgggctgcaggcccaagtgttgcaaaatggtttccacctgttcggcaggaatgtccacgcccaacacggttttcagacggtccaaacgcaatccaacctgcttcgcttcaggcaattcgccttgcgcttccaccatctcgcctgccgcaccaccgcaaatctgcaacaccaattcggtagcacgttcaatggcatccgcctgcaaacggtaatccacgccgcgctcgaagcggaacgacgaatccgaaccgaaaccgtattggcgcgatttgccggcgatgatttcgggcgcaaaccaagccgcttccagcacgatattttgcgtgccgtctgaaaccgcgctcgccgcgccgcccattaagcccgccaaactcaacacgcctttttcgtccgccacgaccagcgtgttttcagacagggaaacggttttctcgttcaggcattccagcgtttccccttcgcgcgcgcggcggatgtgcaggctgccggaaagtttgtcggcatcaaaaacgtgcatcggctgaccgatttccagcatcacataattgccgatgtccaccagcgcggaaatactgcggatgccgctgcgctccaaacgttgtttcatccaatccggcgtagtagcgcgcgcgttcacgttttcaatcacacggctgataaaacggccgcaatcggcaggcgcgttaatctgcacgggctgttttcgactgcccgtgatcggcgcggtatggatttcgggctgcctgaacgcgcaccccgtcaatgcggacacttcgcgcgcaatgcctttgatgctcaagcagtcggcgcggttaggcgtaattttcaacgtaaacagcgtatcgtccaaatccaagtattcgcggatattggtaccgacgggcgcatcttcaggcagaatgtgcaggccgttcacaccgtcgtcgggcagaccgagttcgtcggtggaacacaacatcccgtccgacacctcgccgcgcattttggtcggcttgattttgaaattacccggcaaaacggcacccggcagcgaacacggcactttgatgcccgctttcacattcggcgcaccgcacacaatctgcaccaacccgcccgtacccgcatcaactcgggtaacgttcaaacggtctgcatccggatgtttttcaacggatttcacttcggcaatcaccacgcccgcaaacgcaggcgcggcagtttcagcctcttccacttccaagccggacatcgttaacagatgttccagcttatcggaggaaagttcggtatcggcttgggttttcagccatgagtaggagaattgcatggttaatttctctatatttttaagttattcaataatacaataacctggatgcccaaaactgattctagcttcaggtaaattattttttattttctcaatcgattgttggtaataatcggaattgatttcacaagctgtcaaatcaaactgtgcaatgcagcatgcaatagcaagagttccacttcctaaatgtgtatctaaaatcttatcaccctgctttgcatacatttttaacaaccactgatataattcgactggtttttgtgttgggtgagttttattacgatttttccgcacactaaaccggaaaattttagatggcctatcgaatgacgaccaagccatttccgccatagaaaaattatttaatgtctctggttgattcttatcccaaataataaatcctttattatattcacttctcaaccataactcgccaaaataattcccaccccaaataatttgattttttgacacgcgaaataattcattaaagtaagtttggtctggcttaatatcccattgtgagtattcattcatattgaatttataatcaccaccacgtttagttttattcaaaatcccataaggaggatctacaattgccaaatcaaaatacttgtcaggataccgagacattaagatcatgttatcttcatttgaaatagttatcatgtactatacgcttccattgtggtgttacttgcaaactgttgcatagtcaaattggaaatttctgaactaatatcttttccaagatttttaataataatttcatcaaaataccgataatcaatctctggaatactggagcgattaatcaaacaattatataaaaattcagcaaatgtattggcacgaataattacaattgggcaattacgaatatcggataatacggcagggacataacgtggtgtgacaacaattgtgtaaatggccttaattttatttttatgatcttccaatcttcctgaattaatacctgataacttatttttagttgattttgcctccactgcaaattttctcttttgcgtaatatataagcactctaaatccgtattacctggtccaccaatttttttagcttctacgttataaaacatattgaaccccatttctagaacatcttcaaatagatatgcctctgttccattattattatctgcatattgttcaatcaacctaggtaagtgcaataattcatatgctgcttcatccttaagctcaccaatttcctccaataactcttttggatagaagctataaatttccttaatgacatcaattttcaaacgatcactatcgttcagatttaatggcatttctgaaaacgaataagcactttgcaattttttcacaaattcctgaagttgcttaggaatcgaaaactcacttgatgttactttacgatatgtttcggtcttaccatgctttagacggcaaataattttaccatctgttttttgcaaaacacctgcatcagtcaatgtttttgaaaaataagattcccactcatgtgctgcatttacataagcatgactacgactattttccgcagttaattgatgtttaatttttacttcagcacatgttcgtaacaccaaaatgtcttgtactaatttttcatagctattctgatcagcagatttcacaaatgaaattaaatagatatattcataagaaaatagtttacaatccaatctttcatcagataacaacttaaatattagtctcatgggatataattgaatactttcatcagtcttaatgtacggatgaggaaatggtatcgcccacaacatagtaagaaaaattttttgaatatattcattattatccaagtgtttcaaaaataaattacccaatggactgaacaggaatttctgtgtaacttgcccacacacatcacgataaccaaacatatagaatgataattcttttattttatgagtagtagcatccaatgatttacctgtatttcgtctatggtataaatctagtttttccaatttttcagataacttagctttatcctctacagatataaaagaatttgttttcaaaatacctgcaaatttacataaaatatgaaaattctgtaaatgtttatctattacccagcgcgcagttgtcatatctattttcctattctctctacaatttttttaattaacaatggaggaatagattcaccaatacattgccgaattaataattctgatgtatcgtcgggaatattccaatcaataggtaatgatgttaaaagcattaactctaatggtgttaaaactcttgcatctgaatatgttccatcaggcatagaccgtccaggatgaacatttaattgtgaactgatagcgtcattacgaatagtaatagttggggcaggagcatcccactccatacggcgataagttgtattataacttttaattttttcaccattttttttctttggataatgttctatattatcaaaagcagatcgtcctgttggcgtattttttagccatataatgtgctccggagcatgtgtacgtgcaaaatgccatttcacattagacttttgtccagactcaatactaggcaaaaaactaatagcatcacgaacagaaatggtttttgtaactttttccggcattccccaaatagttgaatgtttattcatacgaataatagctcgtttacgatgttgtgcaacaccataatcggcagaatcaaaaatatgagtttgaatataatattcgcaaccaaataaatcttgcaaaattacttctactgtttgtaatgtccccttataaggtaacttaatttttaaaaaaaatggaacattttcaatcaaaacaaaagttgggcgttttaataaaataaattcgattactctgaatattaaatgattacgtttatcattagccatctcttgaatgttacgatttttccctgcaacactcatgccttgacaaggaggagaagcaattaaaaaatctaatcgattcggcacgctctgtattaaattttgaaacacttcctcatgaagtatatcacctataatcattttactttcgggatatagagctttatataaattagcacgttctggcaccaattcatttgcagctataatcttaatacccgcattatgcaagtaggtttctgcaatccctgcactcgaaaacaaagaagcccctatcatcatagaaccaaacccaaattaactatataatctctacaaagcaataaattatgcctctttaaacaaaattaggaatgtaatttcacaacaaaatatcaaatgttttatatcttacatttgaattttcctaagcagcctgaaaaccaagagtaggctgcttttccatattcaggcagtctgcacgatcatttcgcaaactgcttcaaaaagttcaaatcattatcgaagaacaggcgcaagtcgttcacgttgtaacgcagcatagcgaagcggtcgagaccaataccaaaggcgaaaccggtatatttttcagggtcgatattgacgtttttcaacacgttaggatgtaccataccgcaaccgcctacttccagccatttgccgttttcgcccataatgtcgatttcggcagacggttcggtgaacgggaagaaagacgggcggaaacgtacttgcaaatcatcgcgttcaaagaagcgacggataaaatccgtgaacactgcttttaagtcggcaaaagttacgccctcttctacccacaaaccttccgcctgatggaacataggcgagtgcgtggcatcgctgtccacacggtaaacgcggccgggggcgataatgcggatgggcggctcttttttatcgagcatatagcggatttgaatcggggaagtgtgcgtacgcaaaacatcgccgttttcaacgtaaaacgtatcctgcatcgcacgggcaggatggtttgcagggatgttcagggcttggaaattgtgaaaatcgtcttcgatttcaggcccgtccgccacttcgaaacccattccgtgaaagagttcgaccacacgttgcaaggtcagggttacgggatgcaggctgccgccttcctgagcgcgtccgggcagggtaatatcgagggcttcggcggcaagtcgggcttgcagcttgacttcgttgagggcttcgcgtttggcattaaaagccgtctgaaaccggtttttgcattcattgatatgcgcacctatggttttgcgctcttcaggcgacatttgccccaaagttttcagaagtccggtcaactcgccggttttaccaagataacgggctttgatttgttctagagcgttgaagtcttgcgcagcttctactgcggcaatgccttctgcaacgatgcggtttacattttccataatatcaagtctgtcaattaatgatataccacctgaaacaacgaggccgcctgtatagcctgacatatcagactcttcagacgaccttattttcttcacggtcaatccattggataaattttctgtatagtggattaaatttaaaccagtacggcgttgcctcgccttgccgtactatctgtactgtctgcggcttcgtcgccttgtcctgatttaaatttaatccactatattttaacgcaaatttatttaaaaaaatagactttaaagaaagaaaatcaatcacatagaatttctgcaaacaaagaaaaaaggaagccgcagcttccttttcaattttttggattaagcagccaaagcagctttggctttttcaaccaattgtgcaaaagcggctttatcgaacacggccaaatcagccaatactttgcggtcgatttcaatagaggcgcgtttcagaccgttcataaatttgctgtaagacaacccgttttcacgcgtacctgcattgatacggacaatccacaattgacggaattggcgtttgcgttggcggcggtcacggtacgcgtattgaccggctttcattaccgcctgcttggcaacgcggtaaacgtttttacgacggccgcggtagcctttggctaacgcgaagattttttggtgacgggcacgagcggtaacaccgcgttttacgcgtggcatattctaaactccttaagcgtagggtaacattttagcaacagaagccaaatcgcgatcatttaccatagaggtaccgcgcagttggcgtttgtttttggtggtctttttagtcaagatgtggcgtttgaacgcatgagcgcgtttcacaccgccgttacccagtactttaaagcgttttttcgcgctagacttggttttcattttaggcatgggaaaactccattcgttatcggataaggcattagggggttttaaaacatcggtttcaaacacttgaacccacaatgacacggttttttgccgcaattgaaaacttactccgaagcggcaatcggagtaagcggagaattatagctttattttttcttcggcgcaatcatcatcaccatttggcgaccttccattttgggaaaggactcgatttgcgccacttcagccaaatcttcttttacacgttccaaaagttgcgcgccgagttgctggtgagccatttcacggccgcggaaacgcaatgtcactttgactttatcgccgtcggcaaggaagcggttaatgttgcgcatcttgatttgataatcgccctcatccgtacccggacggaatttgatttccttgatttgcaccctgcttttggtttttcttggcttcgtcgcgtttcttggcctgctggtatttgtatttaccgtaatccatcagtttgcacacaggcggtttagcagttggggaaatctctaccaaatcgacatcctgcccttcggccatagccaaagcttcacgaactgaaacgacaccaagctgttcgcctgactcactgattaaacgcacttctttggcggtaatttcgccgttgattcgtgcttcgcgttcttgagcgatgatgaatactcctataaaaattaatgattgacgagggcatcagtgatttcttgctgcaattgcgcaatgaaatcatccaaatccaaagaacccaaatcttctgctttgcggcgtaccgccactttgttttcctgcttctccttatcgccgacaacgatttgataagggaaacggtattggctgttgtcgcggattttgtaaccgattttttcgttacgcaaatccaactcggcgcggaatcctgccgcctgcaatttggcagccacttcccgacaataatctgcctgattttcggtaatattcataattaccaattgaaccggagccaaccataacgggaatgagcctgcatggttctcaatcagaatgccgataaaccgctccaaagaacctaaaatggcgcgatgcaacataacaggacgcgcacggtcgttgttttcagttacatattcggcattcaaacgctccggcaatacgaaatccagttgtaatgtaccgcattgccaagaacgacccaaggcatctctgacatgatattcgattttaggcccgtaaaacgcaccctcgcccggcaattcgccccattccacgccgcaggcagtcaatgcctcgcgcaaaccctgctctgccttatcccacacgtcatctgaacctgcgcgtttttcagggcgaagagaaagcttgacggatacatcatggaaaccgaactgtttgtagatgcgaatcaacaattcattgaacgcacgagcctcgctgacgatttgatcttcggtacagaaaatatgcgcatcatcctgcacaaaaccgcgaacccgcatcagaccgtgcagcgcaccgctcggctcattgcggtggcaagaaccgaattccgccaaacgcatcggcaaatctcgatacgaacgcaaaccgttgttaaaaatttgaacatgacccggacagttcatcggtttaaccgcatattcgcgtttttccgaactggttacgaacatattatctttgtagttgtcccaatggccggatttttcccaaaaggttttatccatgatttgaggcgttttgacctctttataaccggcggcgttcagctctttacgcatatgctgttcaatcacttgccacaaagcccagcctttaggatgccaaaacaccatgcccggcgcttcgtcttgcaggtggaacagatccaattgcttgccaagtttgcggtggtcgcgcttttcggcttcttcgatacgttgaatataggcttttaattcgtcttttgtcgcccaagccgtaccgtatatgcgttgcagcatttcattattgctgtcgccgcgccagtatgcgcccgccaacttggtcagtttgaagtttttcaggaaacgggtattcggaacgtgcgggccgcggcacatatcgacatattcctggtgatgatacatccccatcgcttccacttcgggcatatcgtcaatcaggcgcagtttgtattcttcgccgcgctcttgaaaaattttaatcgcctccgcacgcggagtcatgattttgaccacatcatagtcttgggcaatcaattctttcatacgcgcttcaatggcggcaacatcttccggtgtaaacggtttttccgtggcgatgtcgtaataaaagccctcttcaatgacggggccgataaccatttttgcattaggatagagttgcttgacggcatgcccgacaagatgcgcgcaggaatggcggatgatttcgatgccttcctgatctttcggagtaatgatttgaacagcagaatcttcaacaatcgggtcgcacgcatcgaccaatttgccgtttaccctgcctgccaccgtcgccttcgccaaaccggcaccgatagacgcagcaatttgagccacggtaacgggggattcgtattggcggactgagccgtccggcaaggtaatattcaacatcaaacgctccgaaagattaaaaaataacggcataaatgccgttatgggaatttggtaggcacgattggattcgaaccaacgacccccaccatgtcaaggtggtgctctaaccaactgagctacgtgccttcaaagaatttttgcattttatcgggtcgttttaatttttgcaagaggtatgtgcgtttc

SEQ ID NO: 286 - DNA, 4540 bp, Neisseria meningitidis
gcacttcagacggcattttatgccttgccctccatgccgtgatgttcgatggcaaaaccgcttcggcggtaggcggtaaagcgttcgcgcgcgtcggcgagctcttccaagctgttgccgacgatttccaaaacgcgcgcgggcaagaccggagcggtgttccaaaaaccgtcggacaggttcaaaacggtcatgccttcgggaattcggggcagattgccgccgcaggcaagcaggacggatggttcagacggcatggcttcttccgtttcccaaatttcgtgcggaatgaaactctcggcctcgtattgccaaagcattttgtccaattcctgaagctgcccgaacgaatcggaccacaccagtatcctgccgccgtcccgaatcgcacgggcaatcaggcggcaggtgaaaatcggaacttgggcaacgtgcgtgtaaaaggtggctttcggcatattgtttgaacatttggcaggataatgccgtctgaaaggcttcagacggcattgtgggaaaattaaagattccgcagatagttcagcagcaagggaacgggacggccggtcgcacctttttccgcaccggatttccacgccgtacccgcgatgtcaaggtgtgcccatggatagtcttcggtaaagtaggataggaatgttgcggcggtaatcgtgcccgcgccgggcgtgccgatgtttggaatgtcggcaaagttggatttgagttggtctttgtaggtctcaaagagcggcagttgccatgctttgtcgtccacgttgtaggaagcggcaagcaggctgtcgatcaaatcctgattgttgcccatcacgccgctgacatcgtgccccaaggcaacaatacacgcgccggtcagggtggcgacgtcgatgacggctttgggtttgaactgctcggcgtaagtgagcgcgtcgcacaaaatcagacggccttcggcatcggtgttcaacacttcgatggtcagccctttcatacttttcacgacatcgcccggtttgtttgccgcgccggaaggcatattttcacaagtggcgacgacggcaatcaggttaatcggcagttgcagtttgacggcggcgcagaaggtgctgatgacggttgccgctccgcacatatcaaacttcatttcgtccatgttcaggccgggcttgagggagatgccgccggtgtcgaaggtaatgcctttgccgaccaataccacaggcgcggcttctttgtcggctgcaccgaaatagctcagttcgaccaaatagggggcttccgcgctgcctttggcgaccgaccaaaacgaacccatgttttctttgatgtagtctttttcgatgattttggcgtgcgcgcccagtttttcggcttcggctttggcggtgcgcgctaaaaattcgggcgtgcattcgttgggcgcggcgttgcccaagtcgcggcagaggctttgtccgtaaacttgcgcttcggcgacgcgcaaggcttctttgacggcggcttcgtgcgcggtatggaacacggcagtttcaaatttggcgggcttggcttcttttttgtagcggtcgaaacggtaggcggcattgccgaacgcaatcgcaaacgcttcggcaacggctgcagcctgcgcttcttcaaagacgtgaacgtccacattgaccgtttcctgattttgcgcccatttggcggcttcggcggcggccttgttcaatgcggcgcggccggtgcttttcagacagcatacggcaacagcctgcaaaccgttgcctgtcgggatttttgtgtcggcaaaattttgaccttcttcaagcgaagacaaaagggcaaggacggtcgggttgctcagttgcgatgcttcggtgcagacaaataactgtgcgcctgcctgctgttcctgcaagatttcggtttttgtgctaaattccacgtttattctcctgattgagacggttgtcggtagttttcggacggcctttcgctcaaaagaccgtctgaagacggctggcacgattgtaccccatttgaagcaccgtctgaaaccttgcgcggacaatccgcctgcgccgaaccgcttaccgcccccctgaccgcgattctatgatttatcaaagaaacctcatcaaagaactctcttttaccgccgtcggcattttcgtcgtcctcttggcggtattggtctccacgcaggcaatcaacctgctcggccgtgccgccgacgggcgtgtcgccatcgatgccgtgttggcattggtcggcttctgggtcatcggtatgacgccgcttttgctggtgttgaccgcatttatcagtacgttgaccgtgttgacccgctactggcgcgacagcgaaatgtcggtctggctatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgagttcaacagtttgggcaagcgcaacggcagggtttattttgtcgaaaccttcgataccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaactcatcgaccccgtttcccaccgccgtaccattccgaccgcccaactgattggcagcagcaacccgcaacatcaggcggaattgatgtggcgcatctcgctgaccgtcagcgtcctcctactctgcctgcttgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacattatcatgtttgccgttgcactcatcctgttgcgcgtccgcagtatgcccagccagcccttctggcaggcggttggcaaaagtctgacattgaaaggcggaaaatgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcattatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtctcggattgctgttccaccttgccggacggctcttcgggtttaccagccaactctacggcatcccgcccttcctcgccggcgcactacctaccatagccttcgccttgctcgccgtttggctgatacgcaaacaggaaaaacgttgaaccaatgccgtctgaacctctcttcagacggcatttgttttcattgacacattcccacagacagatagccgttccctattacattacctgtcataacagttccatttttgttaaaactagtctatgatagcggtacaaatattgtttacaatatttaacgcaaatcatttgcaacccgacaaaagaaaaacagaaaaaggaacaaagagatgttagaagcctatcgtaaagccgccgccgagcgcgccgccctcggcatt

SEQ ID NO: 287 - DNA, 2804 bp, Neisseria meningitidis
cggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataaggagcctaattacattcatggcttaaactgaaaaacagcaatcaagtttattttgattgctgtttttcttaatattgggataagggtcgtattttaattaaccttaatcggtgcacttctagcaatatagtggattcacaaaaaccagtacagcgttgcctcgccttaccgtactatctgtactgtctgcggcttcgtcgccttgtcctgatttttgttaatccactataattttcagacggccttttgccttttcaaattcaaaccaatcaaacggttttattgcttcatcgcgttggtcaaggctttgatgttgtggcggtacattccgatgtaggtgtctgcgggcgcgttgccgagtgcgtcggaatacagtttgccgctgacgttgacaccggtttctttggcgatacggtcaaccatacgggtgtccttgatgttttcggtaaagacggctttgatgccttcgcgtttgatttgtcggatgatggcggcgacttgtttggccgaaggctcggcttcgctgctcacgccttgcggggcgatgaattcgatatggtaacgtttgcccatataggaaaaggcatcgtgcccggtcaggactttgcgtttggcagcagggacggcattaaatgcggcttgtgcgtcgctgtgcagttttttgagctgcatttggtagttgcccaagcgttgttgataataaactttgccttcgggatcggcctttatcagggctttggcaacgttttgggcataggcggacataaggacggggtcgttccagacgtgcgggtcatattcgccgtggtcatggtggtgtccttcgtggtcatgatcgtggtcgtgatggtgtccgccttcttcttcggctttgaggggttggatgcctttggtcgcttcggtataggatactttgctttgtttgacggcgcgttgcacatcggcagcttcaagtcctaagccgttgagcaggacgagttttgcactgcggatttttttaatgtcgccactggtcatatgataggcgtgcgtatcttggttggctccgaccaaactttgtatggatacgcgctctccgccgatttgtttggctacgtcgcctaaaatgctgaagctggttacaaccggcaggggggcggcagttgcggaggcggtcagcaatgcggcaataagggtgagtttgaggtgtttcataactgttctcctgtgatataacgtaacatctgttatggtaaaacaagccgcctgtttgttcaagcggcttgcggggtcaggtggtgtggcggtggtggcttttgagccatttggccagaatgccgccttctttgccgagtatgacggcaaagacatatcggacgctgcaccagcggatgat

SEQ ID NO: 288 - DNA, 657 bp, Neisseria meningitidis
ccggcaccacgccttacgacaccgcccacctcgaagtgatgttcgaccaatgtttcagccagattgactatttgcgccgcaaagggacgggcgccggctccggttcgtcggtcaaagtcgcccacctgctcgaacggctccggcagaccgtagaccgtctgaagctgctcaccgacatccaaaccggcgccggcaacagcaaccgcctgaccatcgcgctgatgaactccctcatctacgcggcggtcgaacaatacagcacccgccacctgcgccgcgcagcatccgtatgctcgcccgcagcattaccgaaaacaaaagccaccacggcgaacactacatcacccgcaaccgcaaagaatatttcaaaatgttctactcggcggcaggcggcggcatcatcatcgccctaatggcgctgctcaaaatccgcatcggctcactcggcctcagccccttcctcacttccttgtcggctgggttcaactacggcatcggctttatgatcatccatatgctgcactgcaccgtcgccaccaagcagcccgcgatgactgccgccagcaggcaatcggagtaaaaaatgaaccttgatttaaccgcgcaaaaagtccgtctttcttggaaggatattctgtgggggtatgggaataaata

SEQ ID NO: 289 - DNA, 305 bp, Neisseria meningitidis
tgctggcagcaaagaaatctgcacgattgtcaatggtgttgaaatacttgtcaaatcttgtagatgccccttgtgagttatataaatagccaaaaacttctttggcaacccgtgatacatccgaagggatatacttccacgcagcaggcatggcaatatatttaatagatatattaatgccgtttctgcaaccatcgcgcaatgggttcctagaatagacttgttgaagttccgtatcaattactttgcgaaattgttcatccgttttgatggcatttactttttccatcgtagtagtgcaagtt

SEQ ID NO: 290 - DNA, 432 bp, Neisseria meningitidis
gtcgactctagaggatcccctgggattgagtttagaccagactgctcattatactttatgcaggtttgtaaatatttggcaaacttcataaattatgccttgtaatcaagtcatcaaataagcatgtaaataactactatagaaattaaattacaaaaatattatgtattcttttgtgtacaaagggtaccgagctcgaattcgtaatcatggtcatagctgtttcctgagtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgc

SEQ ID NO: 291 - DNA, 524 bp, Neisseria meningitidis
cccgcgcaggcggcaatctatcggaaatgactgaaacctcgagattctagattcccactttcgtgggaatgacggttcagttgcgttccaacaacaccgcaatctcgaaatccgtcattcccgcgcaggcggaaatccagacctccgacgcggcgggaatctatcggaaatgactgaaacctcgagattctagattcccactttcgtgggaatgacggttcagttgcgttccaacaacaccgcaatctcgaaatccgtcattcccacacaggcgggaatctagactcctgacgcggcgggaatctatcggaaatgactgaaaccccgagattctagattcccactttcgtgggaatgacggttcagttgcgttccgacaacaccgtaatctcgaaatccgtcatttgcgtacaggcgggaatccagacctctgacgcggcgggactctattggaaatgactgaaaccgcgagattctagattcccggttttgtgggaatggcggctcacttgcattccgacaat

SEQ ID NO: 292 - DNA, 421 bp, Neisseria meningitidis
tcggcatttttttatccgttttgggggtaacttgtttggaaagctgcaacttcataaatacaggattacatttaagttttgggtaacctttttaaaaaaatgcgtgatgacttttgcatttttaaggcgttttttggggtaattcgtgaaaagttaccccaaaagttaccccataaatggcgaaaactcaagcatacgccagcatcctgcaacacaaaaaagccttgaaactgttgaagttcaaggcttttttgtgttgcaggatctgctgtcaatagggtatggtggaggcggggggtatcgaaaccccgtccgatattcctctacaaagcgttctacatacttagttgtgtctatatgagaatcttatttccatcatgccgaccaacaggctttatggataccagttaccttaagtctt

SEQ ID NO: 293 - DNA, 416 bp, Neisseria meningitidis
gacggccagttcgcgaaaacgacggccagtgccaagcttgcatgcctgcaggtcgactctagaggatcccggcgatggcttgtgcgagttggggcaggatgggggcgttgcggtcggggttttggcttaaaaattgggtgatgaattcgggcactggcacgcagatgcggcggatttgcttgggcagtgctttgatttgcaactggattttttcgcgtatcatgccgggcaccagccattcgtgcgacggcgcgtgcaggcggttgaggacggtcagcggcacggtcatggtcacgccgtctagcggatggtgcggctcgaagcggtaggaaagtttgaatttgccgtctgcggtttgccagaatttggggaactgttcttcggtaatgtgtgcggcggcgtgttgcatcagatcg

SEQ ID NO: 294 - DNA, 8059 bp, Neisseria meningitidis
gccccaccaacctgtgagtctccttgcctgctggtgtgtgtggccgcccactcacccatgcatcatgacccgtgggatctcagtagccagcgtgcactgattctgcgcacttatcagtgccttcgtacactttgcccacttccacttcggcagtaatctgctcgatgcgttttttcgccgcatcgccggcttcttgagtggttgcggcaatggtaatcgtaccgtcttcggcaatattgatttccgtaccggtttcagcggtaatcgaacggatggtttcaccgcccttaccgataacttcgcggattttgtcttggttgattttcatcgtgaacaagcgtggcgcgtgtgcggacagctcttgcgggcccgcaacggcggctttcatctgatccaagatgtgcagacgcgcttctttggcctgtgccaaagcgatttgcataatttctttggtaatgccttggattttgatgtccatttgcagcgcggtaacgccttcggtcgtaccggccactttaaagtccatatcgcccaagtggtcttcgtcgcccaaaatgtcggtcaggacggcaaatttgttgccttccagaatcagacccatcgcgataccggcaacgtgtgctttcaaaggcacgccggcagacagcaggctcaggcagccgccgcagacggaagccatagaggaagagccgttggattcggtaatttcggagaccacgcgcatggtgtagctgaaatcttcaggtttcggcaatacggccaacaatgcacgtttagccaaacggccgtgaccgatttcacggcgtttcggtgcgcccatgcggcccacttcgccggtagagtacggcggaaagttgtagtgcagcataaagcggtcggtgtattcgccggacagcgcgtcgatgatttgctcgtcgcgcgaagtacccaaagttgcaacggccaaagcttgggtttcgccacgggtaaacaatgcagaaccgtgcgtgcgcggcaatacgctggtttggatgttcagcggacggacggtgcgggtgtcgcggccgtcgatgcgcggttggccatccaaaatttggctgcggacgacatcggcttccaagtgtttgaaaatgcctttgatttcgttggctgccaaagtgtcggtttcttcggtaatcaaggcttcttttaccgcactccaagcttcgtccaatttggcagaacgcgcttgtttttgacggattttgaacgcttctttaatggtttcgccggcaatcccgcggactttggcaaccagttcctcattggtttcaggtgctttccaatcccaaagttccggattgacttcgtcggcaaattcattgattgcattgatggcaacctgcatttgatcgtggccgtaaaccaccgcgcccagcatcacgtcttcgggcaggattttggcttcggattccaccatcaacacggcttttgaagtaccggcgaccaccaagtccaattgcgatttcgccaattcggctttagtcggattcaaaacgtacacgccgtttacataaccgacgcgtgccgcgccgatcgggccggcaaacggtacgccgctcaacaccagcgcggcagatgcacccaacattgcaggaatatcagaatcgatttcaggatcgacggacacgaccatcgctacgatttggatgtcgtggtagaaaccttcagggaacagcggacgaatcggacggtcgatcagacggctggtcaggatttctttttcgctttgtttgccttcgcgtttgaagaaaccgccgggaattttgcctgcggcgtaagtgcgttccaaataatcgacggtcagggggaagaagtcttgaccttctttcacttctttgttggtggtaacggcaaccaaaacaacggtgtcgcccatagagactttaacggcagcggcggcttggcgggcaatttcgccggtttccaaagtaacggtctgattaccgtattggaaggtcttaacgtgtttgtcgaacatcattgttcctttcaaaataccgcactgctaaaacactaataatgcacactaaaatccgaatgtgcatagttagggtttcagaccgtgcggcaggttataaacaagctttcagacggcatttcggacgctgaaagcaattgcggattataaaggcaaccatccttaaaatccagtattgatacaataaaaaggccgtctgaaccatatttctttcagacggccttcaaacttaaaaatcaatcctgagtcagcaaagtcaatgcttcccgatacttctcgacagttttctgaatcacatcggcaggcactttcggcgcaggggcttttttgttccaaccgctttgttccagccagtcgcggacgaattgtttgtcaaaagacggcggattggtgccgactttgtattggtcggcaggccaaaaacggctcgaatcgggagtcaatacctcatccatcagcgtcagcgtaccgttttcatccaaaccgaattcaaatttggtatcgcaaataataataccgcgcgatttggcatattccgccgcttcggtgtaaagccgaaccgccttggcgcgcacttcttccgccaattctttgccgataatgcgtccgcattcttcaaagctgatgttttcatcgtgatcgccgactgcggctttggttgagggcgtaaaaatcacttcaggcagttgttgcgcttcctgcataccttcaggcagttgaataccgcaaaccgagccggttttttgataatctttccaaccgctgcctgccagataaccacgcacaatcgcctctactttcaccggagtgagctttttagccacgacggcgcgtttctctaaagctttggcttcgttttcaggcaaaacatcgtaaaccgtttgaccggtaaagtggttgggcataatatgcgccagttttttaaaccaaaaattggaaatctgcgtcagaatctcccctttgctcggaatcgggtcgtccaaaatcacatcaaacgcggacaggcggtcggaagcgaccatcagcatacgtttatcgtcgatttcatataaatcgcgcacttttccaaaatagatctttaccaaaccaatctcactcatttcgcccccccctgaaaatatcttgaaaataccgacccgacacccgacaggtttgaatcacaaaccgatattctagccgaagtcggcgcaaaacaatacccatggcacaaaaagccaacccgtcaaccgtcggcaaaattttggcactataataccgacagcaagtcctacaatacacttttaccaaaggaaatacctcatgagaatcctattgacaggctcgaaaagccaactggcacgctgcctgcgcgaccgtcttccggaagactgggaaaccattgcgacggattccgcatccctagacattaccgatgccgatgccgtctgcaacatggtcaaaagtttccaacccgacgccattgtcaacacggctgcctatactgccgtcgacaaggcggaaggcgatgcggcagcggcatttgccgtcaatgcttccgccgtttacaaccttgccttggcagcacatcgcgcccatgcccgattcatccacatctcaaccgactatgtctttgacggtaaagggaaaagaccctatcaggaaagcgactttaccaatccttccaatgtatacggacaatccaaaaccgcaggcgagctgctcgcactgtctgccaatcccgacagccttatcctgcggacttcttggctgtttagcgaatacggggacaactttatccgcacgatgctgaaccttgcgcgggaacgttccccgctgtccgccgtccacaaccaaatcggctgcccgacctatgccggcgacttgtccgccaccatcatccgcctgttgcagcactccaatcccgttcgcggcatttaccactacgccggcagcaaatccgtatcctggtacgaatttgcccaacatattttccaagcggcatcgcaacagcagacatccttccccgttcccgaattgactgccgtttcagacaaggaatatccgaccgccgcccccaggcccgcatacagcattttggactgccgcaaaatcgaaaacgacttcggcatcaaaccgtcagactggcaaaaagcccttgcacaggtcgtttccaagctgctctgatgccgcccgcccctctgtttccgccgtcaagcaccgccttggcggttttcttatatagtggattaacaaaaaccagtacggcgttgcctcgccttgccgtactatttgtactgtctgcggcttcgtcgccttgtcctgatttttgttaatccactataaaatctaccgattacacaaacacatatcatctttacacaatcatgcttccatcaacagtaaaacatgatatgattgccaacaataacatctcacaataaattttctaatttttattgaaaaaatcaataaataagaatcctcccaaccgacaaataaaataaagaaagggttaatatgcaacatcgaagaagactagcaatttaccaagcatccaaacgtgcttcctttaccggcaggtcatccgccccgcaaaaacgtaaagaacgttgatttgaaaaaaatgccgcctgaagtcctgcttcagacggcatttttttaccgttcgagaaactgtttcaacctgtcctcatccaaaaaccagtgacagatttcctcatctcccgccaacaaaacgggaaccagctcattgtatttttcttccaaaacaggattttcatccacatcgaccacttccagcccgaacccgtattcatcctgaaaaggtttgagttcgtcgcgcattttgtggcacaagctgcaatattcacgaaacatcaaggtcaatttcatccgcgtttccttatctgtcaatttgcacacgccaaagccttagacgcagcagaatcatggtctatttgggaaaaaacaatgttttcgaggaagatgatactcaagtcctgccaaaaacagtaaaaatgccgtctgaacagttcagacggcatttcgaaaaccgttttacgcttgaacgttgatacccgccgtaaccgtcggttgcgcattgtgcgccgtcagaaacgaagcggcaagctccccgcagcagccgcagcagctcgctacgcccaattgcgactgcaaatcgcccattgtggtcgcgccggcggcgatggtttccttgatttgatggtcggtaacggcattgcagatgcagacaaacattttgtgctccgtgtgttctcaaactatcgtaccgatagcggcttttattatcgtatgcgaatataaataaaaacggttcgcattgcaaggtcggtatacacggtttgtcttggtaattttttatcaagtttgcattttcgattgatttcttattaaaccaaagtagaagcctcagtttcgggaatggtgttccttcactacaccctgcaaccatacgttggcaacatgggtataaatctgcgtcgtattcaaatcggcatgtcccaacatatcctgaaccacgcgcaaatccaagccgtgccgcaccagatgcgtggcaaaggcgtggcgcaggctgtgcgggctgatgtgcccgatgcctgcctgacttgcatattctttgacaatcatccatgccaactgacgggaaatgcccgtctttttctgactgacaaacaatgcgtcgcaattcctgcctttcagcagaagtgggcgtgcctccgtataatagcgttccacccaatacgccgactcctgccccatcgggaccatcctctgcttatcaccctttcccagcgcggtaatacagcccctgtccaaatccacattgccgaagttcagcccgaccgcctcgctgacgcgcaagccggtcgcgtacatcaattcgagcaaagccttgtcccgcaaaccgtgcggcgtgtcggtatccggggcggcaagcagtcgggaaatctgctgctcggtgatcagggtcggaatattcttgtcgattttgggcggtttcagcaaacgggtgggattgtccgtccttatgccttcacgctccatccatatatacaggcgtttgcatgccgataatgcgcgcgcctgcgaactccgttgctctccgtcaacataaaccgccgccgccaaatccgcttcgtccgcatccttcagcattctgcccgattgggacaggcggcgggcgattttttccaaatcgcgccggtaaccgtttaaagtattctgactgagccgcctgtccaaccacagcgtttcaagcagcctgtcgatcaaaccttcttccataccgttccaaacaaatgccgtctgaatcttcttcagacggcatggttcacattatcgggaaagcgtttccaatacttcctgcgcgtgacccgccactttgactttccgccattcatgggcgatttctccatccttattcaagacgaacgtactgcgctcgatacctaacgactctttcccgtacagtttcttcaatttgatgacatcaaacaggcggcacactgtttcatccttgtcgctcaacagctcgaaccggaaaccctgcttggcgcaaaaattctgatgcgcctttacgccgtcgcgggaaataccgaccacggtataacccaatgcctcaaactgttccaaacgcgcattgaaatccaagccttccgtcgtacagcccagcgtactgtctttcggataaaaatacacgaccaaaggcagatgttctgccgaatgaaaatccgcaccgctgctcgaaggcagggtaaattcatatttcacatccatagtcctactcccgatattcccattattcaaaacggcacgcagacgcaccgccgcaattgccaaaccaaccccgattctaccgccccaaaggacaaggattcaaccgccggaaacatccaaaccgacacacgacggcatgaaaaatatccatgtcaaaccacaaaatatgttccgatttaaaaacagaatgttataaaacccaatccccaaaacacaacaagaccgcccgcctacgggcagtctcctgtcagacgacatactttacagatggctgttttttcaacaaaataacgccaatactcaaaaatatggaatcaaaaatgtccatccatactctgaaacgcctgccctcatcgctgctgctcggtctctgcctttccctgccgtcagcccacctttttgccgacaacgacattttagggcaatttttagaacagaacatgcttacctcctccgatccgatagaaatattcgccgaaagcacgatacaccccaccaacacccaagccattacaggcggtctgattctctcctcacagtctgccctggtcgtcaacaacaaaaccggacagatactgtatcagaaaaacgccgacaggattatgcccatcgcctccatttccaaactgatgagcgcgatggtcgttttggatgcaaacttggacatgaacgaaaccgttaccattacgcccgacgaaatcgaccgcatcaaagggaccggcagccgtcttgccataggtacggcacttacacgcaaaaaactgctgcacctgagcctgatgagcagcgaaaaccgcgccacccatgcattgggcagaacctaccccggcggcatgggcgcatttgtcgccgccatgaaccgcaaagcccaaagcctcggtatgtacggcagccgcttttacgaaccgaccggactcaacttccaaaacgtttctaccgccaaagacctgagccttatggtcaacgccgccgcccaatatccgcaaatccgcaccaactcgacttccaactacgcctcggtacagaccaaaaacgggcagcagaactacaaaaactccaatgccctggtcagagaaggcatgtggaacatcgaattgcagaaaaccggctacatacgcgaagcaggcaggtctatggttgtcaaagccaacattcaaaaccaacccgttaccatcgtattgctgaactcgcccacatccgccacacgcgtcaacgacgcccgcaaaatcgaatcgtggatgctgcagcaacgctcctgacatacaaatgcccggcggaaaaccg

SEQ ID NO: 295 - DNA, 597 bp, Neisseria meningitidis
  misc_feature (578)..(578): N is any nucleotide
cgtttcttccagtgcagctattgatttagttattaatcgttcacttccggatatggcggatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgatgatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaaggaaatgaagctttaaaaatgaaatcaatagctggttctggatatgaaagctgctgggcaaggaatttggagatgacttaaatacaccgtggaataatctcactcaggctgccgaaataatctataatgacatagtagaccatactagtcaggaatagaaaaaggtgtcaaagccattaaagaattgtcngaaaaaatgaaaaatgctg

SEQ ID NO: 296 - DNA, 567 bp, Neisseria meningitidis
ccgatccgaccacgcccccgccgattccttcaaacggtttcccgcgttcttcccaattatcgtacattaggttctgctacggttttccgcccaatgtggcaacttggcgccctgtccgaatgttgctgcgcgctttgctgaacttcctgcccttggctttcttctttgtatgggttaaacggcaagccgttttttacatagtccttggcacatcaactccgtcacttctttcaatgccgtcccttgatgcgaatagcagggcgcatccggttcttccgccttctatacagcctgctatatattcaaaggttcttacctgccttacaccgttataaatcggcttgcttcgggtttttcggacaatgtcggaacaaacatatctgcggtaaggttgccgttatttaccgggctcgccttctgttttatccggaagtactgcctgctgttctgttgccgccgattcttgtgctggcgggttcttccgtttttttccgtaacggctcaacattttataggacaggccgacaaacacgggaatcagcaataactattacggcagagtgtaaa

SEQ ID NO: 297 - DNA, 725 bp, Neisseria meningitidis
ggccagtgccaacagtgccaagcttgcatgcctgcaggtcgactctagaggatccccggcgaccatttgggttttgaataaaggcggtgcgattttggtggagatggacagcgcaatcggggaaatcatcagttcgcctatcgtgatggcgaggacgatcagtgcgaaaaacggaaataggaatcggggaaccggaggaaataaaggggacgaatcccaaaaacgacgcgccggtaacaaataccgccatagcgaatttcagcggggttttgggctgtttgcgccccatttttgtccacattgccgccatcagtccggaaaacaggatgacccacaggctttgcatagaatctttccaagcgacgggcacggtaaacgaaccgatggtgcggttgacggtttcgtcgaaatagacggttgccacggtgtaaatctgaaaccagacggcccaaaacatacagatggtcaggaaaagcgggatgtaggcgatgatgtgccgtttgttgtcggaactgacgcgggggttggtcagcaggcgggcgaaataggcgatgacggcaaggatgacggtagataataggatgccggagaaattgtcgaggttgacaagcccggttttgatggcggttgcaagtgcggcgatgagggcgatgccgacggcggccgcagttttgccctgtccttttgaaagcggatgggggacggtggggtggggcaagttttta

SEQ ID NO: 298 - DNA, 822 bp, Neisseria meningitidis
ccttcctcggcttcctcaaaggcgtagatttcatgtggacggtcaaacatatccgacaccagcaaccccgtccgtccgaacgcaagcgcaaaggcatcatgcaccgccaacgcaaacggcagcgtcaaaaacaccagtcccgcaaacagagccgcataaggatatttctcgttcacaaacatcgccgtccccctcttccgaagcagaccgcattatatagcggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactataccgcgcactgccttgccgcccgcccgaaaagttgcacaaacaaccgttcatatatatcatgacgaaaaaacgccggtgtagctcagtcggtagagcagcgcattcgtaacgcgaaggtcgggggttcgattcccttctccggcaccaataccaagcacagaccctcccttcctcgggaagcctgtgctttttcacatttccgcttcagacggcacaaccgatatgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcctgcgacttggcatgctccaattgcaaggggcgatttactccaaggcggcggaacg

SEQ ID NO: 299 - DNA, 728 bp, Neisseria meningitidis
acttgcatgcctgcaggtcgactctagaggatcccgttacaaaagatcattaaaaaaatctttcaggaaaatgaaaaagagatcctgaaaaacattgatagaattgaacggattcaaaagttaattattggtcaagttatgcataagaccaataatcgagcaaacccccaacaagtttttataattgttgaaaatatgcttcatgaagttcgggaaagagatagctaaaaaaaatcaaattatttatcgctatataatccttaaaattcaaagctttgaatgacctgctaacacccgtatcttctcagaacgccaactagaaatccgtttcaactcctcgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccag

SEQ ID NO: 300 - DNA, 333 bp, Neisseria meningitidis
ccagtttcgatcttgattctgtcgataccgaagccccgcgtcccggccaaaatatcaagatgttttttccgaaaaaccgcaagcccgggtacgagctcgaattcgtaatcatggtcatagctgtttcctgagtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgc

SEQ ID NO: 301 - DNA, 1037 bp, Neisseria meningitidis
ggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaagaagatatagtggattaacaaaaaccagtacatcgttgcctcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatarggcgacagcaggttgtatgcsgcggttttggaaacctgataaccgcggtcggtcaggctgttggcaatctgattgaccactgcgctgaccaaagcccccaacaggccgctgttgctgttgttgctgccttcgcggatgctggccgaacccgacca

SEQ ID NO: 302 - DNA, 578 bp, Neisseria meningitidis
gacggccagcaacatatacgacggccagtgccaagcttgcatgcctgcaggtcgactctagaggatccccgcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaggtcaggaagttttagaaaaaatcgtcctatat

SEQ ID NO: 303 - DNA, 387 bp, Neisseria meningitidis
ccgcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggccgtctgaaacgataaggtttcagacggcatttctttctttatagtggagaactttggcatttttttttggctcgcttagcttgatgatacgattctctaaggtgctgtagcacaagtgaa

SEQ ID NO: 304 - DNA, 593 bp, Neisseria meningitidis
tctgcggctcgacgccttgtcctgatttaaatttaattcactatatttcatatgcttatttatctaacttttccccggtaacaaggtaacaactaagggtatcgcttcctagtataggttttttccaaaaacccaaaaaaaaccgccctgcatcttggacggtttcccccttgttccctacgtcttggcagtattccccgcaagctcttttccgcttggcattcctgatttggcggtcgttcagctttatttttgcggtattttttcgaggtatttttcagataccgcaaaagatatcgtaaattttaggttacttcaattagggcggattggacgggattgcactgtcaggaagggggacggcacgataacaatcagcctgaaatccttgtattgattgcaattggttgacagcgttggatgggattgaacaaaaaacgcctgaaattttcaggcgtttttgtctgttggtgccgacagcgagatttgaactcgcacagcctacggccactaccccctcaagataacgtgtctaccaaattcaccatgtccgcatttgaaaaactgttatttctgctgctgacgaacaaggg

SEQ ID NO: 305 - DNA, 410 bp, Neisseria meningitidis
cggccagtgccaagcttgcatgccagtgcgaagcttgcatgcctgcaggtcgactctagaggatcccccagacgcaggtacagattaggcggtgtgccgtaatcgtacgaatgccgattcaacctaagcagacatcagtatttaggaagtggatgtttgatggagcaaaggttgtacgaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaaaaacaagatagtacaatactcaactttgaaggtctaaccatggcatactct

SEQ ID NO: 306 - DNA, 555 bp, Neisseria meningitidis
gacggccagctaggaaacgacggccagtgccaagcttgcatgcctgcaggtcgactctagaggatccccgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaata

SEQ ID NO: 307 - DNA, 478 bp, Neisseria meningitidis
cccctccgaccgggaagcctgtgatttttatttcccaggcgtatatatgcgggatgaaatggtagttggggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagacggcattgcctgcgaggaaaagctggcggaactgctgtcggaatcggtcgtccgtattccgccgctgcgtatgcagcatgaagacattcccttcctgatacaggggattgcctgcaatgtggcggaaagccaaaagattgcgcctgcctcattcagtgaagaggcacttgccgcattgacccgttacgactggccgggaaatttcgaccaactgcaaagcgtcgttgcaacgctgttgttggaggcggacggacaggaaatcggcgca

SEQ ID NO: 308 - DNA, 693 bp, Neisseria meningitidis
ctggtcgggggaagtccactttgttaaacatttcaacaggtagcctaaaacctgaaactggtacagttagtattaatgggcatgatatatatcaagtttctccatcctttattaggggattgagcgggattgttcgccaagatgatgtcctttatgcaggaactattggcgacaataagccataacgcgtgatttaccaacctgttaccattgagccgcgcgagatcacgccgcgtatcgtccgtgaggagaactacggtggccaataaattaagaaactacaccatcaacttcggcccgcaacaccctgcggcgcacggcgtattgcgtatgattttggagctggacggcgaacaaatcgtccgtgccgacccgcatatcggcctcttgcaccgaggtaccgaaaaactgggggaaaccaaaacctatctgcaagccctgccctatatggaccgcttggactatgtttccatgatggtcaatgagcaagcgtattgtttggcagtagaaaaacttgtcggtatcgatgtgcccatccgcgcccaatacatccgcgtgatgtttgccgaagtaacgcgcatcctcaatcacttgatgggcatcggttcgcatgccttcgacatcggcgcgatgaccgccattctttacgccttccgcgaccgcgaagagctgatggaccttgtacgaaaccgt

SEQ ID NO: 309 - DNA, 609 bp, Neisseria meningitidis
ctggtcgggggaagtccactttgttaaacatttcaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccaaatatggagctcattgaacaatgtgcaaaaatggcacaaatacatgacgatatacttaaaatgccaatgggctatgagaccttgattggcgatatgggaaatatcttatcaggtggacagaggcttgagagttattttggagctggacggcgaacaaatcgtccgtgccgacccgcatatcggcctcttgcaccgaggtaccgaaaaactggcggaaaccaaaacctatctgcaagccctgccctatatggaccgcttggactatgtttccatgatggtcaatgagcaggcgtattgtttggcagtagaaaaacttgtcggtatcgatgtgcccatccgcgcccaatacatccgcgtgatgtttgccgaagtaacgcgcattctctgtcacttgatgggcatcggttca

SEQ ID NO: 310 - DNA, 2343 bp, Neisseria meningitidis
tgccgctgctgctgaagggcgcggacgtgttcaatacggggaatgcgcgttatgtgctgacggctatgtgtatgccctttccggcggtgtcgtgcgtcatcgggctggtggggcggttcaggcttcagacggcatcgggcagggcggcaaagtcagggggtgcgggcaaggcggacggataggacgcatttttcagcgggtgcgtcgagaagcagccgatgtgtttggcagccgcagcttggggggtgtagtgctaatggcggtttctttgcttttatagtggattaacaaaaaccagtactgcgttgcctcgccttamctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgaacgggaaagcagcagtcccagatgggcgtgcgcacccggggcggcattcatttttttgttgccggcttccacaaagtatttttccatcttttcggtctgcttgcccaacgaagtgtcgtcgtttttcaaaccttcatagacggtatcgggatagccgccgtaataatacagggatttttgcccgttgccgccgcaggcggtcagagccaagaccgccgcacacagcgacaaacggctcaaggttttcggattcatcatttctccttaacggttgggttgccatgcgccgttgtcaacagcctgaaccaggctgttgacggcttcgcggattgccaagtctaaaactttgccgttcaaagtcgcatcgtagccggaagtgccgccgaaaccgatgatttcacggttggaaagtgcgtattcgcccgcgccctgtgcggaatagacgatttcggaagtattgacgttgacgatattcagagccacttttgcataggcgatttgcgatttgccgcgacccaaaatgccgaagagctgatgatcgccgacatctctgcgtccgaattcggttacatcgccggtaacgacataatctgcgcctttcaggttatgcgctttgccggaaatgccggattcctgttttaatgcgttcaaattggtgcggttcagtacgttgaagcggttggtctgttgcaggtgcgttactagaatggtttttgcctggctgcccaaacggtcttccccgtcggagaaaatgcctttttggaagctggagcggttgtcgaatgttccgacggaaatcggggtacgaacaccgtgatattgcgtattgtaggaggcgactttctctacctcgagactgcgtgaggattcggtcgcacagccggtcagtgaaacggcagcggcggcaaggacaacggcggtggaaacggttttcataaaatttaccctaaggtcaagttaaggaaataacggggg

SEQ ID NO: 311 - DNA, 443 bp, Neisseria meningitidis
cgtattgcgcaccgtccccaaagtctccggcgtctgcgaagcgtcaaaaaagatattcccgacagcgggtcccgtcctgaccggcggagaaaacaatatcggcttcgcacaaagcaaacgcttggcggaactcggcgtcaagtccgcataagccgcgtgttcagacggcatggcgttcagatgccgtctgaacactttgcctgtataatccgcatctttactgtccaacttcgcggttcgcaaacctcccgcgttaccaaaactagggttcgatatgtcaaaccaacaagccttggtcatcttttcgggcggtcaggattcgaccacctgcctgattcaggcaatccaaacctacgggcgcgaaaacgtccaagccattactatccaatacgggcaacgcatgccgtcgagctggaacgtgcccgctggattgcgcaggattt

SEQ ID NO: 312 - DNA, 698 bp, Neisseria meningitidis
gaatatccaataagacaatatgttcttttgaaaaatacttttggwtttttcgccgaaaacaggacggttcaagttgcggaaattgtttgcaattctttaaaagcagcggcggaggtcacaatgaaatgtccgaatggggatgtggcgggcggcagaaatcatcaatgctgccgactgccatacttctgaaatctacaaaatgatgcatcgatcaaacaatataccgctttaaaaaaaccgatgccgtctgaaacgctttcggggtttcagacggcatcaaaagggtacggtcagcggatgatgccgcgcgccgattgtgcgaaaaagtctcggaatacggcaagctcggcttgggtttcggcgcggcggagaatgtctgccttggcttcttcaaacggaatgccgcgatggtagagggttttgtacacgtctttgacggcggaaatctgctctgcggtaaaaccgttgcggcgcatgccttcgctgttgagccccgccggttcggcgcggtagcccgatgccataaagtagggcggcacgtctttgtgtacgcctgcggcaaacgcggtcatggcgtagtcgccgatgcggcagaattggaaaaccagcgtgtagccgcccaaaacgacgtagtcgccgatggtaacgtgtccggcaagcgaggcgttgttggcgaaaatggtgtggttgccgatgac

SEQ ID NO: 313 - DNA, 6100 bp, Neisseria meningitidis
ttataacataacaaaatctttaacccacaccgacaaaggctgcaccatgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaatcccgcccgcacaaaaatgccgtctgaaggcttcagacggcattttttgttcaaacatcaataccaaccgcgcagtttcatcgctttttcaacacggcggatactcatcatgtaagacgcggttcgcaaatcgacatcatactcttgcgccaagttccatatatcgcggaacgcgcgtcgcaggacgacggtttctttctcttgaacttcgtcaaactcccaataatagccttgcaggttttgcacccactcgaaataggaaacgaccacgccgccgcagttcgccagaatatcaggcacgaccaatacgccgttttgacgcaggatcacgtcggcttcgggcgtagtcgggccgttcgcgccttcgactacgattttcgcgcggactttaccggcgttttcggaagtcagttggttttccagcgcgcaaggggcgagtacgtccacatccaaagccaaaagttcggcgttggtaatttctttgccgtaaccggcttcgttggtgatgaagcctttttcttggaactctttaaacaaagcttccatatccaaaccgttttcgttgtaaatggcaacgtcaacagtagaaaccgcaacaactttcgcgccggattgatgcgcgtaataacctgtgtggtaacccacattaccgaaaccttgaatggcgtaagtggcacccttcacgtccttgcccagtttttccaaagcttggacggcggcgaggttcacgccgtaaccggtagcctcggtacgcgccaaagagccgccgaactcaaccggttttccggtaaatacgcccggcgcggaatgtttcaccacgttttcataagcatccaccatccacgacataattttgccgttggtattcacatcgggggcgggaatatcgattttctcgccaatcagcggggcaatcgcttcagcataagcgcgggcgatgcgttccagttccgcctcggaataatcgcgcggatccaaggtaatgccgcctttgccgccgccgtaaggaatacccgcaacgcagcatttgatggtcatccaaattgacagggctttgacttcgtccaaattcacactgggatggaagcgcacgccgcctttataggggccgacggcgttgttgtgttgcgaacggtagcccgtgaaggttttgaccgtgtcgtcgtcgagtttgacgggaaaattgacttccaacacgcgggtcggactcttcaggatttcataaacggccggatcggttttcagccggtcacaggcggttttcacctgtttgcgcgcgatttcaaacggattgagggtttcttttgcaagggcttcagacattttgcttccttttcacaaagagaggttcggaatggaacaagccatcaggttcgcaactataaccaattttcaagcaaaatgtaatagcgtgtagttggaatcggcccgatttgattaatctatatatgattttatttcccaagccgcacggaatccgtctgaaaaaagcggaacacatatccaaaaagcaaatgtccaattaaataaagatataagaatccttttattttttaaaaatttaattggaacggcgccgggatttgcacacccttcccgactccgttccgaaatccggaaacaccgccggcaaaacctgtttcgattgttaacaatccatacattagaagccctgtgcaaacgatgttaaaataaaccttttcaacccgacagaaaaccggattatgaatgcagccatcgaacacgtccaagccgtcgccttcgatttggacggcacactgtgcgattccgtccccgaccttgccgccgccgcagaagcgatgttggaacaactcggtatgaaaccgctgcctgccaaagtggtcgaaagctatgtgggcgacggcatcggcaaactggttcaccgcgtcctcaccaacgaccgcgaccgcgaagccgattccgaactgtgggaaaaaggtttcgtatctatatgaaatactaccgcgaccatttgagcgtcttcacccgcccctatcccgaaaccgaagccgggctggcattgcttaaatctttgggcatcccgctcgccgtcgttaccaacaaaaacgaaatccttgcctccgagcttctaaaacaactgggactcgccgactattttagcctgatactcggcggcgacagcctgcccgagaaaaaacccagccccctgccgctgcggcacgccgccgaagttttgggtatcgatgttgcaaacatggttatggtcggcgactcgcgcaacgacatcatcgccgccaaagccgccggctgcctgagcgtcggcgttaccttcggttacggcgatatgacgctgctctcgcaagacgatgcgacccgccccgactggattatcggctcgctgcccgaaatttacgaaaacctgcaacctcagaaaaacaaagaagagtaggcattcggacggctccggtttgcgccgctatgccgtctgaaacctgccccacgccgaaaccgccgccatgaaaccgcaaaaatccctacgcgcccgcgcgatggacatcctctcgcgccaagaactcagccgcatcggtctgaaacgcaaacttgcaccgcacgccgaaagcgaagaggagttggaaaacgtgttaaacgaatttgccgaacgcaactggcagtcggatttgcgctatgccgaagcctatatccgcagcaaaagccgcaaacacggttcattgaggctgaaacaggctttggcgcaacagggcatagatgaagaaaccagccgcaacctgcttcccgaccgctcaagcgaaaaactggccgccatagccgtgttgcgtaaaaaattcaaacatccggccgccgaccttaaagaaaaacaaaaacaggcacgcttcctcgcctatcgcggttttgatgccgataccgttcagacggcattgaaacatgcctgggatgacggctgggaggaagactgctgaactgaatccttgaatctttttgcatgacggcgtaaccttacctccatttccaacttttccgattgagaataaaatgtccgaacaatccgagaaaaatcacaacccacttcttgaagatgaacgcaaaaacccggtttaccgtatgggtcaggcagttgccggattcatgctcgtcgtttgggcaggcgtattggcactcgtgtttttcctagtcttccgtttttggctttcctaaacaaaatgccgtctgaaaccttcagacggcatcggcagcccatttcggcaggctatcccatcatagctttttttagcttgaattccactttcccattccctaaaatttttccacacccatttcaaaataccctttcttaaaacaggtacactatgacacaacaacgccaactgccttcgcacgaactcattatgtccgaactgatgatgccggacaccgccaatttcagcggcaacgtacacggcggcgaactcctgctcctgctcgaccaagtcgcctattcctgcgccagccgttacagcggcaattattgcgttaccctgtcggttgacaaagtcctgtttaaagaacccatccatgtcggcgacctggttactttctacgccagcgtaaactacacggggcgtacctctatggaaatcggcatccgtgtcgaagcacaaaacatccgtacgggagaaatccgccataccaacagctgctacttcaccatggttgcagtcaaagacggcaaacccgtccctgtccctccgctggaaatcctgaccgaccgccaacgctgccgctacgaaaaagccaaaaaacgcagagacatcagcctgcaagcctccggagacgtgtcctgcggctgctgacggcggactatgccgtctgaaagacaggcacatcgcgccatccgtttccattgcaaacggatgaaatcaagcaaatatagtggattaaattcaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatacccaaacacagtcaaacaaatttatatgccccatcccttccgaataatttgaaaacacagccgccaaaaacaaaaatgccgtctgaaaacctttcagacggcatttccaacttgatttcaggcagaaagtcagaacgcgatatagctgttcgggttaaccggtttgccgttttgacgcacctcgaaatgaagctgcgttctggaagcatcggtattgcccatcaaagcaacctgctgaccgcgtttgacctgctgcccctcgccgaccagcaatttttggttgtgcccgtatgcggtcaggaaagaagaattatgctggatgatgaccaagtttccgtatcccctcaaacctgaaccggcataaaccactttgccgtcagccgccgccaaaacgggctgtcccgcattaccggcaatatcgacacccttgttgttgccgccgaaatcggcaaccactttaccttgcgtcggacgctgccaaacaatgccgccgaccgaacgcgtgccggaaggcgaagcggcaggagattgcggggcgggcgcgggaaccgctttattttccgcagcgggcgcggcaggttgcggcgcggactgcacaggcggttgcgcggcgggtttcacaggggtttgcacggcagccggtacggcgggcctgctttctacggctgcggttttcggtgcggcatatcctgccggtttgactttaacaatctgaccgatgctcaacatattgtcggtcatgccgttccacgcacggaaatcgtcttgagagatatggtagcgtttggaaatgttgtacaccgtgtcgccgcgcacaatagtatgcgtcgccgcgttaatgtcgacgggtgcggactgtacgggcggttgcgcggcagccggtacggcgggcctgctttttacggctgcggctttcggtgcggcatatcctgccggtttgactttaacaatctgaccgatgctcaacgtattgtcggtcatgccgttccacgcacggaaatcgtcttgagagatatggtagcgtttggaaatgttgtacaccgtgtcgccgcgcacaatagtatgcgtcgccgcgttgatgtcgacgggtgcgtaagaaggaacgtatgtacccgaaacggcaggtgcagacggcggaacataagcaggaggcgtataaaccggcgcgctttgcaccggcggcaca

SEQ ID NO: 314 - DNA, 219 bp, Neisseria meningitidis
ccgtcaaagccaccggcggcaacagcgcgttgggcggcgacgatttcgaccaccgcctgttctgccgcctgctcgaacaaaacggactctcccaactcaacggacaagacagccaactcctgctctcggtcgtccgcggcggcaaaggacaatttaccacgcaaaccgaagcgcggattcaggcgacggtttcagacgggattggaatcgacacaagca

SEQ ID NO: 315 - DNA, 393 bp, Neisseria meningitidis
atgacgacgcaggcttcgtctatcatacaggtttcgtggatttcgggcgtgcggttttggaaagttcggattgcgttcatttttcctccttcggtaaggtatatattgttaaaggatttattaaatattccccctgattgcttttaaaatcctgcctgttatatcgaccccgagtaatgttattatcgggaatatcagcttatatatcattttattggacttttacagcataaaccttaaattatacgcccttctttttatatcagcatcacactctatattttttctcgtcattataaaaagcaaaacgagatattcgtaggatagataagaataaagataactcgatatatccctattattttccatttccgcatttttttccaaaatata

SEQ ID NO: 316 - DNA, 730 bp, Neisseria meningitidis
  misc_feature (536)..(536): N is any nucleotide
caacaaagcaatctagaaacccgtcattccggagcaggcgggaatccagacctccgacgcggcgggaatctatcggaaatgactgaaaccccgagattctagatttcacttccgtgggaatgacgtggtgcaggtttccgtatggatggattcgtcattccgagcaggcgggaatccagacccccgacgcggcgggaatctatcggaaatgactgaaaccccgcgttctagattcycacttccgtgggaatgacgtggtgcaggtttccgtatggatggattcgtcattcccgacaacaccgtaatctcgaaattcgtcattccgcgcaggcgggaatccagccccctgacgcggcgggaatctatcggaaatgactgaaacccccgagattctagattycacttccgtgggaatgacgtggtgcaggtttccgtatggatggattcgtcattccgcgcaggcgggaatccagacccctgacgcggcgggaatctatcggaaatgactgaaaccccgcgttctagactccacttcncgtgggaatgacggttcagttgcgctccgacaacaccgtaatctcaaaacccgtccgacaacaccgcaatcttgaaacccgggattccgcayaggcgggaattcagacctgtccgcacagaaacttatcggataaaaacagttgcccaaaccacgcgttctatagtggattaaattcaaaccagtacggaattg

SEQ ID NO: 317 - DNA, 1276 bp, Neisseria meningitidis
ggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaatakgccgaaatcggcataatcccttataaatcaaaagaatakaccgrkatakggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgt

SEQ ID NO: 318 - DNA, 556 bp, Neisseria meningitidis
acctgcctatgatttgctctgccacttgggctttgccgtcaaaatgcgtgtgggtgtggttgtcgatttgtttgtccaattcgtcaatcagccggtcaaaatgggcaatcagttgtttgacgctttcgacttgcgtttcatgaacctaatgcagacggtttttctcggcagtccgcatatccaccagttggttgcggcggttaaccaaggcttccaacacttcttccacttcggtgggcaggtggaagggcattgtttgcgaatctgccgtcggtaacgtcatctagaactttaatggcggtaagctagagcatgttcggagtgggaagtaccgtttttaccggtgaaaccttgaaccaatactttagtgtctttattaatcaatacgctcattcttttctccttaggcgtttacggctgcaacaattttttcggctgcgtcattcaggccgtctgcagaagtcagtttcagacctgattcgttcaggattttcgcgccgagttcggcgttgttgccttccaaacgaacaacgacaggaacgttgacgttgatttc

SEQ ID NO: 319 - DNA, 3986 bp, Neisseria meningitidis
ccgcttttgaaaaagacgttttaaatgcagatatccccgtcctgctggacttttgggctccgtggtgcggcccctgcaaaatgattgccccgattttggacgacattgccgccgaatttgaaggccgtctgaaagtggtcaaaatcaacatcgacgacaacgaagccaccccgtcccgtttcggcgtgcgcggcattccgaccctgatggtgttcaaaaacggcgaagtcgtcgccaccaaagtcggcgcattggcaaaaggtcagctgaccgcctttgtcgaagcctctatcgcctgataaagcgcaatcgaaaaagccgccggaagattccggcggctttttcgcacccttaagatttgtggcggatttcccagcacctatggatttttttgttgcggaaatcttcgggaacggattgtttggaaatgtctttgacggcgtattgttccgataccaagtcgtctaagacgaagctgcgcaggttgttggaaaagtacaaaatgccgtctgaagcgagcagcttcaccgcgccgtcaatcagctttttgtggtcgcgctggatgtcgaggatgtcggacattttcttgctgttggaaaaactgggcgggtccatcacaatgaggtcgaaccgcctgccttccccatatgccgtctgaagatattggaacacgtcggcgcggacgattttgtgtcgttccgtatcgatgccgttcaattcaaaattgcgtttcgcccaatcaagatatgtgttggacaaatcgacggtttcgctggatgccgcgccgccggtggcggcatagacggtgaagctgccggtgtaggaaaacaggtttaaaaaacgtttgcccgccgccgtttcgccgacttttttgcgcgtgtttcgatgatccaaaaaaagccccgtatccaaatacttatcaaggttgacccaaaacttgcggccgttttcggtgatgacgaaatcgtcgcccgccttgccggttttctcgtactgctgcaaacctttttggcgttcgcggcgtttgaggcggatttgttcgggcgcaaaaccggtaacgaaagcgacggcttccaagacttcggcaagccacgcttcgtattcttcgggccgcatcagccagccggtatcgtattcctgaaggtggattcgatcgccgtaaacatcggcggcaaaggggaattgggggatgtcgcggtcgtaaatgcgccaggcttcgatgccgttgcgtttcgcccatttcataaggtgtttgatgtttttgcccaagcggttggcaaacggtgtgatgtcggtcattggtttcaggcggaataaagtggaaaacggcaattttactgtaattaacgcccgattgcttgaccgtttcgggcaaaccctataccatccgtcgcttatcttgtcatacgaagccatcgccttccaacctaaaccgcccttacgggcgcgtttcttctgttgctttgattttgcaaagcatatctgtgcaggttgccgtcgatgtaaaccacaagcaagccgcttgcgacaaccctgtaacttcacattccccgtatcgttacccttccctgcttcaggccgtctgaacctttcggacgcgggcgttgttgtcttccaaggatagccatgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcaaaaactgaccaaacgcagcgaaaaaccgggcaaaggcccgcgtgctttggtgttgaccccgacccgcgaactggcggctcaagtcgagaaaaacgcgctggcgtatgccaaaaatatgcgttggttccgcaccgtcagcatcgtcggcggcgcgtctttcggctaccaaacccgtgccctgagcaaaccggtcgatctgattgtcgccacgccgggccgtctgatggacctgatgcaaagcggcaaagttgattttgaacgtttggaagtgctgattttggacgaagccgaccgtatgttggatatgggctttatcgacgacatcgaaaccatcgtggaagcaacgccgagcgaccgtcagactttgttgttctccgccacttgggacggcgcggtcggcaaactggcgcgcaaactgaccaaagaccctgaaatcatcgaagtcgaacgcgtggacgatcaaggcaaaatcgaagaacaactgctgtactgcgacgatatgcgccacaaaaaccgcctgctcgatcatatcttgcgcgatgccaatatcgatcaatgcgtgattttcacgtccaccaaagccatgaccgaagtcattgcggatgaactgtacgaaaaaggtttcgccgcaaactgcctgcacggcgatatgccgcaaggctggcgcaaccgcacgctgatggatttgcgtaaaggccgctgcaaaattttggttgccaccgatgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaagccccaacctgccgcataaaccaatgccgtctgaaaccgatttcgagtttcagacggcatttttgcaatgtttcagcaccgcccggctttgatacccaaaggattaggctgtaataaaaacccttttccgctttggcaacgattgaaaatttccgtaaattcaaatatctagattccttcctgcacgggaatgacacggaagggtttcagatgcagggtgggcattcctgcccacccaatcccgcccttgcaacggtgggcaagaatgctcgccctacggcttgactgttcgatatgatgccgtctgaaaacccaacggcggcatgacaatgccaccctgccaacgcacgtaaatcagaattgccatcccgacatcaaacgcttggaaacaaaatgccgtctgaaaatcaaacggcaacataacaatgtccctaacaaatgcaaaaatgccgtctgaaagctcttcagacggcattggcgcgccgggtttaccgcctcctgccgaaaccgcgcatagcggggcggcggtaattggcgggcgggcgcgttgtcgggcggtaacgctgcgcctgcgccgcctgttgttttgcacggaggctgcgcgtgttcaaatccctgctggtgcgcgcattggggcgtgcggactgatggtaggctgcacgcgcgcgccgggcgacgggactgtcttggttgcctgcccgtgtgaatttgtttgccagcgcgttgccgataaacgcgcctgccgccgcgccgaccaggctttgcagcagccagcttcctgtcgattggtcgtaaatatactgctgcccgtctttaccggtaacgggttgcccgttgttgccgtttgcctgtgcttcggcaggaatggtgtctttgactgcttcgggagtcagttggtaaaccgtatcgtctgcctgctgtgcgagctgctgttgcagggcttcaatctgtttctgctgctgttcgagccg

SEQ ID NO: 320 - DNA, 133 bp, Neisseria meningitidis
cacctgcacgcacaattcgtgtttccaacgttttgccgataaagggcatgatttcggagtgttcgccgcgattcaccatcgcaatttcctgcagaccggcgatttcttcaatgaaacgaacgcaacgggtgca

SEQ ID NO: 321 - DNA, 194 bp, Neisseria meningitidis
tcgcgcacgatgatggggggcagttctacggagatagggttgccttcgtagaacgttactatcgcattggtcgtccatgccgtcaacgatgaagttcaacgcgatcgggacgcttaaagacggttttggcatcgccgtcgtcccgcctccgattctggagttgggcaacggttcgggtctgagcatcaacctgc

SEQ ID NO: 322 - DNA, 741 bp, Neisseria meningitidis
caaaaactgtacgtacagctagtttgcagacccgatgtacgtctttatggacgaagaattcaaccaatatgaaatcgaagttgacaacattggcgatcattttaatttatcgggtatagactatttcggcgaggacgaagatatagatttccacgattgaatacatggaagccaagtacgtctatcaacactatattaaaacacagccttttattttgaggtttggggtaatttttaaaccgtcattcttacgaaaacagaaaatcaaaaacagaaatctcaaatcccgtcattccygcgcaggygagaatctagacattcaatgctaaggcaatttctcggaaatgactgaaactcaaaaaactggattcccactttcgtgggaatgacggaatgtaggttcgtgcgaatgacgtggtgcaggtttccgtatggatggattcgtcattcccgcgcaggcgggaatctagacattcaatgctaaggcaatttatcgggaatgactgaaactcaaaaaactggattcccactttcgtgggaatgacgcgattagagtttcaaaatttattctaaatagctgaaactcaacgcactggattcccgcctgcgcgggaatgacgaagtggaagttacccgaaacttaaaacaagcgaaaccgaacgaactggattcccactttcgtgggaatgacggaatgcaggttcgtgggaatgacggaatgcaggttcgtgggaatgacgg

SEQ ID NO: 323 - DNA, 397 bp, Neisseria meningitidis
tccacacaacgtcaataattccaacacaaaatacgccaaccgcattggtttgacacgccagcaaccgctttttgcttcacaacagtgatattgtgttggcttttccgtttaaagattgtgtgttaaatggcggacaaagcaccgaggaaggcgaagaaatttattttaaacgcaataacagccagccagccagccagccagccagccagccagccagccagccagccagccagccagacagtcaaccagccagacagccacttataacaaggcgaagacagcaaaaaactgcccgaaatgagcgaaggcgacaaattgcccgtggacaaactctacggcgaacaacactttaccactccgccgccacgctacaacgaagccacgctggttaaagccc

SEQ ID NO: 324 - DNA, 920 bp, Neisseria meningitidis
cgcgataaagagcacgttccggtttcgatttacttagttaacggtatcaaattacaaggtcaggttgagtctttcgatcaatacgttgttctcctgagaaacacttccgtcacccaaatggtttacaaacacgccatttccaccatcgtaccggcacgctccgtcaacctacaacatgaaaacagaccccaagccgcaccgacttcgaccctcgtccaagtggaaaccgtccagcagcctgccgaataatccgcacgaagcatgacgtgtcatatctttcaataccttaccggacaacggtaaggtatttttattttcagacagcatttaaaaatgttattgcaaaacatccttccattcgcccattgccttttgcggaaggcacttcccgaaggtggcaatgctttggacggcaccgccggcaacggacacgacacccttttcctcgcacaaaccgcaggcatccgggggaaagtgtgggcattcgacatccagccgcaagccctgaacaacacccgatgccgtctgcaggaagcaggttacagcaatgtacggctcatcttggacggacatgaaaacctgaagcaatatattccaaagccgctggatgcagccattttcaatttcggctggctgcccggcggggacaaaagccttaccacccgcacggaaaccagcattgccgccctttctgccaccttatccctactgaaagaaaacggtatgcttattgccgtcctctatccgggacacgaaaacggcaaacaggaggcagaagcaatcgaacaatgggcaaaaaacctgcctcaagaacagtttgccgttttgcgttacggctttaccaaccggaaaaacagcccaccctatcttttggtatttgaaaaactgcgtcaaaaataactgtttgcggtaaaataagc

SEQ ID NO: 325 - DNA, 1177 bp, Neisseria meningitidis
  misc_feature (1169)..(1169): N is any nucleotide
ttggaagccttctgcaaaggtcaggacacgcttgcgggcattgctgaagacgagccgaccggatgccggtcggtcgtgtcgctgaacaatacctgtgtcgcgctggcatacccgaaagccttgggcgcgctgcgtgtcgacaacgccgtcgtgattacttctccgcgttttacgagcgttcatcaggtcgcactcaaccagtgcatcaaaaaatacggcgtacagggacaatgcggcttggaaacagtgtattgcacatcttcttcttattacggcggaactgtgcgctctttgattcaaaatctcaaataaaacggaaaatgccgtctgaaagatgttcagacggcatttctatatcgacggtcaggattctttcggatcgggcagcaggctgttcaacataatggcaagtacggcgcacaagcccacgccggcaaagctgaagctgcccaatttgagcgtcatgccgccgatgcccgtggtcagtaccgagctgacgatgaccaggtttttcggcagcatcaaatcgactttggcatcaatcagcgttttcacgcccaaagaagcaatcgtgccgaacagcagcagcataatgccgcccattactggcatcggaatggaagccaaaaacgcattgaatttgccgaaaaacgccatgcagacggcaaaaaccgccgcccaagtcatgatgacggggttgctgtttttggtaatcatcaccgcacccgttacttcgccgtaggtcgtaaccggcgggccgccgatcagacccgcaacgcatacgcccaaaccgtcgcctgcaagggttttgtccaagcccgggtctttcgtatagtctttccccgtcacattgccgattgccatgatgccgccgatgtgttcgatggcgggggcgacggcaacgggcagcataaacagtgcagcctgccagttgatctgaggcgtttcaaaatggggaacggcgaaccagggcgcgtgtgcaatgcttgccgtgtccaccagtcccatcagcagtgccaaaacataacccgaagcgacaccgatcaagatgggaatcagcttcatcatcctgctgccgaaaaccgatacgatggcggtaacggcaaaggtaaagccggaaagatcagcgaatcggtatagtcgatgacctgtttgccgtccgcctgacncattgcca

SEQ ID NO: 326 - DNA, 400 bp, Neisseria meningitidis
aaaaattgggtggttttaccaaaawtttaaggggaattttaacaaattattaacgcttacaatttgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctmgaggtcgacggtatcgataagcttgatatcgaattcctgcagcccgggggatccactagttstagagcggccgccaccgcggtggagctaccagcttttgattacccttatagtgacgggttaatt

SEQ ID NO: 327 - DNA, 870 bp, Neisseria meningitidis
  misc_feature (867)..(867): N is any nucleotide
ttgaagaaatatgcaggggagggtatatgcggatttttactttcagcttaatgtgtmtcaaatcgggtgtggggtatgtatagtggattaaatttaaaccagtacggcgttgcctcgccttgccgtactatttgtactgtctgcggcttcgtcgccttgtcctgatttytgttaatccactataaaaagccgcatcgtgaaaagatgcggcttcaggtatcggttggattattcttcagaaccggtgtaaggacggatgctgacagttttacggttcagcgcgcctttggttttgaattcgacataaccgtcaactttggcgaacaaagtgtggtctttgcccatacctacgttgtcgcctgcgtggaatttggtaccgcgttggcgtacgatgatggaacctgcgggaatcagctcgttgccgtaggctttaacgcccaagcgtttggcttctgaatcgcgaccgttgcgggtgctgccgcctgcttttttacttgccatttgtaatgctcctaagttttaaggttaggcgattgccacgatttcgatttgggtgaaattttggcggtggccttggcgtttttggtagtgtttgcggcggcgcattttgaagatgcggactttttcgccacgaccgtgtgccactactttagccgttacttttgcaccttcgataaagggtgcgccaacttttacagattcgccgtcagcaatcatcaaaacttcggtcagttcgatttggctgtcgagttcggctggtatctgttctactttcaatttttcgccgacggaaactttatactgtttgccgccggtttttacgaccgcgtacatactcaactccataagggttatggttaatatccnggg

SEQ ID NO: 328 - DNA, 1225 bp, Neisseria meningitidis
gtaagattcaccgtctggaagactggggtcgccgccagctggcttacccgattaacaaaatccataaagcccattacgttttgatgaacatcgaaaccactcccgaagtggttgaagagctggaaaccgcattccgcttcaatgatgcartattgcgtcatctgaccatcaaaaccaaacacgccgttaccgaagcatcccctatgttgggtggtgaaaaggctaagaacctgttgagcggtgcgtctgaagaagcggtcgcccaataattgggattcaataatcttgtttcgcttgccgcgttaattgaaaaggttttccctattcgatatacgcctgccggaatccctgttttagatattattttaaagcacgaatcgtggcaggaggaaaacgggcagcaatgccttgtccaattggaaattccggcacggattttaggcaggcaggcggaagagtggcagtatcggcaaggtgtatatgttcacgtcgaaggttttttagctcaaaaaagcagacgttcccttatgccgatgctcaggatacaaaatattcaagaatataaaggttaaacgacaatggctcgtcaatcattcaaacgtagaaaattctgccgtttcacggctgaaaaaatccaagaagtcgattacaaacaagttgatttgctgaaagacttcatctccgaaaacggtaaaatcattcctgcacgcatcacaggaacgaaggcattctaccaacgccaattggctgttgccgtaaaacgcgcacgcttcctggctctgctgccttacaccgaccaacacaaataattttggagattgaatcatgcaaattattctgttagaaaaaatcggcggtctgggcaacttgggcgacatcgtaaccgttaaaaacggctacgcccgcaactttctaattcccgcaggtaaggcaaaacgtgcgaccgaagcgaatatgaaagagtttgaagcacgccgcgcagaactggaagccaaacaggctgaaattttggcagatgcccgagtccgtcaggaaaaattggacggtcaaaccgttaccgttgctcaaaaagctggtgtggacggtcgcctgttcggttccgttaccaatgccgacattgctgctgcaatcgttgctgccggcatcgaagccgtgaaagcaaatgtacgtctgccgaacggtcctctgaaagccgttggcgagtacgaatggaagtggctttgca

SEQ ID NO: 329 - DNA, 549 bp, Neisseria meningitidis
ggagcgatgtagccccattcggcgaggacggtcgtcataccggcgttgcgccccgcctgtatatcgcgttccgcgtcgccgacgtagagtgtgtgttgcgggtcggcgtggatttgtccgcacgcatacagcatgggtttgacgctgggcttgggctcgccgcaggtgtcgccgctgacgacgacggcgggtgggatgatgaagccgagtttggggacgagtttgtcggtgaagcgcatgggtttgttggtgatgatgccccatttgatgccgcgttttccgagttcggcgatgagttcgtttacgccgtcgaagagggtggtgtcttgggcgtagcggctgtcgtaatccgcaagggaatccggtgcgcaatcgggcatagtcgggatggtcgggggtgatgcctgcgccgagcttgatcagtcctgccgcgccgtggctggcttgggtgcggatttcgtccatgctttttgcaggtagtccgtggcgggcgagcaaggtgttgagtgcgccgccgaggtctaaggcggtgtcggcgagcgtgccatc

SEQ ID NO: 330 - DNA, 889 bp, Neisseria meningitidis
  misc_feature (21)..(21): N is any nucleotide
acgagccgagcaaccatttgngatatcgacgcgatgaatccggcggcaaggtttgcctgatagcagacgaacaccagcccgacatcaagctgtccgcttgaggcgagtccgcgcgaatagctgtaggcgcggcggaagaggcggtgttttttgaggaattcgggatcgcgcggattcgccaggcgtatatggctgtctttgggcgtgatatcaccctcggggtctttggcaaaatccggttggtcggcttcttttttgccgtccatcggcgcaccgctgtatttgcgccgcccgaaaatgtcggtttgctcttgaagcggcgtcctgtcccaaaactcgacaaagtggcggataaggcggactgcctgatagctgccgtttttcgcccactccggttcgtcgaggctgttggcggccacccccgtccacaaaacctcgtcggcagttttgggatcggaaactttggggttgcccgtgccgtccctgaagcccaacaggttgcgcgccgccatcgcgccgggttcggatttgggctgccacccgtcgatactccaacggataacggcggtttggacggtgtgtttgatgatgtcgcgcaggcggcttggcaggtttcgggggtgaaggcacagatttgcaggctcaaatcgccgtcgcaccagcttttttgcagcttatcgttggagaagtcgcgcatttcctgcaaatgaatcggttttttgtctttgagtccgaaccggccgtcaaacaggctgctgcccacccccacggtaacggtcaacccgtcggggttgaaggctttgcccaaaatgccgctgccggctggcggaagtttgtcgtcgccgtcttggtaatcgccgcctttggtgagaaactcgatgcgggcggt

SEQ ID NO: 331 - DNA, 596 bp, Neisseria meningitidis
aaaaaccaggtttggcatcctccaataaagaagcgcgcggctttgcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtgctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatc

SEQ ID NO: 332 - DNA, 748 bp, Neisseria meningitidis
gccggcggcggaagaggcgttttcaaagttcaaatggaaacgttgccgctkcaaawamagcraktgtacaccgtcaaaaacgtatagtggattaacaaaaatcaggacaaggcgacgaagccgcagacagtacaaatagtacggaaccgattcacttggtgcttcagcaccttagagaatcgttctctttgagctaaggcgaggtaacgccgtactggtttttgttaatccactataacgcaagcaccgcaaagccgcgccaaccctctcccaaccttttttcagacggcattttcggtaatctgctaaaatcgcccgcttgagtttccacagaaaaatccgaaaaatgaatattttttacgaagagtccggccaattcaaaatcgccgccatcatccaaaaaaacgatgccacctaccaagtcgataccccacacggcaaacgcaccaaagtgaaggcgaacaacgtctttgccgagtttgacggcgatatggcggcgtttttggaaaacgcgcaggcacaggcggcggacatcgacaccgatttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaa

SEQ ID NO: 333 - DNA, 116 bp, Neisseria meningitidis
tgggcagagaattgtgttcatgtctggcattgatttttcctgtcccattatcatcgtcgttaaaagagtatttcccattttgacgtggttcgtagaatactgaatgggtatactcc

SEQ ID NO: 334 - DNA, 507 bp, Neisseria meningitidis
  misc_feature (439)..(439): N is any nucleotide
ccccgtaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgtgtggacgacttaaactgaaagcgggtccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatganattatggacacgccaaacctataaatacatcgacgatgccgagatcgaagtacaacgccgccgctctg

SEQ ID NO: 335 - DNA, 1638 bp, Neisseria meningitidis
cctgaaacgctggaagccaaaatgctgaccggcaaatccggttacgatttggtcgtgccgggcatcgccttcctgccgcgccaaatcgaggcgggcgcgtatcaaaaagtcaacaaagacctgattcccaactataaaaacatcgatcccgaactcttgaaaatgctggaaaccgccgacccgggcaaccagtatgccgtcccctatttctccggcgtgaacacgattgcgattacggcgaagggcaaagagcttttgggcggcaagctgcccgaaaacggctgggatttgctgttcaaacccgaatacacccacaagctgaaatcctgcggcatcgccctgtgggacaccccgagtgaaatgttcccgattttgctgaactacttgggcaaagaccccaaaggctcgaatcctgaagacttgaaggcggcggcggaagtgttgaagtctatccgtccggatgtcaaacgtttcagcccgtccatcatcgacgagctggcacgcggcgacatctgcctggcggcaggcaacggcggcgatttgaacttggcgaaagcacgttccgaggaagtgaaaaacaacgtcggcatcgaagtgctgacaccgaaaggtatgggcttctggattgagtcttggctgattcccgccgatgcgaaaaacgtcgccaatgcccacaaatacatcaactacacgctcgaccccgaaatcgcggcgaaaaacggcatcgccgtaacctttgcccccgccagcaaaccggcgcgcgaaaaaatgcctgccgagctggtgaacacccgttccatcttcccgaacgagcaggatatgaaagacggtttcgtgatgccgcaaatgagcacggatgcgaaaaaactgtctgtcagcctgtggcagaaaatcaaagtcggcaccaactgatttgaagcattaaaaatgccgtccgaacgatgttcggacggcattttatattggattgaaatagaaatatttatatagtggattaacaaaaatcaggacaaggcgacaaagccgcagacagtacaaatagtacggaaccgattcacttggtgcttcagcaccttagagaatcgttctctttgagctaaggcgagccaacgccgtactggtttttgttaatccactataccgtcgttcccacggtcaggatttcagattgcggacatctgtcagaaaagacaaaaaaccttccgccgtcattccctacaggcgagaatccgatccgttgaaattcggttgttttaaataaattcttgcagctttgattttctgtttttccgataacgccgtaactttgaaacgcgaaagcggtaatccgatccgttgggattttgcaacttcaaatcaatccgcaaactgaaatcccgtcattcccgcgcagtcgtgaatccgaacgcgtccgcacgaaaacctgcatcccgtcattcccacggaagtgggaatctaggacgtaaaatctcaagaaaccgttttatccgataagtttccgcaccgacagacctggattcccgcctgcgcgggaatgacgaaatttcggcgagccgtagggtgggctgtaaggtcggcgtccagcccgaaatgtttgcggttgcccgcttcggcgcggacttcaaacaatggcttgcg

SEQ ID NO: 336 - DNA, 159 bp, Neisseria meningitidis
cttagatctcataccatgtcattgtgacttaccctccaggaagcttcctcactctgagaaggccccattatttgttttttccaagatgctgactggtaaatatttctaggaaaaaatagaaatgattctactttgtttgtctataaattcatcgtcctt

SEQ ID NO: 337 - DNA, 590 bp, Neisseria meningitidis
cttcagggtactttgaattttttttcaatatatctgccatatgtttttgttagccgaatttttaggaataccaaccaacgccaggagtataaaaatgattgaacttcaacttcatgaattgaagctggtttcagggggaggtcctgtaacagacaatatagctggaaatgtagctaatgctgccacaaccaaaggaggtcccacatggggggatttggttgcaatacctgctgccgcagcggcagtttattatctgccgaaaaatgcttacggtgctgctggtgcaaatggtgtatacaatgtgactcgtaattgggtaaatgatgccgttaatgcacctccttataacggaagaccaatctttgagattgaacatggattaactgctcccgcaacaaaagcagataaatcagggaacggctacactgacggtacagattactgctgatatttctcatcgtccagacaatctctaggggtcgtctgaaactttcttaacttcaattttatgaatagacccaagcaacccttcttccgtcccgaagtcgccgttgcccgccaaaccagccttttttttttttttttttttt

SEQ ID NO: 338 - DNA, 273 bp, Neisseria meningitidis
ccgccggattttctcctcttttaatatagtaaaattcatgacccctatgggattttcaggaatatgtcttttatcttcataagcctcgtattcaggataggcagatggcatttttttaaccccgtaagtgagcaatctttctcccatagtcgtgcttaaactacacgcatcttttcggataacaatatcgtccacgctatccaaaccgtcgcgtagaaattggataaagtgcgctttgttttgctggatgtatggctcgagcacccagccttg

SEQ ID NO: 339 - DNA, 334 bp, Neisseria meningitidis
tggagtacccgcagaagaaatctgggcattgccatttcaacatatcgccgccggctttcgcgctataccacataaagggcagggacgcggcaagcagccagtggaaaaggcgggtggggatgtcccagactttggttttgtttttcataatcggtttccggcggtagaatcggtttgttttcgagccttattttaaccgattggaggggcaatgtttcccgtttttcatctttcatgcgagagccgccgccagatgcttcagacggcattgcgttttccccatgtgttcaaagcccgtgcggaagattcggacatagggactttcggcacgctc

SEQ ID NO: 340 - DNA, 435 bp, Neisseria meningitidis
cctgcccggtgctggaaggttaattgaagatgtgagagcatcggatcgaagccccagtaaacggcggccgtaactataacggtcctaaggtaacgaaattccttgtcgggtaagttccgacccgcacgaatggcgtaacgatggccacactgtctcctcctgagactcagcgaagttgaagtggttgtgaagatgcagtctacccgctgctagacggcaagaccccgtgaacctttactgtagctttgcattggactttgaagtcacttgtgtacagatacgtgggaggcttagaagcagagacaccagtctctgtggagccgtccttgaaataccaccctggtgtctttgaggttctaacccagacccgtcatccgggtcggggacagtgcaaggtaggcattttgactggggcggtctcctctcaaagcgtaa

SEQ ID NO: 341 - DNA, 619 bp, Neisseria meningitidis
  misc_feature (497)..(497): N is any nucleotide
ctcggtacccgagcattacgaattcgagctcggtaccctgcgacagggcggcaatcaggcggttgcggcgcggaaaattgccggcatacggccgcgtgccgatggggaactcgctgacaatcaatcctttttcggcgatttcataggcaaggtttttgttgaccggcggataaatgcggtctatgcccgtcccccacacggcgatggtgccgccttctgcctgcaacgcaccctgatgggcggcggtatcgatgcccgaagccatacccgacacaacgggaatgcctttcccacccaacgacttgccgaaatctttggcaatccgcatcgcctgcggcgtggcatgacggctgccgacgatggcggcggaaggtttgtgcagcagttgcacgttgccgcgcaaaaacaaaaccggtggcgcggtcagcccctgcgtcagcatttcgggaaaatcttcatcctgaagcagcatcaggcggcatccgtcacgcatttcncattccaatgccgcttctgccgcctgccgcgccagagcgcgtttttccgcattgcgccaagcctcaagcgcctgtttgtgccgtatcagtgccgccaactgttccgccggtgcggacaaggc

SEQ ID NO: 342 - DNA, 1296 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctgaaacaccgttatgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccctgcttgccgaactcaaccgtatcgaggctgatttcggacgcgaacgcagcttccgcaacgcgccgcgcacattggatttggacattatcgactttgacggcatctccagcgacgacacccgactcaccctgccgcatccgcgcgcgcacgaacgcagtttcgtcatccgccctttggcagaaatcctccctgattttgttttaggaaaacacggaaaggttgccgaattgtcaaaacggctgggcaatcaaggtatccgtcttttaccggacaggtaattccgcacgcggatgccgtctgaaagcctttcagacggcatttttcctttgccgccaacacgcgtgcaaaaaaatcgccccttggaaaagggggcgcaaaaggaacacaaaccactaccaaaactttaaatctgaaacactgcctgccgcatactgtatccgacaggatataaagccctcactaaatcgtttcgagaaatccaaacttcttcatcgccgacagaaaatctgcctttctccggtaccagctccaacagaaacggttgaaccgccgtatgcagcctgtccttacaccgccccagctttctggacaacgcggacagggcgcgtttgtaggcattatccttgcagtcaagctcccgcgcactgccgacccagctcaaacgaaggttgcggctttcatcctcaatcagcaaaatgcctgttttgacttcccccacctcgggctcgcatgaaagcgcaatataatatttgccgtcgatgttgacatacgccgcttcatgcacg

SEQ ID NO: 343 - DNA, 263 bp, Neisseria meningitidis
taagtttccgtaccgacagacctggattcccgcctgcgcgggaatgacgaagctatccttttggccgaaggtcaaaaatcagccgtcacagagtattacctgaatcacggcgaatggcccggcaacaacacttctgccgcctgggaacctcctcaacaatccaagggaaatatgttaaaggaattacaatcccaaacggggtcaataacggcaaaatgccttcaagccgggttaacaaagaaatccaagggaaaaaactcccc

SEQ ID NO: 344 - DNA, 349 bp, Neisseria meningitidis
agtgcttgtgttgtttgcaccggttgctttcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaagagaagagaagagaagagaaggttttttgggggctggattcattttcggctccgtattcggttttaactgattaaaaagaaagattttcaatgatgttgcaggagcggactatatcacgtttgtggcgatgtttcaacacaatatagcggatgaacaaaaaagagaacg

SEQ ID NO: 345 - DNA, 711 bp, Neisseria meningitidis
acgggacctttgatgctgatgctgctggtcggcacgggtattttgctgactgttttattaaaaggtttgcagttcacgatgttgggttatgcgctgaaacaggcgtttatgccgccaaagaagcataaaagcggcgaaggccacgaaggcgatatttcccattttgcggcgttgatgaccgcgctgtccgccaccatcggcacgggtaacatcgccggcgtggcgactgcggtggtaaccggcggcccgggcgcggtattttggatgtggatgaccgccattttcggcatggccaccaaatacggcgaaggcgtgttggcggtgaaataccgcgtcaacaattccaaaggcgaaatgtccggcggcccgatgtattacatcgaaaaaggcttgggcaaaaactggaaatggatggccgtcgcgtttgcgctgttcggcacattcgcttccttcggtatcggcagctcggtgcagtccaactcggttgcacaggcggtgcaaaccagcttcggtatcgaacctgcctataccggcattacgttgaccgttctgactgccgttgtcgttttaggtggtattaaaggcatcgccaaagccgcttctttcatcgtgcctgctatggcggtgttttatgtgttgggcggtctttccattatcgcgattaattccgatgcactgatgcctgccgtcaagctgattttctccgatgcg

SEQ ID NO: 346 - DNA, 129 bp, Neisseria meningitidis
aaaacggtaaaatcaattcatacttgaatacgttctgcgcctgccggctgggaacaggcgcacggataatgctttgccgagtgcgtttttaataaacaattccgttttaaagtaaaccgtttcatgagg

SEQ ID NO: 347 - DNA, 384 bp, Neisseria meningitidis
tacccggttcttaaagttgaaaacgtctcattcagatatgctgataatgagccatatctttttgaacacattaatttggaatttagagataatgaagcagttgttttaacaggacaatctggtcgggggaagtccactttgttaaacattttaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccacatatggagctcattgaacaatgtgcacacgtggtacacatacatgatccatatacttaacatgcc

SEQ ID NO: 348 - DNA, 826 bp, Neisseria meningitidis
  misc_feature (116)..(116): N is any nucleotide
aaaagttgataaatggtagtagcatatggtctcataatttcaagcttagaaattagttaaagaataggggctgtcctagataactagcgaaattcaaattaagttagaattatccntatgagaaaaagtcgtctaagccagtataaacaaaataaactcattgagctatttgtcacaggtgtaactgcaagaacggcagcagagttagtaggcgttaataaaaataccgcagcgtattattttcatcgtttacgattacttatgtatcaaaacagtccgcatttggaaatgtttgatggcgaagtagaagcagatgaaagttattttggcggacaacgcaaaggcaaacgcgttcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaaaacaattagtaaaatcaagtttgtcctagttatctaggacagccccttgttttttgttcggcgggg

SEQ ID NO: 349 - DNA, 1200 bp, Neisseria meningitidis
cacatccgtgcctgtgtcattgtcaaaaataccgtaaatagattgtatatcctttttatcaacatcatcctcactcaaatcactgcccgataccgacagataaccacgcgtttgtctttcagtttggaaacggcgggcgcggaggtaatcggcttatccagcgtgcctttaaaaatagtacgtacagaccatttggtcggatcgttgttgctcaaatcaaagcggtacatattcccgccgcggtcgccggcataggcgatatcgaccgtgccgtccaaatctttatccaccaacgtgggggacgaaagcccgcccttgccgtcgggtacgttgattgttgcaatcggcgtaccgttgttgttttccaaatcatacacatacagcgcggttttattctcgccgttgttaatgtctttagtcgcataaccggaggcgatgaaggcggcgtatttgccgttgtgggttttgccgatttgcggcgtaccgacggtgtagcctaatttcacgccattgtcgtttttgacatcaaacatggaaacgccggccgggttgctgttgtcgattttgcttaaatccaaggcgtatgcgcctctgccgccaaagcccattgcgccgaacataaagaagtgtttttgcttgtcttggtcatctgtaatgcggcgcaagacaaagccgccgtccacgccatagcggtcgcccacatagcctttttcggcaaaggtgcgcagctctttggcaagggtggattcggtgttttgaatatccttgcgcggcatcgtgccctttcagacggcagcagcttttggattaccggcgaagacgcgcgtgccgacgtacaggttttgcgtgccgaaagctgcgcggtgctgaccggcatcggcacggtgttggcggacaatccccggctcaacgtccgcgcttttccaactttgcgccaacccgcacgcatcgttttagacagccgcctgcgcctgcccccgaacagccatttggttaccgacggacaatctccgacctacatcgccacactcgaacgcaacgaagacagactgcacccctatcgggaacacgcacacgtccgcatcctgatgccgtctgaaacggcagacagcaaaatcgacctgcaccacctgatgcgcctccttgctgacgaaggtttcggcgaaatcatggtcgaagcaggctccgaactcacatccg

SEQ ID NO: 350 - DNA, 1379 bp, Neisseria meningitidis
tcaaggcattttttttcgattttgatagtctgcaacttgaaacaaaacctacaatattgtcaatatcggcaattcccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagccgaatatcgtttcagacggcattttgactgtttaaagcgggggcagttctacaaacggaaagaaatgctgaaatttctgataaatttcaggatgtttctctaaagcttttaatgctttttcttttgaaataggcggatcatagacatctatcccccttaagaaggcaatgccggtcaaggcattttttttggattttgatagtctgcaacttgaaacaaaacctacaatattgtcaatatcggcaattccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagccgaatatcgtttcagacggcattttgactgtttaaagcgggggcagttctacaaacggaaagaaatgctgaaatttctgataaatttcaggatgtttctctaaggcttttaatgctttttcttttgaaataggcggatcatagacatctatcccccttaagaaggcaatgccggtcaaggcattttttttcgattttgatagtctgcaacttgaaacaaaacctacaatattgtcaatatcggcaattcccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagccgaatatcgtttcagacggcattttgactgtttaaagcgggggcagttctacaaacggaaagaaatgctgaaatttctgataaa

SEQ ID NO: 351 - DNA, 732 bp, Neisseria meningitidis
taccctcaggattggcatattgatcccgataaccatttctccaacaaccccgactttgtggactcctggccgccacatggggttgttggcaccgacgaagctgagattcatccggcgatcgctaagattcctgtcgacgcacgggttaagaaaggccaatacgctgcagcctattccgggtcaatttattaagcttcctatcaacctcccatctcggtttcgcatcaaacacaggcttagccttaggtataccgccccccgatttacccacactgaacaaatctatagagaactgaacatattccgcagcctgctccgacagccccaactgcttcaaggcctgaaccgcaatcgtcggtcgttgctcgctggctttttttccgaagtttttcgtcccagtaatgacatgatcgtaggaagacgttacaccaaccaaagcggcggcacagcctaagccgaaagtctcggcacaagatccgcctccggctactcctgaaagaacaacccccaaactgcccgaaacgatttcagccccgggtgagatgtagcggtgcaggatacttttgtcttccctatccagcttttcgtattcagccttcaaataagaggctactaaatcaggatgtttagttaggtaatataaggattccttttttaagtccttaaacctactgtcaaagcgtttgtcctgggtaaattcgataatgcgtcctatattttgacgacattccg

SEQ ID NO: 352 - DNA, 346 bp, Neisseria meningitidis
tcaatacagtttcaaaatggaaaatgatacgttcactttggattttagtggtcttgttcaagcatttaaccatgtcacagaagctaatccgcaaaaagcttttgtggatttggccgagatgcttgcatatggcgaacttcgttcttggtatgaaggccgaagactaatgaccgattatgtggaggaggcatcacaagcaggtaaatttgaagattaccagaaagtgttgggtcaggagaccgttgcattattagctaaaacatcgggtacgcaagcacatgatatcctgcacaatgtatgctttggtcataataaaaatgtttctttatatggcaatcacaggaac

SEQ ID NO: 353 - DNA, 116 bp, Neisseria meningitidis
ccgcgcttgaaacgtccgcttgcagatactacagaaagagtgtttcaaacctgctctatgaaagggaatgttcagttctgtgacttgaatgcaaacatcacaaagaagttcctgag

SEQ ID NO: 354 - DNA, 237 bp, Neisseria meningitidis
ggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggg

SEQ ID NO: 355 - DNA, 522 bp, Neisseria meningitidis
caacagtcgcactacaaaagccaccgcgcgccgtacccgcccttggtataatgtggacgtgtccggttattacacggttaagaaacactttaccctccgtgcgggcgtgtacaacctcctcaactaccgctatgttacttgggaaaatgtgcggcaaactgccggcggcgcactcaaccaacacacatatgtcggcgtttacaaccgatatgccgcccccggtcgcaactacacatttagcttggcaatgaagttctaaacgtccaaacgccgcaaatgccgtctgaaaggcttcagacggcattttttacacaatccccgccattttccatcatccccgatacaccgtaatctcgaaacccgtcattcccgcgcacgcgggaatccagtccgtgcggtttcggtttttttgaagtttcgggtaacttctaaaccgttattcccgcgaaaacagcagtcaaaaacagaaacctcaagtcccgttattcccgatcagacgggatctacggcgtaaaatctaaa

SEQ ID NO: 356 - DNA, 185 bp, Neisseria meningitidis
cgccgcatcgggcaatttgccttttttcagtccggcttcgagtttgtcggatgcaagtttcaagagtctgtcgtgtgtgtcgttgtccataaagggcagttgtccggaggtggatttttgtgccagttctttaaaaaggttgccgaagctgtttttgcggtaactgttgccgttgagggcgggat

SEQ ID NO: 357 - DNA, 597 bp, Neisseria meningitidis
tcgactctagtagatcccgcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcaaatcttcaattaaccttccagcaccgggc

SEQ ID NO: 358 - DNA, 101 bp, Neisseria meningitidis
gcggcaatgccgtctggaaaagcggataccgccctgctgttgtacgggtgcggcttctatttgcgccgttgcggcaactttggcaactttggcaactttgg

SEQ ID NO: 359 - DNA, 467 bp, Neisseria meningitidis
cccgcaagtggcgagggggcaagcaaagagccgaaagacaggggggaccgcagacaggggcgaaagcaggagcggggagggcagaagccaggggggcggcaacaacggaagccgcaggggggaaggaacgggggcagcagcggccggggagcgaaaccggcaggggcaggggcaaaagaagccggagaggaagacggggagcagggcagaaaaagagcagcagaagacagagcggccgaagcagagacaacgggggtgagtgtgggacggacccaaaacccggggggcgctggggcgacgagacggaaaggcagaagagggccaaccgaagcaaaagcacgggaaacagcagccagcaaagccggcggcgcgagggggggggccaaggccggacaagctcggaaagagagccaaagacacagcggcaaagagaaaaaaaggaggagggagaagcgggggggccagga

SEQ ID NO: 360 - DNA, 723 bp, Neisseria meningitidis
ccaatgcaggatccgagccgagtatgcaacctacaccacagctggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaga

SEQ ID NO: 361 - DNA, 455 bp, Neisseria meningitidis
ttcggacattccttaaattacccgtgtatcgctgtaaatcttagagatggcggaatatagcggattaacacaaggcattactgcaatgctcaggattccggtacagggtcatcgttgcacatttagccaaacggccgtgaccgatttcacggcgtttcggtgcgcccatgcggcccacttcgccggtagagtacggcggaaagttgtagtgcagcataaagcggtcggtgtattcgccggacagcgcgtcgatgatttgctcgtcgcgcgaagtacccaaagttgcaacggccaaagcttgggtttcgccacgggtaaacaatgcagaaccgtgcgtgcgcggcaatacgctggtttggatgttcagcggacggacggtgcgggtgtcgcggccgtcgatgcgcggttggccatccaaaatttggctgcggacgacatcggcttccaagtgtttg

SEQ ID NO: 362 - DNA, 707 bp, Neisseria meningitidis
  misc_feature (624)..(624): N is any nucleotide
gcattgtcttgttgcccttacttttagcatcttgtatcggcggcaatttcggcgtgcagcctgttgtcgaatcaacgccgaccgcgtaccccgtcaccttcaaatctaaggacgttcccactccgccccctgccgggtcttcggtagaaaccacgccggtcaaccggcccgccgtcggtgcggcaatgcggctgccaaggcggaatattgcttcctataaacaagacggtacggaaattcccgacaagcatcaggcagaggagcatctgccgcttaaagagaaggatatcctgtttttagacggtacgctgaaagaacaggctgacaaacttaaaaagaaaatcaacgaacggtattctgatgtgagggttatcacatcgaaaaaagaagaagaaaaatatcaatatcaatttgtccgtgcgggctatgtgtttaccagggcggaaggaaaggataatgaaaaagaaaagacttctgatggtaaggagtttgttaaccgatttagttatgacggttttgtatattattccggagaacgtccttcccaatctttaccgagcgcgggaacggtgcaatattccggtaactggcaatatatgaccgatgccaaacgtcatcggacangtaaggcggtttycagtacggatttgggttataccacatattatggtaatgaaattggggcaacttcttatgaggctagggat

SEQ ID NO: 363 - DNA, 110 bp, Neisseria meningitidis
acatggcattcggacttcatgcgttcgtgcgcggcttcggcttttcagacggcatatttgacgttatgattaaacagttaacaagatttatcacaacgccgtcaagagac

SEQ ID NO: 364 - DNA, 491 bp, Neisseria meningitidis
  misc_feature (401)..(401): N is any nucleotide
acttcagcctcccaagtaactggcattacaggcatgcgccaccatgcccaggtaattttttttttttgtatttttagtagagacggggttttgccatattgtccaggctactcttgaactcctgccctcaagtgatccgcttacctcagcctcccaaagtgctgggattacaggtgtgagccaccatgcccagccatccttgttattcaaccctaccacactttaaaatctctgacagggagtaagtatgcaaaacgctcccatccggtcaggcgcagttctgccacgaggtcaagataagcaggcagttcgctgcgggtgccggagaagaagacaaatggcggccgcaccattgccatcaggcgcagaaactctaccatgccgaagtagttcatcgcgtncccttttccccggcggcgcggctttggtttgaacgcgcgtcgtgctgcctgcctttcagttcgctgatatacgcctgccggcagtggtgg

SEQ ID NO: 365 - DNA, 815 bp, Neisseria meningitidis
cctgcagtttctcgatatagccttctgcatcggtacgggtatgtaggttgtaaccgggtttgtagaggccgtttttctttatccaacgggcatcgctgtccttactcggtgtggtttgaccgctgatttgtccttcttcgtcaacttctatggcctgacgctgtttgctgccggcggtctgaataatggtggcgtcaacgacggcagcggatgctttctctatttttaaacctttttcggtcagttggcggttaatcagttccaacagttcagacagggtattgtcttgcgccaccggttgcggtacggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaarcggtcgatgtgtttggcaatcatggcttgggcggtttgytggaaaggtgctcttgagaaatcccctaaatgtcttggtgggaatttaggggattttggggaattttgcaaaggtctctagatgagtgaaaaagaagtgcaggctgcctaaaaagacagaaaaagtctttccggcagcctgcactttggtttcatttcagtcagtaaacccagtaaacgacggtctgaaaacgcagaacgttacgaaaa

SEQ ID NO: 366 - DNA, 354 bp, Neisseria meningitidis
gctttgccgtcaagcgcgccgccagttgatttggttgcgcgcgtggtttgggagaagcttgcggaatacgcgccaatacgtcgcctttaccgatttcctgaccttcgcgtacggtaatcaccgcaccaacggggaatgccatggataccggagtagaagtaccgggaatacagatttccacgccgttttcgtccaagagtttcacagtcggacgcagcagtgtcgtcttcttgagaggaacgacgtttaccgtcaatcaccaccaaagtggacaaaccggttacatcatcggtttgtttggcaacggtaacgccctcttccacgttttcgaatttcaccatacctgcgtgttcg

SEQ ID NO: 367 - DNA, 282 bp, Neisseria meningitidis
caaaagtttttcaaatgaaacggttgcggcatcgggcggtgtcgacgttgatttggttcccgtgtggtaggggaggaagcggcttccttcaaacctgcctttgattgctgttgtgcgcgcggtgatggggaatcgggagaggtcggcggtatgtgtgccgccggtattgtcgattgtgccgctgttttttcccgtctgcctgatgcggacaagggcttttccgctccgcaaaccggcaagcatggggacggagataaaatcgtcgggaataccgtagatcgg

SEQ ID NO: 368 - DNA, 301 bp, Neisseria meningitidis
gaaacggttgcggcatcgggcggtgtccatttgtatccgccgtccttcgggggcgcggttgatgttgacgcagattccgctgcgtttgaccgatgatgttcgcgcggtgatggggaatcgggagaggtcggcggtatgtgtgccgccggtattgtcgattgtgccgctgttttttcccgtctgcctgatgcggacaagggcttttccgctccgcaaaccggcaggcatggggacggagataaaatcgtcgggaataccgtaaatcgggaagcgggcttgtgccgtccgcctgtcgtcgccc

SEQ ID NO: 369 - DNA, 384 bp, Neisseria meningitidis
catcgggcggtgtccatttgtatccgccgtccttcgggggcgcggttgatgttgacgcagattccgctgtgtttgcccattatgttcggctgcgggataagcaacatttatgagcggctaaaaatgggacgccggtattctcgattgtaccgctgttttttcccgtctgcctgatgcggacaagggcttttccgctccgcaaaccggcaagcagggggacggagataaaatcgtcgggaataccgtaaatcgggaagcgggcttgtgccgtccgcctgtcgtcgcccttcagcaccggttcgtaatagccggtaaccgtaccgtcaaggcttccgttgcctgcaacctgccacggcgtgaaatagcgttcaaaaaactgttttg

SEQ ID NO: 370 - DNA, 476 bp, Neisseria meningitidis
  misc_feature (332)..(332): N is any nucleotide
  misc_feature (363)..(363): N is any nucleotide
cactgtgccgccgctttgcccgtcggtgcggcaagcgcgatgttgggaagattttcgtcttcaccgcaaatcagcgccagcagtttggcaaccgttgtcgttttgcccgttcccggcccgccggtaatcaccataaaagactgcaacagtgccaaggcggcggcatcgcgctgcccttcgctgcccgtgccttgaaaccattttgcgaggttttgcctcgcgcctgccgcgtcgggggcggatgtgccggctgccgccaagcgttttatctcggcagccaaatcgtattccaactgccacatcctgcccaaaaacagccttctgccttccanaatcaaaggcgcggcggatgttccgacaacnggtgcgagtgccgacagcgcgtcagcctcgccaccgctcaaacggatattgaacttttctccactgcggtctacgcctgcgactgtgataatgcctttttgagcgtctttttc

SEQ ID NO: 371 - DNA, 589 bp, Neisseria meningitidis
caggcaggttcggtcggttgcagccacttcaacgactccggcttctggctggtcggccgtctcttggacatggacgtaccgaccacgctgaaaacctggacggtcaaccaaaccctcatcgcactcatcggctttgccttgtccgcactgctgttcgccatcgtctgacagacggaaaggatagtaaatgactacgcattttgtcgttatgggcgtatgcggctgcggcaagaccaccgccgcgctgtccctgcagaaacacctcggtcaatgtccctatgccgaaggcgacgagttccacacccaagccaaccgcgacaagatgggcgcgggtattccgctgaccgatgaagaccgctatccgtggttgggcaatctgcgcgactggatgacgcaacaggcgcaaaacggtgcgaaccacaccatcgtaacctgttccgcccgtacgaatgaccgtttttgcaatgcctgaaacaggcgttcggtgcagtttgcaagcacttcgtcgccggaacccgcatagtgttccagaaaacggattgccgcccttgccgccgcttgggcaaattcatctgtctgccgttccatt

SEQ ID NO: 372 - DNA, 549 bp, Neisseria meningitidis
actggaaagtgcgcatcgaagatgccattgccgccgacgaagtgttcgttacgctgatgggcgacgaggtcgagccgcgccgtagcctttatcgaacaacaacgcgctgattgcccaaaatatcgacgcataagtgccgttttaaaaaaggagacgggcatcgtgccgcgtctcctttttggttggtcaaacggaacctgtgccgtctgaaaaaccgtcggagcaaaatatgatcagcattttcgatattttcaaaatcggtatcgggccttccagttcgcatacggtcggcccgatgaaggcagccgccgcctttgcggcaggtttggatgcacaggctgttcgcatcgtcatcgacatttacggctcgctcgcactgaccggatacggacacggtacatttgacgcgctgacaaacgcggctaccgcgacattctgcgcggagccgaaggcaaagctgccttcatccacctcagtccgccgcaagacatcaacctcgagcgcatgatgtcgcgcagaggacattacatgaaagcagggatgctcgat

SEQ ID NO: 373 - DNA, 564 bp, Neisseria meningitidis
cggcatgcggattgaacatgatgatgtcgcggtctttaaacgtacctggttcgccttcgtcggtgttgcaaaccacatatttttcgcccgggaaagaacggggcataaagctccatttcaaaccggtcgggaagcccgcaccgccgcgcccgcgcaaaccggaggttttgacttcgtcaatcacatcggtttgcgagatgttttcggacagaattttacgcagggcggtatagccgccgcgtttgacgtattcgtccaatgtccagcaatcgggattggcggtatccacttggtcaaaaatcacgcctgattggtaaatagccatttttggtgtgcctgtttgttttcgtatcggttgcggtcgctgtttcagacgaccttaagatgtctttgtgtaccggcttgtaacgtcgtctgaaataaaatctagtttatcaaatcgctcggtttggaaggcagcctgccgcacgacatcccgcttgccggcattcccgaacgcctcgaacgcatccgcacgcagcacatcctccggctcaacgggcaagaaatcggcttcatccccga

SEQ ID NO: 374 - DNA, 522 bp, Neisseria meningitidis
  misc_feature (452)..(452): N is any nucleotide
  misc_feature (483)..(483): N is any nucleotide
cgaaagcgggaatgccgaatccgtccgcgcggaaacctgcatcccgtcattcccgcgaaagagggaatctagaaacgcaaagctgcaagagtttatcggaaatgaccgaaactcaacgaacctggattcccgctttcgcgggaatgacgggggtttggcgggaatgacgagggtttgggatttctgtttttgaatttctgtttttgtgagaatggcaagattttcggttcttgtatggataacgagattttagatggcgggaatttgtcgggaaaacagcaatctgagacctttgcaaaaataatctgttaacgaaatttgacgcataaaaatgcgccaaaaaattttcaattgcctaaaaccttcctaatattgagcaaaaagtaggagaaatcagaaaagttttgcacgatattttcagacgacctttaatcgtttttgttggatctcgnacacttgcttgtctgtcgtcattcccgccangcgggaatccatcctcaatggtaagcaatgtcttattaa

SEQ ID NO: 375 - DNA, 585 bp, Neisseria meningitidis
cggcaataccgataacggtcaaatccacataacggttgttggcaaatgcttggcgcaccatcaaatgcgccagcgagccttgtccgaacaaatcggccgcctcggcatcgctaaatagttgcaccggctctaaggcgggctgtatgcccgcggtcagcatgggtgcaaccatcaataccttttgcggattttgcggcaaaccttgtacggcattgcgggtgttaaattcaatatactgcccgggcacgcggatgctgcccggaatcgtgtcaaaatcaatatggggcatcattactctcccttagtattgcgggttttggtatttggggcggcatcctcaaccaccaccaaatcgccgtcatcaatcatgcggcggtaatacaggctgttgccgtccaactccaccggctcttggccgatatattcgtgcgggttgtgttttttgaaaatgagattgagcataaaattttagtaacctatgttattgcaaaggtctcaatctttaccgtcattcccacgaaagtgggaatctagaaacgcaaagttgcaagaatttatcggaaatgaccgagactcaacgaacct

SEQ ID NO: 376 - DNA, 974 bp, Neisseria meningitidis
gggcgttgattgcgattgtagggtttgtaggctggaaaagttacggcatttttaaagtttacagcawagccacagacagccggattgagcaggaagcgcaaaaagaaagcgttgtgcagacgatgacggagcagcctgcatcatcagaggaaatgcctttaaaaaattcagacaatttgaaacctgaagactttgtgccgactttacccgaaaagcccgaaagcaagcctatttataacacagtccgacaagtaaaaacctttgagcaaatcgccggatgtatagacggcggaaaatcagattgcacatgctattcaaatcaaggaacacccttgaaagaaataacaaagataatgtgtaaagaatatgtgaaaaacgggttgcctttcaatccttataaggacgaacagcaaaggacggaacaggtggaacagtccgcgaaagcggacaagccgcaagttctcgtaatgggcggaaagccgtagcaaaatctcatgtacgacaactgaagagcgcggaaaaccgtttgaaggaattggcggcggagtcgtaaagcagaaagttcaatccctacccctcaggatggcttgagctgagtgaagggggttaattgctagaatggctgttttttttaaagtgtctcagtctggaatcgcttcgttcgggggttgtaggtgcaggaaaatatggcagaaaaaaggaaacgggggaagctttgtaaagattgggcgcgctttttacccaatctttatgaatacccccttttccttttttatgaactgtttttcagtaccggtaactctcgaacggagtgattcgagactgagatacgcccattgaaaatcagacattcgggtcgcatcagaaacctttaccaagacctgcgaccccaatctacggcaacggcgacaatatgcccgatgagaactgctgccgttgttcgacaaaatcaatttgcagcaaggcaagcattt

SEQ ID NO: 377 - DNA, 485 bp, Neisseria meningitidis
ccgccgaagcaatcgaggcggcgtggatattgttggtaatcaccctcaggctgccgcgccgcctgaccagctccgacaccacggcctccatcgtcgtgccgatactgacaaacagcgacgaaccgtcggggatgtgttccgcaatcagccgggcaatggcgtttttttcgttttgacaccgggtttggcggtcggcgggcaggccctccggcaagtttccgcccgaagatgcgccgccgtgatggcgtttcaggctgccgacctcctccaactcgcggatgtcgcggcgtatcgtctgcggggtaacgtccaatgcggcggcaagctcgtccaccgacataaactgatgccggcggacaaggcttaaaatctctccgtgcctttggattttcggcttcatcgttttctgaaaatcagatacggcaaaggcgataagcttcaagccctgaatgagtagatcagcccattgagggcttggcgtttga

SEQ ID NO: 378 - DNA, 579 bp, Neisseria meningitidis
  misc_feature (410)..(410): N is any nucleotide
  misc_feature (527)..(528): N is any nucleotide
aaatcccgtttattcccacaaaacagaaaatcaaaaacagcaacctgaaatcccgtctttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaagtcccgttattcccacaaaaacagaaaatcaaaaacaacaatctgaaattccgtccttcccgcctgtgcgggaatccggcttgttcggtttcggttctttttctcgtttcgggtgatttctaaaccgtcattcccgcgcaggcgggaatctaggtangcatacggctttgttccgcaaccatttgggccccacgcccgaaaaactcgccaccctgcgcgagcagctcggtctgttggggcttcaacttggcggcggcgacaacccgtcgccgannagatatgccgcgcttgtcgaacattcaaaggcagactgatgccgaattgct

SEQ ID NO: 379 - DNA, 580 bp, Neisseria meningitidis
cgccctttgaatttgcccccataatgcagccttgcccaagaccaatgccgcattctggttcagattcacattgccgttaatctgtgtcgctccaaagctgtttaaagccttatcggataagttgcctgtgttgcaggtaacgtaaccggtatagtccgagcgcacgcaaacctcatcgccgtttttgtaacccaaatttactttggcgttgtctgttgcggtgatgttggcggtgatgtcggatacatttctgccggaagagaatgatgcggattgattaaccgcaatttctgtggctttgaatgtgcggtttatccagtcgtcttcaaatacgacttcattgtttttggagaaatgtgcgtcttttcgggctgaagatttgttcacaaaatctcttgcgtgtggtgttggacgacctgataacaagacattgccttgatctttaagcttcggtttttcttgataaattcttgccgcattaaaattctagattcgcgctttcgcgggaatgacggcggagggttttttgttttcccgataaatgcacatcatccaaagtcccgttattcccacaaaaaca

SEQ ID NO: 380 - DNA, 623 bp, Neisseria meningitidis
caacaacttcagcgcctgcattataggcagcatcaaccatttcaaaagctgtttttaaagagccttcatgattgatgccgatttcacagataatcaatggttcgtggttgtaacctactgaacgattaccaattttaaattcgttgttgttttgcatttagctttccttgtgattaagaatgttttctgcctgttgtaaatcaagctcagtatcaatatcgatagagtcttgatgagacataatataaagtttggttggggcgataaaaaaacaattatttgcaattagtgaagcagtatcattaatgtaaattgcaccattaggcctaaatgcctgaggtaattgttggcgaggctgctccaaatcgcttagatggcgcatgggggcatattcgccattattgatttgaagcaaggtttttagtggatgatgctccacaaatacgcacttgcctgccttgttgataatgttgtcgtgaatatcggaataattgacatagttgagcataatgccctgatcgcggctgccgacggcgatattgtcgaatactttgagccgctcggaaaacatcagcacatagcccatattgttgcccacggaaatattgccgctgatttcgctg

SEQ ID NO: 381 - DNA, 533 bp, Neisseria meningitidis
cacggatgacgcgcgtacggatttcccgggtggcttcttcatagattaaattgcccgccgcgccggcagtggagtccaatacatcgaccaaaggcacgcctgccgcaatcagcgtcgccgtcgtcgtgccccagcgggcaatcgttcctttgcggacaatgtctccgaaaatcggcatacgcagcagtatggcatccatacgccgttggattttaatcgaacgcgccttcaatttaaggaagccgtatatggcaaagcccagtgcgatcagcaccatccagccgtatgagacgaaaaagtcggacatatccatcactgtttgggtcagtgcgggaagctccgcgcccatattggcgtaaacttctttaaaggcgggcagtacgaaaatcatcatcacgaataccaaaccgattgggcatgcagagacaacggatccttttattttctcatcaaatagagaaaaacttcacgaatatgagcccctgtgcgtaatggactggttggttgtaataaggttactgtgccggaattac

SEQ ID NO: 382 - DNA, 597 bp, Neisseria meningitidis
  misc_feature (451)..(451): N is any nucleotide
cacgaagcccgcgcggaacgcgtctgccacaaacagcatacgttcggggccggggttcgccagttcgcggcggatttccgctttgtcttcactgcgcggattgaagccgcacaagcctgtttccaagccgcgcagggctttttggaaactttcttgaatcgtgcggcccatcgccatcacttcgcccaccgatttcatctgcgtggtcaggcggtcgtctgcggcagggaatttttcaaacgcgaaacgcgggattttggtaaccacatagtcgatggaaggctcgaacgacgcgggggttttgccgccggtgatgtcgttgcgcaactcgtccagcgtaaagccgaccgccagcttcgccgccaccttcgcaatcgggaaacccgttgctttggaagccaacgcggaagaacggctcacgcgcgggttcatctcaatcacaaccggttcngattgcctgcgcccccgccttgccgctgatgaatcgtttcggcaggcattgattcctttttcaaataccgatgccgtttgaaagatgttcagacggtatcttccgaacagacagatgaatatggtttccaaactggacaaatactg

SEQ ID NO: 383 - DNA, 459 bp, Neisseria meningitidis
cactacgttcaatttcggcattgctggtgcggtcgttcatttccttttctaaatctaattcgccttgttttttgcctttggtttgcgcgtttaaatggtgcgcttcatcacccagcatcacaaggttcaatttgtgcaaatccgccaatgtggtttgattttcccgccgggtgcgaatatcgttatacagcttttgaatgctggtaaatttaatttcaatgccgtctgaatgtgggctaaatgtctccactttgcgaataggaattaccgtatcgccctgcaaaatcttctcggtaaataaaaattttgcgtgcgtcggatcggtaaaattaatttccgttttatccacgatattgttttgattcacaaaaaacagaaaatgccgataacctttttcaaaataatacaaacgcaccctgctgatgaacgatttggacagcttggatattaccgggccga

SEQ ID NO: 384 - DNA, 577 bp, Neisseria meningitidis
  misc_feature (573)..(573): N is any nucleotide
agcggcacggtttgaagcggccagcctatgccgactgtcgggtcgttccatattaaaacctgttcggcttcaggcttgtaatagtccgtgcatttatagacgaactcggcttcatcgctcagtacatagaagccgtgtgcgaggccttcgggtacccacagttggcgtttgttttctgcggacagaatttcgcctacccatttgccgaaagtgggggagtctttacgcatatcgacggccacgtcgaatacttcgccgacaaccacgcgtacgagtttgccttgtgtgttttcagtttgatagtgcaggccgcgcaatacgcctttgccggatttggagtggttttcctgcacgaaggtgcgttcgcagacttgggttttagaccactcgtcgcggaaggtttccataaaaaagccgcgcgcgtcgccgaagatcaacgccgccatcatcatcgttttgccagcacctgttgccatattgaacagcaaatgcgttggcttattttttaaatcagggaaatcgtctagctttgaagtgcggtcaaaaatcaaaaagttttcaagggcagatttntgcc

SEQ ID NO: 385 - DNA, 492 bp, Neisseria meningitidis
  misc_feature (331)..(331): N is any nucleotide
  misc_feature (352)..(352): N is any nucleotide
  misc_feature (414)..(414): N is any nucleotide
cggcttcgaccgcgccggtgtggtcgggatgtgcggacagatcgactttgtgtttttcgccgtttactttgaatgtgatgtaggcatcgggcaggttgagtttttcggcaaggcagctgagcaggacttcgccgctgccgttatccaggaccgcgcctttgagggacgagctgccgcagttcaaaaccaagatcaatttttgggacattttcttactccggaaagtttcagacggcattggaatcggacacggatactaaccggattcgtgccgaatccgttttgccttcctgggcgggaaagtagtggggccgtctgaaaaggttgatanaagaacaggctattctagcanaaatctttgcaattgcttggcttaatcgggcgtttgcgtgaaaatggcggaagtcacttggngctcaagcagttttacgtcaggaatggcggtatcaatgatgttcatctttttatctttcatctaaagggcgtctgaaa

SEQ ID NO: 386 - DNA, 654 bp, Neisseria meningitidis
  misc_feature (644)..(644): N is any nucleotide
aattcaagaatcaataggaaggttaaaaaaggataaaacttcttttataatttctcatcgtctttcaattattcgtgatgcaacattaataatggttattaatgatggtaaagtacttgaaatgggtaatcatgatcagctgatgaaacaaaatggattttatgcacgtttaaaacaatcttcggttcgttaataaattctaatgactgttgctgaaattaaaaaacttgcattaaataatcaggtatttaatgaagcaaaagcgcttttagaaaaaggtaatgttatttttccgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagagcggtttgcgtattgggcgctcttccgcttcctcgctcactgactcgctgcgctcggtcgttcggctgcggcgagcggtatcagctcactcaaaagcggtaatacggttatccacagaatcangggataacgc

SEQ ID NO: 387 - DNA, 218 bp, Neisseria meningitidis
gcggtcgcgcccaaacagcccatttcaccttcgtctttttcattttgtcttttctcccaataagcccattttccatcatctcgattttgcccaaaagtaaaaacggtggcggctgattgggcgcaaacgcccaatgtacaactttaatcgcccaaaaatttatgccaaaaaacgcaactttaaacacgtacattgggaggtcgcgcccaatcagcctt

SEQ ID NO: 388 - DNA, 120 bp, Neisseria meningitidis
cgcaaaaagctagcgcacggcgctgtttctgcgggtcgatatcgagcggccgcagcctaagcttgacaggaatattggccttaagtgacagcatcggcaaatcgttgacagcccataggc

SEQ ID NO: 389 - DNA, 528 bp, Neisseria meningitidis
tccagctcggtagcaatacgaattcgagctcggtaccaggttacaggagaaacagatttaagaggttctaatattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaataatgacttgaattccgcacaaggcaatcaaataaccggttccgatattacggcttccaaaaaactgaaccttcacgccgcaggcgtattgccaaaggcagcagattcagaggcggctgctattctgattgacggcataaccgaccaatatgaa

SEQ ID NO: 390 - DNA, 368 bp, Neisseria meningitidis
tgagcaatttaattgccgctcggtaccctaacatattgccgccaagcggtatggaagcggaaataatggtaggtgggcttcagacggcatccgccctccccgtcattcccgcgtaagcgggcatccagaccttgggatagcggcaatattcaaaggttataaaagacccgtcattcccgcgcaggcgggaatccagaccttgggatagcggcaatattcaaaggttatctgaaaatttagaggttctagattcccgctttcgcgggaatgacgaaaagttgcgggaatccagaacgtcgggcaacggcaatattcaaaagccgtctgaaaatttaaaagttctagattcccgctttcgcgggaatgac

SEQ ID NO: 391 - DNA, 479 bp, Neisseria meningitidis
ccgtcaaataggactgcagtgaaagtcattttgcgccctccttatttttccaacgcaacggtgtggctgccgtcgagcgtgatgtctttgccgtacacctgcaaatcgagcgactcgcctttgagcagagtgaagacgacgttttctttgccgacggcgactttaatcagacggccgcggtagttgatgtggaaggcgtagcctgtccacgcactcggcaggaacggtgcgaagctgagtttgccgccccaggttttcatttgggcgaaaccttggacgatggcgagccaagagccggtcatggaggggatgtgcaggccgtcctcggtggcgttgttgtaattggccaagtccaagcgggcggtgcgctgggacatttccacggctttttcgtccttgcccaattcgggggcgagaatagagtgaatacaaggcgacagcgagctttcatgcacggtcaacggttcgtagaagtcgaa

SEQ ID NO: 392 - DNA, 759 bp, Neisseria meningitidis
gcacaacttaattatgttgcctgaaacatcatataaaagataataaaaggtacgcagccatgaattacgcaaaagaaatcaatgcgttaaataacagcctttccgatttgaaaggcgacatcaacgtttcattcgaatttttcccgccgaaaaacgaacaaatggaaaccatgctgtgggattccatccatcgcctgcaaaccttgcacccgaaatttgtttccgtaacttacggtgcaaactcaggcgagcgcgaccgcacacacggcatcgtcaaacgcatcaaacaggaaaccggcttggaagccgcgcctcacctgaccggtatcgacgcttctcccgacgaattgcgccaaattgccaaagattattgggacagcggcatccgccgcattgtcgccctgcgcggagacgagccggccggttatgagaaaaaaccgttttacgccgaagacttggttaagctattacgctccgtcgccgacttcgacatctctgtagcagcatatcccgaagtgcatcccgaagcgaaatccgcacaagccgacctgawtaatttgaaacgcaaaatcgatgcgggcgcgaaccacgtcatcacccaattcttcttcgatgtggaacgctacctgcgcttccgcgaccgctgcgtgatgttgggtatcgatgtggaaatcgtccccggtattttgcctgttaccaacttcaggcagctcggtaaaatggctcaagtaaccaacgtcaaaatccaagctggctgtc

SEQ ID NO: 393 - DNA, 737 bp, Neisseria meningitidis
cggctgtcttcattggcgtacggcgcgctactgctcacaccggtactacccgaaagttatgcagcaagcgtaggacgtgtcttcagcacgcacgcgtctgaacagtatacagagaatctgaatatttactgcataacaaatgccgtctgaaaaattgtgagcttttcagacggcattgagccgtaaatcatggaacgcgtgcgcgctgaagcacacaccttacgcatggattttaggtttcatgcaggctacagcttgcttccataaatcatttttatcagagctcgtaggtacggttaagcttttagggttagccggtacaatgtgaactccatttttacctgaatgaatcgtaccaaaattggtacttaatcctgatttcccatcgctgcctataggatacccaaaatcaacaacaggatttcctcttgctcctttagaaataactggataagcacctgaatgtattccgttcaacaattcttgaggattaatgttttgatttaaagtactcttaccttcaatgtagtttctatgtcctgaaatatgtttcccttgagctccatcatgaattttagtcccaatagattttgctttaaaatcaacattgcgggtttgaaacatttctccatctacagactgagataatcttgaagcagtgttatgcctgtaggagtctgagaaatccccactaaccgcagccttccccggttttggcgcctttgtcaggtttttga

SEQ ID NO: 394 - DNA, 1089 bp, Neisseria meningitidis
gacggcgagcataatgtcgctgtcgtattcgttcatctggcagccgaaggtgcggataaatacttttttcatggttgtgtctttctcaggcagccgtaatcgcggggctgattgttgttggaatgaaaaaatttcagacggcacgacgatgccgtctgaaaatcggtgcggattatagcacgatgtgggttttggaggcaggatattgttttaaaatatgaatttaatcggtcgggacggctgtataatgtttggctttaatgggagatgtgtatgaaaccggctgtatgggcggcattgctgctgtgtgcgtgtaccagcaatttcggcgacagggaacatcagttcctgcgttatagtggattaacaaaaaccagtacagcgttgcctcgccttgccgtactatctgtactgtctgcggcttcgtcgccttgtcctgatttttgttaatccactatatcagacggaagagggaatcgcactggattgagccgaaatgccgtccgaaaacagcagaccgatgccgtcattcccgcgcaggcgggaatccagaccttgggataacggcaatattcaaaggttatctgaaagtccgagattctggattcccactttcgtgggaatgacgggatgtaggttcgtgggaatgacgtggtgcaggtttccgtatggatggattcgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatctaggtttgtcggtgcggaaacttatcgggtaaaacggtttctttagattttgcgttctagattcgcactttcgcgggaatgacgaagagttgcgggaatgatggaaagctatgggaataacgaagggttaaagtaatcacgggatggtgttcgcgggaatat

SEQ ID NO: 395 - DNA, 394 bp, Neisseria meningitidis
ggtttcgcttgttttaagtttcgggtaacttccacttcgtcattcccacgaaagtgggaatccagttttttgagtttcagtcatttccgagaaattgccttagcattgaatgtctagattcccgcctacgcgggaatgacggattttaggttgggggcatttattggaaaaagcacaaagctgaaagtcggcattcccgcgcaagcgggaatccagtgcgttgagtttcagctatttagaataaattttgggactctaatcgcgtcattcccacgaaagtgggaatccaggacgcaaaatctcaagaaaccgttttacctgataagtttctgcactgacagacctatattctcgcctgcgcgggaatgacgaatccatccatacggaaacctgc

SEQ ID NO: 396 - DNA, 452 bp, Neisseria meningitidis
ccgggcgaagtcatcgccggcgcgctcggcagagacctcaaacaatgcgccgtttacggccgcgaaggccacaccggtccgcgcgatccgtcgaccatcggctttgccaccgtccgcgcaggcgacatcgtcggcgaccacaccgccctcttcgccaccgacggcgagcgcgtggaaatcacccacaaggccagcagccgcatgacctttgccgccggtgccgtccgcgccgcagtttgggtcaacggcaaaacgggtttgtacgatatgcaggacgtactcgggctgaacagccgttaacccccatacaaaatgccgtctgaraagatattgttcacacggcattttgccgacaggctccgtatcggcatatcaatgtttcagcacacaggacgacgcataaagcgtcgccctatgtgttgccctgagtcggcacgggttacgcccctccc

SEQ ID NO: 397 - DNA, 102 bp, Neisseria meningitidis
gtccgatgtctgtattgattccagatcagtcaccattttttgggagtcttcaatggttatatcgccaaattcttttccatgagctttgaactgtccatttaa

SEQ ID NO: 398 - DNA, 257 bp, Neisseria meningitidis
tggttttgggtgggtcaaacaactcctacttacatggatcggcaaaacgacgatcaccaactgcaatcacttcgtcaatcaggtaacagtcaaactccaccgccaacgacagcgcaaaagccaaacgcgctttcatacctgaagaatagcgtttcaccggctcatacaaatattgccccagctccgaaaattcttccgtaaacgctttcacataatcgatatcgacattgtaaatccggcagatgaaacgcaaattg

SEQ ID NO: 399 - DNA, 312 bp, Neisseria meningitidis
tccctctggcctgaaccaagcccgaaattatacctgcaacatccgacacaaacaaaggcatttcaatatttttatttctatgaaataaaagcgtgtaagcaggcttacacgcttttatttggctggggaggaaggattcgaaccttcgcatgctggaatcaaaatccagtgtcttaaccgcttgacgactccccaaaaagggctggctggggaggaaggattcgaaccttcgcatgctggaatcaggatccactgtcttaaccgcttgacgactccccaactcgcttgacttggctggggaggaaggattcg

SEQ ID NO: 400 - DNA, 308 bp, Neisseria meningitidis
ctcgagggaattgaccggcaattcttcaagcaataaacaggaataccaattattaaaagataacttagtcagatcgtacaataaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactaatttccc

SEQ ID NO: 401 - DNA, 181 bp, Neisseria meningitidis
aattccccgaggaattattcgataaagataagcttacattatgaagagcagcatattacagccgtatgggtctacttgacagtaaaatttgaagagcattggaagcctgttgatgtagaggtcgagtttagatgcaagttcaaggagcgaaaggtggatgggtaggttatatagggatata

SEQ ID NO: 402 - DNA, 192 bp, Neisseria meningitidis
  misc_feature (15)..(15): N is any nucleotide
gcagtcgacagtagnagatccccacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatc

SEQ ID NO: 403 - DNA, 562 bp, Neisseria meningitidis
cgataaaaacctgcgctatcacggcctgatgcagggcatttcgcgcgaaaaatccgacgaaatcttcaactacatggaaaaattcgccggctacggtttcaacaaatcccacgccgccgcctacgccctgatttcctaccagaccgcatggcttaaagcgcactaccccgccgaatttatggcggcgaccatgtcgtccgaattggacaacaccgaccagctcaagcatttctacgacgactgccgcgccaacggcattgagttcctgccgcccgacatcaacgaatccgactaccgcttcacgccgtatccggacatgaaaatccgctacgcgctcggcgcgattaaaagcacgggcgagcccgccgtcgaatccatcaccgccgcgcggcaaagcggcggcaagtttaccggtctgttggacttctgcgagcgcgtcggcaaagaacacatgaaccgccgcaccctcgaggccctgatacgcggcggcgcgttcgacagcatcgaacccaaccgcgccatgctcttggcgaacatcgacctcgctatggacaacgccgac

SEQ ID NO: 404 - DNA, 703 bp, Neisseria meningitidis
attacgtatcgaggcattcgagctcggatacccgggttaatatcagattttggagcagtaaaatttattatgtacactaatccaaaacaaaatcaaatattgaaaactagatttattttcgaataaatagaaagccgtcttatatatagtaataaattaataaccctgtttttcctattgcctttattgtgccatgcagttgagtttgatgaaactcaatataacgactgtaaagataaatctatgttatgtgctgtcagaattgattctcccaaaggcaataactatagtggattaacaaaaatcaggacaaggcgacgaagccgcacacagtacaaatagtacggcaaggcgaggcaacgacgtactggtttaaatttaatccactatataaatctatgtggtttgacaatggcaagttagtatttatatcctttactaatcaacaaatggaaaatcaaagtcgcccatctctagcgatgtttattagtgatgacaaaatatccagtaccaatattgatgaatttttagcatctttcgatcctgataaatatcgaatatttcatgatccaagatataaatttttacctagtatgtcgaactcattgtaatccttattctctttttgatattgatagcaaatataaacctgatgagaaagataaaatctttttttcaatcacgacagataacacagattttt

SEQ ID NO: 405 - DNA, 512 bp, Neisseria meningitidis
gttatccaaaggaggctgtcgaaggcaaggcatgaaatcgagcagtccgtattgtttgactttgtcgtggtcaatgacgacttggcgcgagcggaggaggatttgcgccatattgtgaatgcctgccgtctgaaaaggtcgcggcaactggggtttattgcagatttgttggaaaattcctagaaaacggcgaaaatacccggtttcccaatttaaatatttttgaaagaaagcaaataatatggcacgtattaccaccgaagactgtaccggaaaaatttccaaccattttgacctgacattggtaacggctcgcggggccggcaaccttgaaaacggcaacacgccgcttgtggacaatgtccgcactaccaaaccgaccgttaccgccttaagggaaatcgccgccggacatatcggtacagaactgttgacgcgcaataaataaattctgccggaaacgcacgccggaacactttgccgccgtgcagtccgacggtttgaaatgaaaa

SEQ ID NO: 406 - DNA, 517 bp, Neisseria meningitidis
ctttggatgaagatggtgtaatgcacgctttggtcggacgggtcgaaatgcgcgctttcgacttgcccgaccataaaattttcatacaaaacagggctgttgacgttgaggatgcggtcgtttttaccaatcaaattcaagcgcagcccgctttgcccgatggcggtaacgggcggaatgtcctgcacttggaacacgtcttttgcctcgtcgcttttgccgggtgtaaaggcgatgtacgaacccgaaagcagcgtacccaaaccggttacgccgctttggtcgatacgcggcttgacaaccaaaactgggtaaccctgcggataaggccgaatacttcggcattgatttgggcggttacttcaacgcctttttggtcgtcgcgcagtttgattcgggtaacgcgtccgacatcgatgctcaatactttgatgaccgtattgttgacctcaatgccttccgcgctgtccatcaggagcgtaaccacaggccccctgttgcggatttccttaaccca

SEQ ID NO: 407 - DNA, 674 bp, Neisseria meningitidis
ctcggctaccctgcaaattccagattcccgtctgcgcgggaatgacgattcataagtttcccgaaattccaacataaccgaaacctgacagtaaccgtagcaactgaaccgtcattcccaccacttttcgtcattcccgcgaaagcgggaatccagaatctcggactttcagataatctttgaatattgctgttgttctaaggtctggattcccgcctgcgcgggaatgacgaatccatccgcacggaaacctgcaccacgtcattcccacgaacccacatcccgtcattcccgcaaaagcgggaatctaggacgcagggttaagaaaacctacatcccgtcattccctcaaaaacagaaaaccaaaatcagaaacctaaaatcccgtcattcccgcaaaagcgggaatccagtccgttcagtttcggtcatttccgataaattcctgttgcttttcatttctagattcccactttcgtgggaatgacggcggaagggttttggttttttccgataaattcttgaggcattgaaattccagattcccgcctgcgcgggaatgacgattcataagtttcccgaaattccaacataagcgaaacctgacagtaaccgtagcaactgaaccgtcattcccaccacttttcgtcattcccgcgaaagcgggaatctag

SEQ ID NO: 408 - DNA, 105 bp, Neisseria meningitidis
gaatgacgattcataagtttcccgaaattccaacataaccgaaacctgacagtaaccgtagcaactgaaccgtcattcccaccacttttcgtcatacccgcgaaa

SEQ ID NO: 409 - DNA, 403 bp, Neisseria meningitidis
ccgactacgatttacttataaaaaatggacagacagtaaatggtatgcctgttgaaattgcaattaaagagaaaaaaatagctgctgttgcacagactatttcaggttctgcaaaagaaactatccacttagaaccaggtacttatgtatccgcagctggatagatgatcacgttcattgttttgaaaaaatggctctttattatgattatccagatgaaattggggtcaaaaagggtgttacgacagtgattgatgctgggacaacaggtgctgaaaacattcatgaattttatgacttagcgcacaagcaaaaacaaatgtttttggattagtcaatatttctaaatggggcatcgttgctcaggacgaactcgcagatttaagtaaagtacaagcgagtt

SEQ ID NO: 410 - DNA, 386 bp, Neisseria meningitidis
aaatcagagaagctactgcgaaagttgctgctgaaaaaggtgatcaaaatggataagcgttcggtgctatgatggattaaattcgttggaaactgatttagacagttcagtgacacaattaagagaaattaaagcagggctccatgagttggtagaaaaaaataccacgttggaaatcggaaaccaacgcttacgagagcatctccaagaactgaataagttagcaggaaatacaactgaaactgaaaaacaagagctatcaaaatctcgtatgaatttggaaaaactttatgaagagggcttccatgtctgcaatattttatatggttcaagacgtgaaaatgatgaagaatgtgccttttgtcttgatgttatttatggggaac

SEQ ID NO: 411 - DNA, 379 bp, Neisseria meningitidis
cctgtcgacccagatggttataaaatcgaagtcattcgtgagtgttaaaaagtttcacttgttcacttactgagctttttgtgtttgagagctgtccgagacaaaacttgtctcgacttcttctcaaacacttttttcaaaaaaagtgctacaatagaacgtatgaatttattgaggatgtgatgttattatgacaaaaaaaattattggaatcgctggcaatcaacttttgcaggcagctgaagtgtttcacggtaaccaagtgacgtacaccccacaaggttttgtcagcgctgttcaagccgcaggtggcgttcctctcgttttgccaattggccccaaagaattagccgctacgtatatacaacaaattgataaa

SEQ ID NO: 412 - DNA, 395 bp, Neisseria meningitidis
ccggtgagttgctgcttttaatatactctcatcttttattgtttctgcttcttgtattttgctttcatattctttttctaattcttttacttgattacttaaagttaaactcttttcattgataatatcttcgatggaattatttactgaatcttttaatttatcagtttgtcgataaagtccgtataattgtgtaaaagtaaaaaggccatataacagtccttttacggtacaatgtttttaacgacaaaaacatacccaggaggacttttacatgacccaagtacattttacactgaaaagcgaagagattcaaagcattattgaatattctgtaaaggatgacgtttctaaaaatattttaacaacggtatttaaattttccaaaaaaaccc

SEQ ID NO: 413 - DNA, 368 bp, Neisseria meningitidis
ccggaaagaaaaaaatattactttagttgagttaagtgaggagttaggtattccacgttccactcttaataggtatgaaaacgaagatagcgaaccaaaacaagaaacttgggaaaaattagctgattattatggtgtttctacggcttatttaatggggatatccaaccaaaaggttagcgaagaaaaagctttgacggccgcaaagaaagtttatcaagtctatctttccgacgacgatttaggaaaagaaattcgaaaagctctaatgtattttaataaaaatgatttagatagtgtcttaaaacaagcaatgcagcagtattttactatcccagccgttgaatggaatacagaatttcaatctt

SEQ ID NO: 414 - DNA, 372 bp, Neisseria meningitidis
tgcgccgctgattctaaatcattttgtaaatcgtcgttcagggataatcgctgctattttccaagtcgtttttgcgttatttatcttttataattctatcggcacaaactcgttgacggttattctgattatgtacttattctcaggatttctagcaacagttgttaaacggaaacggatgagtgagcaagttttcccagctttaatgtgggtagtggtctttcctgttttcatggcggttgtcttaatgatttatcaagggatgagtttaacagatggtaaaacgtggacagctttaatttgtgcaagtgcaggaacggtactttcatttttagcaacaatgggcttgcatccatatatcgaattattagt

SEQ ID NO: 415 - DNA, 378 bp, Neisseria meningitidis
ccggcctatcgatttccccacatttacagttggcaactggcggtggaagcgttatgcccatagtggtctatttgatttggataaaaaaatcaaggactattctcctgaagagttagcattatttttatatgctccacaacaaaaactagctaatccacccaaagagtggcctcatacagctttgtatgaaggaatcgtcccgcgtatgcaacgtagcatattgcatacagacgaaggcaaacgtcatcaaaaataccttaatcactttgttaccgtaaaaagatgtcctgattgtttaggaagtagagtcaatgaacgtgttcgtagctgcaaaattaatcagaaaagtattgctgatgctgttgacatgccactcac

SEQ ID NO: 416 - DNA, 359 bp, Neisseria meningitidis
attcccacctaactcgttaagcaccgaagcttcaatcaagcaagggtgcatttattttgcttccttagtcaatcgagcaaaggatatcggttgtgatcaagagagcatcattcaatcgtataactatggtggtggatatttagactatgttggaaaaaatggaaagaagtacagctttgccttagcggaatctttttcaaaagaaaaatcagatggggaaaaagtgacctattcgaatccaatcgctattaaggagaatggtggttggcgttataactatggaaatatgttttatgtaatgttagtgaaacaatatcttactacaacgaagtttgatgataaaaccgttcaaggaattt

SEQ ID NO: 417 - DNA, 360 bp, Neisseria meningitidis
cggagttttgatgaagattgttatcaagagtgtatgattaggttatatttagctttgaaaaagtttgaaatacgtgaatgatacatttttgaaataacagactccgtctaccactctttattattactgttcaaaagatatgttcaaatacacttaactacttttgtaaaaaaatataaaaaatactgaaagattacttcattttattaatttaaatctattgaatcatgtagaggtggcgttaaccatgtatttatttttattaggcatgtttataggatgtttgcttggtataacgattttaaattgtttagccattgcaaaatatgatgatatgagttctggaagaaattagctctt

SEQ ID NO: 418 - DNA, 296 bp, Neisseria meningitidis
ccgaatttttctttttacatccgaaggtttactacttcattattaagatgttcccaaacaatttgctctggcggtgccgttttattataaatacggtaaacaatacgatctaatgatttcccaagaagtgatttccccgacacctttatttgtactgttgcctgatcgtctacaactacggcatcaacatagaaatagagcccttccatataaataacagtgtctggaacaaatatttgtatatataaaggtgtcaaaccaacaaacagctcaaacgttgaataggtatagtaatt

SEQ ID NO: 419 - DNA, 376 bp, Neisseria meningitidis
cctgattttagctttatcgaaaaaccattaattacgaaaggagcaactcgtgaagaaattattcaggatcaattggttttagctggggaccctgccaatcagaattggttggtacgtgaaaaggattctggggtctttcattatacccaacagtatttagaagaaagtaatcaaagcccaacactcatgacggttaaaaacaatgaaatgattgttaaaatgttggaattgggcatggggcaatcgttgctttcaagaaaagcgattactgaaaaaattcctttccaaacgttaggtgaaaagtattggcgtacctttaatttattaacacggggacatttaaaatcctccttgcttcaagaagtaaaacaagcaa

SEQ ID NO: 420 - DNA, 371 bp, Neisseria meningitidis
cctactagaagcaatcgcgcaatatcatcggtatgcaagcctgttgttggttcatccagaatataaaagtttttcccattagaatttttatgaagttcactcgctagcttcatccgctgtgcttccccaccagataaagtagttgccggctgccccaatgtcacatagcctaagcctacatccacaattgtttgcaatttacgatgaattttaggaatatgtttgaaaaattctacggcatcttccaccgtcatatctaaaatatcagaaatgtttttgcctttataatgaacttctaacgtctcagaattataacgtttgccatgacaaacttcgcaaggcacatagacatcaggtaaaaagatgcattt

SEQ ID NO: 421 - DNA, 372 bp, Neisseria meningitidis
ccggggctttcaaattggctagctctgtttctttttcagccaacagttgttcttgtttagccaattcgtctttttgcttttcaagcatctcagctggaattcctggttgttgctccaactgcgcaagtgcttgttttcccgtttccagcgcttgccgaccttggttaatgtccggctgagccgaatcacgcagagccgcaacctgttcttctggccgatttttcagtgcctcttttacttgatttaaggcctgctctcttttcttttcataatcagaggaatacgtattttgatgttttaatgaacgaaatgagattagcaattctggataccgttgactgtcaaaggctttttccgaaaccacgccaaaaa

SEQ ID NO: 422 - DNA, 363 bp, Neisseria meningitidis
ccgaattggagggtaaacctttttcaatttttgttaatgcaggagagaaagttactaccgaaacattattagccgaagttgattttgatcaaattaaacaagcaggaaaagatccatctgtcatagttgtttttactaaacctgaacaagttaatgaagtcatcttaaatagttatacaactatatatggtgattcgtgtggtaaaattatactttgacgtagagttaagtatgttatcggattaaatttaaatgaataaaaggtgattatagactgtgagttatagaatttaagtaaattatattaacaaaacaccctactattatataaatcagtagggtgttttctacttatccgaactt

SEQ ID NO: 423 - DNA, 397 bp, Neisseria meningitidis
  misc_feature (378)..(378): N is any nucleotide
  misc_feature (383)..(383): N is any nucleotide
ccgttttgcaattttactacgttacttaccagtgaaaaaacatttcccttatttaattcttggttttactgtaactgctttactaggaacaatctttacaaacatgcaacttttaggaacatctgttgcgagcgttgtgaaagacttcagtggtgtatttaacgcactaccaatgttagcagtcgctttaattggtttcgctttagccgcaattagctacaaaaatggtcaaatgattccgagtgggccagcagccaaaaaagaacatgcagcgaatgattcagacgaaggagagattgaagatgacgaaatctaattataaattgacgaaagaagattttaaacaaattaatcgcagaagcttgtttactttccaanttaangggggggttttttt

SEQ ID NO: 424 - DNA, 371 bp, Neisseria meningitidis
  misc_feature (365)..(365): N is any nucleotide
ccagccattgcagtcgaagaagttgattttttaacggaaacaattaaagaaccgaacgcagtagtagttccgtttctttcaaaaagaggcgtataaagggaggaagaaggaatggaatttgtaatcattttgctgaagtcattgcttattggtggtttactaggttttgcagctggcgcaggcgctgctcggatgtttcatgcaccacaaacgcaagggttaggggcatttagaacattaggagaaatgaacgcggcacaaggagatccagcatcacacttttcttttggtttaggttttttctttaatgcttgggcttcggccgtcggagcaggggcctttacacaagatgtgacccaccgganttgttt

SEQ ID NO: 425 - DNA, 379 bp, Neisseria meningitidis
ctgaagattatcatcatgttaaatatacagatgaagcgattaacgcagcagcaaacttatccaatcgttacattcaagatcgctttttaccagataaagcgattgacttgttagatgaatctggttcaaaaatgaatctaactatccaactcgtcgatccaaaaacaattgataaaaaattagcagaagcggaacaacaaaaacaacaagcttccgcagaagaagattttgaaaaagcggcttattatcgtgatcaaatcaataaattacaagcaatgaaagaaaaacaaatcagcgatgaagaaacaccagtcatcactgaaaaagatattgaagccattgtggaacaaaaaactggcattcctgtcggtgacttaaa

SEQ ID NO: 426 - DNA, 361 bp, Neisseria meningitidis
cctgtgaataatccagccaaattaatcgctttaactgccttaagttctgtgggaattaacttactagttggcgaacaatatttgtcaattattttaccaggggaaacatttaaatcctcatttactcgtttaggtattgataaaaaatatttaactcgtactttggcagatgctggggcggcagtcaactcgttaattccttggggagttagtggtaccttcattatgggaacgttaaaagttggtgcactagaatacttaccatatgcctttttcccattgctttgtcccattatcaccgtcattttggggatattcttaaaaaaacaacaaggggaaaacaaaaaagcaccagggacta

SEQ ID NO: 427 - DNA, 362 bp, Neisseria meningitidis
cgagggactttacaatcagttggtcaggttgtcgccagtgccaatatggtcaatgagaacgcagttcaacttgcgatgctctttaaaattatgcggattgtcctactcgtagcagttgtctatttatttggacgtttcaagcaaagtaagacggcagaatcagaggctgagttggtagaagtcaccaaaaaaagcagcgccctaccttggtatgtagttggctttttcattgcctgtgtctttaatagtttgattcatttccccgtcgtgatcagtgagactgctcatttctttagttcttggtttgaaattactgccttggcagcaatcgggttacgactcgattttaaaaagtttttcca

SEQ ID NO: 428 - DNA, 378 bp, Neisseria meningitidis
ccggcgcaccaacttggaatggccgagaatatgtacaacgcttaatcgcagctgcaggtatcaaacaagactataggacgtcattagcccaagctcaattaattaattggtgtatgttcaatgggcaatggttaggacaagtaagtccattaacagttgatgaatttaaagttgtcagctcgcctaaaacagctgcttatgcgtttgaattaaactttgaacgtccagctgcagcacatccagaaagacaaacctatgcacaagcatggtatgacaaattcaaagatttgaaagcttctactgcaacaggaaaagctggcatagaacatttggagaccttaatgggcaaatggcttggtaatgggcaatgttatgccg

SEQ ID NO: 429 - DNA, 359 bp, Neisseria meningitidis
cgaactggttgccaaagaactctaccaagactcgactgcagcagttaatcgaacttttccatataaagagcaactttttaccattgttggcgtgacaaccaataccagcggtgccattggtccaggtaatgatgactcattgctttattttcccaaaaagacctatgaacattatttcggcaagctaaaagatacatctacgttgaaactaacagtagcacctggctatcaaccagatcaagtattgaaagaaacaataaaaactctctctcaacaaggaaccatgaaaaacagtgggacgtatcaagaatataatgttaaagataccatcaaagaaatgggctctttattaaataatt

SEQ ID NO: 430 - DNA, 376 bp, Neisseria meningitidis
cctgattacggtcgttattatgatgccgtttatgaaacgttgaaaaatggtgcaccgcaactagtaactaaagagcaagcattaactaacatcgaaattttagaagcaggttttcttaacccaagtccaagtgtttatcatttgaaagaaaactaaagcgtatttaaatgacttgaaaagcgcctgccctacagtccagacaactgtggggcaggcgcttttatttataaagaattgtgaattttaatataagaaacgtatattgttagtaaaaataaaaaaaggaaagacatcttagtagcactacttccccaagaattgctactaaaatgtcttttgtgatgctcgctcaattgaagagccttaaataggatat

SEQ ID NO: 431 - DNA, 362 bp, Neisseria meningitidis
cccctaagtaatggtcaattcggaaaatatcttgttcaggaaatgcagcacgaatttcttcatttaattcgtaggcagattcataatcagaaccaaatggcttttcgataattagacgatcaaagccttcttccgaaataatatgttgtgatttcaagtgattaacaatggttccaaagaattgaggggccatagctaaatagtaaacatgattgccttctaagtggtattgttcatttaggcgatcagataattcttttaaggtattataatgttccgtatcattcacattatgtgattggtaatagaaatgactagaaaattcagttgcctcttcggccgtgggatttaagtcttgaatg

SEQ ID NO: 432 - DNA, 375 bp, Neisseria meningitidis
ccggttctttctaaaggtgaaaataaggaaacgccatcttccgttcgatgactagccaaggcataattgtttttccccatgacttgatcttctttcatggtcccggcaccagttaataaagcgacattggacaatcctttaaaaatgggcaaattaatttcgacacttggtatcgcaatggcaccaatcacaggtaagtttttgttttcaaattgggctttcatcaccgcttctgtgctcaaggactcaactgaatcaaagtcaaacgttgtttcacgagccatatttttcttcacatcagctggtttcaacttgctaacggcgtacgagcggctattttgttgaaccacccaactacgtatctgattgttaaaa

SEQ ID NO: 433 - DNA, 370 bp, Neisseria meningitidis
ccggcgtaaataagaagaaacctttactttttttaaacaaccaagtacctatgccaaatacagctaatgaaataataatgccaacatacggattcatgcgcgaacctctcctttcgctttcttcgttgctgcgggttctttttcttttcgagcatctttcatatgcaataaaaaggcgcccgtccaaccagttgttgctagtaacgctaatgttgctactaaaataacaaaaataatttgaacgccaaattgttgcataatccctaaagaattaactaaggaaatccctgaaggaacaaataaaaatgtaataaccgttgataagctattacctagcccttccacttgctccaatttaacaactattttt

SEQ ID NO: 434 - DNA, 357 bp, Neisseria meningitidis
agtttatctttggtcgattttccttgatatatatataatcttcaggaaatgctcctgtctgtttaaaattcggaatttcagaaattattcttttttgctaaactagttataactggttagtaaaaagaagtattggacgaatagtgctgaaacaagtgaatgatccaaagtataaagaaaaatgaaaccgataccacaagacaagactgttgctgaaaatggtaagtgatcattctgctaagtttagtgtcttaatgtttagttaactaagaattgttggattgtactttagaaagaagggacaatatgaagcgaagtaaatggaaagaattgatagtaacgggcatctgccatata

SEQ ID NO: 435 - DNA, 362 bp, Neisseria meningitidis
ccctgttaaatcgtcttcatatttttccatttctgtaagtgcaatagctttaggataatcgaagctagttaagtaaagatgcgcattcggtacttgctttaagtcctgaatcatctcatccacatctttagttgctaaagctgaaaataaaatatgaatcgtgtgttgtggaaactctttgcgcaagttttcaactaagcgttttactgcatgatcattgtgggcaccatctaaaacaatcaacggttcatcactaagacgttccattcgagctggccattgcgctttagccaacccttgagtaatgtctcgttctttaaatggcaaatgttgtagttggcaatacttgtcaaataattgaa

SEQ ID NO: 436 - DNA, 354 bp, Neisseria meningitidis
cggaacgaatgatgcctgaagagcgtttattagtgatgcgccgtttatgtgcgaaagatactccagcctttatagtatccagaggactagaaatccccgaagaattaattacagcagcaaaagaaaatggcgtttctgtattacgttcaccgatttcaacttcccgtttactaggggaactatccagttatttagatggccgtttagctgttcggacaagtgtccacggagttttagttgatgtttatggacttggtgttttgattcaaggagatagcggtattggtaaaagtgaaacagctttagagcttattaaacgtggacatcggctaatcgcagacgatcgcrtcgatg

SEQ ID NO: 437 - DNA, 370 bp, Neisseria meningitidis
tgaccaagaaacggtggtcattgaaatggcgaaagcaacggaattgaattggttaaagcagcagaacgcaatcccttgatcacttctacttatggtacaggagagatgattcaacatgcgctcaatcatggggcaaaaaaaatcattatcggcattggtggtagcgtgacaaatgatgggggtgcaggtatgattcaggcacttggtgcgcgtttgttagacaaggaagggcaagaattgacacgtggcggtggtgcattagataaactggcgcagatcgatttaacacagtttgatcaacgcatttttgctaccgaagttctagtagcaagtgatgtgaataacccactaacagggccaacaggggcgt

SEQ ID NO: 438 - DNA, 361 bp, Neisseria meningitidis
ccgcttgtcaatctatcactttggttgtcttcttttaaagaaggcaagatttcttctttataaagggtttgatagaattcgtttgattgtttatccaaagaagcttcatactgatttgttgctttgcgccagacaaaactgaatttattggcatccgcttcgatttttgtgccatcaatatatagcgcttcattgtcaattacctgattggtgattaattgacagcggaataagacaaaggcttctgctaaaaggtgagcagttgtttcctgactttggaagcgattgatggtccggtaactgacttgttcgtggtttgctagccaacgcatacgatagctgtcatctaatagaaatccaa

SEQ ID NO: 439 - DNA, 559 bp, Neisseria meningitidis
aaagcattctcaaaattctctcgctataccgcagacggtaaacaagccgttggcgaaatcaaacgacattcatacggcacacccgccgaaaatctcattatcaagggcaataatctgattgccctgcattcgcttgccaagcagtttaaaggcaaagtgaaactgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaccgaacaggcacatttgaaaatttcactggatgaacttttcggaaatgaatcatttcacctgcacttttatttgggaaaaaaagacaggtgcgtccgatgccaaacagatagcgactattacatagtttgtcttatgttacacaaagaactttaaaacagttaaattagatttaaacacgttttcatatgatacagagagatacaaattaagtgataagtttgaacacgagagaggc

SEQ ID NO: 440 - DNA, 364 bp, Neisseria meningitidis
ccggcaatccatatgtgatgggcgcaattttaggtgctattatcccgattgttggtatgacaccgttaagttcaatggttttaactgccttgattggtttgactggtgtaccaatggctgtcggtgcgttgacttgttacggcagttccattgtcaatgcggcgctatttaaaaagttaaaactaggcacagcttcaaccccgttagctgtggcaattgagccattaacacaagtcgatatcatcagttccaatccaattcctatttacgcaacgaatttattttcaggaatggttagtggcattgtagtgaccttctttggcttaaaagtacctgtracaggaatggcaacaccgtgggcttg

SEQ ID NO: 441 - DNA, 375 bp, Neisseria meningitidis
ccgacatgtggtccatcacccgaggatgtaacgttgctggttggacattcaatgcttgcgtgtcttcttcaaaggctttgataaaacgctccgccacttccggcgcagtaattttcaattctttagctgccttgataattttatcatcgacatctgtaaagttcgagacataattcacttcatacccacgatattcaaaataacgacgaatcgtatcaaaggcgatcgcactgcgcgcattaccgatatggatatagttatacacggttggtccgcagacatacatccgaactttacgcgcctcaattggcgtaaatacttctttttctctggtcaatgtattataaattttaatcatgccctttttccaccttt

SEQ ID NO: 442 - DNA, 328 bp, Neisseria meningitidis
ctttaaaagaattcttttctaatattgatgaaattacagatttaataaaagaaaagatggatgaaactggtattaaactattgtggaatactgcaaatatgttttcaaatcctcgttatgtcaacggcgcacatactacaaataatgcaaacgtatacgctatcgcagctgctcaggtaaaaaaaggtttagatgtttcaaaaaaattaggtggagaaaattatgttttttggggtggacgtgaaggatatgaaacattactaaatactgatatgaagtttgaacaagataatattgcgcgtctattcaaaatggctatattttacgg

SEQ ID NO: 443 - DNA, 375 bp, Neisseria meningitidis
cccgtttcactcaattacaatctctaccaaccaagtagcggaccatctaattgatttagggctggttagttcctttgatatgtgtaatcagcggattttaccttttattgaatccgttagtaaaaatgcggcccttaacagtttgctaaattatcgcgatcctttaggtacgcactttcaacgagcaaccgctgccgaatggcttcagacacaaggcgttcggaccaatgccgaagaagttgccattgtatctggtgtccagaatggactggccgtgacgttagccgccgctttttctccaggtcagcggattggcgtagatcgatacacgtattcaaattttattgaactcgcacagctttatcatttagaaat

SEQ ID NO: 444 - DNA, 358 bp, Neisseria meningitidis
cctgaattagttatgatcatttctacgccagctattaaacttgtgacgactgttcctattgaatatgtcattttttttattgttcagcatcttttttatctagtggtaattggggtgattgagtttatacattgtttgtttacattctttttgaaacgaagagtgaaacaaattaatagtctcaaagtgataggtgatagtttattaatgatttttgctactttttatttttttgattttcgttatggtttagaattatttctagcaaaccaattgtggagtatctcctatatgattcctatcactttttttctaatagtggtatgtttaatgcttattagtataggcctattaagac

SEQ ID NO: 445 - DNA, 375 bp, Neisseria meningitidis
ccttcaatttttactgtttagcttaagctgatttgaatagagtatcaatttcttcccacggggaaaagtcgaagagaccaatttctcttcgactttctttgtataaagcagaaacaacttcgattcctttaatcgttactgcagctgtataggtggactgaaagttgttgccataaggaagcttccccttcaactgtcggtgatcctgttcaagaatattattgaggtatttcgacttccaatgcttcactttttggtatagaattccttcttctttcagctctttgatcgcttttaatgaaggagcatatttatctgttacaatggaacgtggttgaccgtagactctgattagacgcttgaaaaagagcttta

SEQ ID NO: 446 - DNA, 365 bp, Neisseria meningitidis;
  misc_feature (361)..(361): N is any nucleotide
ccagaaatcatgacaatgtgaaagtatcgtatgcctcattggaacgctatttagaagatattcatcgcatggtggaaaatggtttactttctgaagaaaaagaattttatgcgcctgtgcgcttacgtggcgggaaacaaatgtctgatctgcctaaaacaggtattcgctatatcgagttgcgtaatttagacttaaatcctttttcacgtttaggcattgtggaagatactgtggatttcttacattatttcatgttgtatttattgtggacagatgaaaaagaagaagcggatgaatgggtgaaaactggggatatttttaatgaacaagtggctcttggtcatcctcatgaaacganttaa

SEQ ID NO: 447 - DNA, 380 bp, Neisseria meningitidis
  misc_feature (376)..(376): N is any nucleotide
cctccttggcatggcaactactggaactgatggcaaatacacagtgactttagagccagggaaggcctcagctaacgaaacaataactgtcgtagcgaaaaatgcaacaggaaaagaaagtcagccagctacagcaactacaccagtcgacttagccacaccaaccattgattctattaccggaaattctagtaaaggttacgaaatcactggaacggcggagctaaaaaccactattgatgtccgtgacgcagacggaaccatcattgctgctacaactgctaacgaaaccggccaatatacggtgactctaccagctggcgtagtgacaccaggagaaacgattacgattattagcaaagatggcgcaggtaantgaa

SEQ ID NO: 448 - DNA, 375 bp, Neisseria meningitidis
ctgcttaaaaatactgttttagtgagtttaggtacgaatggtccttttacagaggcacaatttgatgaatttatgaaagcgttaggtaatcgaaaagtttattggattaatgttcgcgtcccaactagaagatggcaaaatcaagtgaatagtttacttagtcaaatggacaaaaaatacgataacttaacggtcattgactggtttaattatagtaacgcccatgatgattggttttatgatgaccgagttcatccaaatgtggcaggtggcgagcaatacacacactttatcgcggagaaaattttacagtagcaagaaacttccagctcagatgaaaggggctggaagttttttgttataggaaaagcaaat

SEQ ID NO: 449 - DNA, 362 bp, Neisseria meningitidis
ccgtggaaaaacttttgttaaagctagagctaatagataaacgaatcgaacgcacattatttcgacaaaaacattttgagcggttttgggctactcttaagcctttagagcaacaattgctcattaggcgattcaagtataaagaagaggttaattgccctcacaggcttatagagagcgtattagatgagattgaagagatagaaacagctatttgtttgatggaaaatatagaattagaagaaaacgagctttccgacgatgtagaagaaaacttagagaggatgtgtgacttctttgctttatgaacgtatccgtccagagtttcatcttgcacgctggatatattacgaaaaagcacg

SEQ ID NO: 450 - DNA, 375 bp, Neisseria meningitidis
cctgatcctaaaaacggctttgtttatagcttcctcatcgttgaaacaattcaaaatggtgcagaaatctcagcggggaaattagcacccaatgaactaggtgtcacagctgtggatgattatacattaaaggtgacgctcaaagagccaaaaccgtactttacgtccttgttagcttttccgacatttttcccgcaaaatcaaaaagtagtcgaacaatttggtgcggactatggaactgctagtgataaagtcgtctataatggtccgttcgtggtaaaagattggcagcaaacaaagatggactggcaactagcaaaaaataatcgctattgggatcaccagaacgtgcgctcagacattatcaattataca

SEQ ID NO: 451 - DNA, 360 bp, Neisseria meningitidis
cccccattttagaacggatcatgaatcaatatcaagaaatagctgcggctttacgccaagcgttgccgcaaatttttccgcaaaagaatctatcggaagaggaaattgcctacatggtgcttcattttgccaattctttagaacggagtcccaaaattatggaagttgatattgctggtttttctcctagcggtttggcttcgacaagtatgctggaaatgcgattacggcgctactttccttttatcaaccagattcatttttttcggattgcggatttaggtaaggtgaatgttgaggaaaactatgacttagtgatttccacttcgttattaccaggatacaatggtaaatataaat

SEQ ID NO: 452 - DNA, 377 bp, Neisseria meningitidis
cccgttgcgctacttgctgatgttgcttccttagcgctacttgctactgtcggactactttcaatcgtgattgtttccgcaactgcggtcgcgccagaaaaggcgttaatcactaaagaactacacaagccaatggttgctaatcgttgccacttagtttgcttcatgtcgtcccttctttctctggaccattccgacaagaccaatcaagacaagaccaagaatgctcaggtttgcctgactcttgcttcctgtacgagggagctgcgagccagctgtggtggtctgtgtcgaaccaccacttcgttgatctccttgcagaggaccagctggttccttgggatccgcagctggctcatctgttttcggtggggggc

SEQ ID NO: 453 - DNA, 339 bp, Neisseria meningitidis
cctaagatttggcttatgagcttgggacagcgcttaaaaacgtttgtctctttgctgataagtccatttttttataacggaggtggctagagtgaaagcctgtggcattatcgtggaatataatccctttcataatggacatcgctatcatgcccaacaagctcgccaacaaagcggactgatagtagtgattgctataatgagtggaaattttttacaaagaggagaaccagccttactagataagtgggccagagcagaagaagctttgcaaaatggtgtggatttagtcattgaattgccgacagcttggtcggtacagtctgcggattactttgc

SEQ ID NO: 454 - DNA, 532 bp, Neisseria meningitidis
ccggagcgagtacccaaaaatcgcgtgggaacttttgctgaatatattgcagtggatcaagcggctgtagctatgaagccgaaaaatttaacgtttgaagaagctgcggccattccgttagtcggtttgacaagttatcaagcgctacatgatattatgaatgtacagccaggccagaaagtcctgattcaagcaggttcaggagggattggaaccattgcgattcaattagcaaaactagcaggcgcttacgttgccaccacaacgagtagtaaaaataaagaatgggttcaagcgttgggagcagatgaagtgattgactatcggacacaaaattttgaagaagttttatccgactatgattatgtgtttgatacaatgggggggacaatcttagaaaaagctttctcagtggttaaacctcagggaaaagttgttacattgtcaggcattcccaacgaacgttttgctaaagagtatggcttgccgctttggaaacaatgggcctttaaaatagctacccgcaagattg

SEQ ID NO: 455 - DNA, 519 bp, Neisseria meningitidis
cggaattgtatttactgcagagacagtttaaggaggacacgcaatgagcaaaggtccgttagtcactcggacagagcttcgcaaacgcagagaagcagaagaaaaagaagcggaacgtcgtcagcaagaagagcagaagctggcggaaaaagcgtataagcgaaaagaaaaagaaatttcgacgttttatcgtaaagaaaagaaaaaacaaaaaccgatcaacaagtcacgagtaggagaatactcgaagcgtcgagaacggagtacttggttaaacaaggcaattattattgtagcgattttattagccgttgtggcatatatcgttttgaatttatagaaaagaggaatcactatgaaaattggaattattggagcaatggatcaagaggtcaaaattctaaaagaaaaattgacagacacgatgtcatgggaacgagcaggcgctttatttgtttctagttcgttaggaagacatgaggtgattgtagttcgttcaggaattggtaaagtggcctc

SEQ ID NO: 456 - DNA, 503 bp, Neisseria meningitidis
ccggggttgaaggtgtacatggagaaaaacaagttgagaaaagtgggcttaactgccctggaatggctaaaacaacatccagaaattaaacaacataaagaatcaagtctctatgaacagttgtttgctagtcagcaatggcaacaagcacaaacgatcggaatgattcggtcgttaccgctagaattatcaacacagccaattttcgaacgggccatgcaagagagcaagcaagtggcggtgccgcgaacatttaaaggaggcaaaatgcacttttatcaagtctttccagagacggtttatgataccagtgcatttggcgtggaagaacctccgttaacagcggcagaaataacagctacagcgattgatttattgattgtgccagggattgttttcaatcgtgctggctatcgaataggcttcggcggtggtttttatgatcgaatttggtacatttttcggggcattcatgtagtttagttttacgtgacactcccatg

SEQ ID NO: 457 - DNA, 500 bp, Neisseria meningitidis
ccggaaaagtcgctggccttggcacccacgaagaattacttacttcttctaaagagtatcaagaaatcgttgcgtcacaggaggaggataccatgcaaactaaaaaaattcattttggtgccttctcacgttttaagccgtatttactacgctatccaaaagaaattattggcgccttaatcctaggaattctcagtggtttttcgactgtcctcatgacttattatataggtaaatccgttgatacaatggtgggtaaaggacaagtcaatgctgcgcaactcatcaaaattttaggtttattagcagggattttactcgtaaccgttctaagtcaatggctgattcaacgtctcggtaatcgcgtgtcttatttatcgaccacacagctgagaaaagatgcctttgcccatttaaatcaattaccgttaagttattatgaccaaacgtcacacggaaatatcgtcagtcgctttaccaacgatattgacaatatttca

SEQ ID NO: 458 - DNA, 439 bp, Neisseria meningitidis
cgcggtcgtttataaaccattagaaccgttagacacaccaacgattcattttgaaaaattatatggacctgatcagaacggggcatatatttatcgaataaacgactagtgattcattcatggaatgaggtttgaatatgggaaaagtattgaatagaatcggtcgacttattttattagttacaatgatcggctcgtatacgatgtgggtcgtaggaattgatgcgccagtcacaaaatatatgtatgccaatagttcaattttattattaatagcagtaatacttgtactgctattaaattgtacgatattaaaatttattgactggctgaccgtagcgttggcgctagcaacctggctcttgtttcactttacggaatcaatccgtcatagcacgatgcaaacagatacaatgattcctttaattattttattggt

SEQ ID NO: 459 - DNA, 495 bp, Neisseria meningitidis
cctgctgtgccgttgcgccagaaggaagcatcagctagaagtgcgtcaattttttcttggaaaacagaccatttttcctcaggaaattttttttcaaagcgtgtttttgccgcttttgcaaaatttttcaaaacaagcgaatctttttctacgttttgatgagcgacatgggtgttaaacaagaaagtaacaaacggtccatgaacttcttcagaaaataatgttgataagctatcttatttttgatttgccataataaaatcccccttctaaaagtaagtgtagcacaggaaatcgaatgtttaaaacaatatgttcaataaaagaaaacgcttcaactaatctcaataaaggactgttaatggtgttctaataaaagttttataaaaaatatagctgaaactcatgataaaaaaggcacaaaccactatacttacgttatgccaattatcccgaattggtatgttcatacttactcctaccaagagtacataa

SEQ ID NO: 460 - DNA, 853 bp, Neisseria meningitidis
atctataattcctgaatctcaaagatcaattattccagttaatctattattgccatctaacaatagatgattacaactaaaatcattatggcataatcactttttaccctcaaaaactgttgttgcatttagtctttccataaaactatctatataatctttttctatatcagttaaatcattataaatagtttcacgcaacaatatatactcttctaatacattttgtttattatcaatagtacattcactaatatctgtataatctaaaccgtgcatttgtcttaaaaaactggcaatatctcgttttaacaaattttgttcttcttctgacatagtagaataaatttctggtgttaaaaaagttcctttaatttctttataacctagtatagataattcatcactaatatacgaatattcaatattaggaatttttacattagtttctaaatttgtatttaaaaaattatatattgctttttcttttgcataaccttttttcttattagtactaaattttgttttaaaaatgtattcattattaactaaatatgccacactatcataaccactaccgattatttcaatactatctactttgaaattatcaaagtaatgctcaattaaatatttcattgccttaacatttgtggcattatcatcatatctatattccattaaataacaatcttcttttttgccctcgtgtaattcatgttctggcaaatcttcaataattctaaaaccagatttttggtatgcccttattgctctatggattatttttatgagggactaaaataactgcattagcatttctttcgattttcaaaaattcaaaaatcaattg

SEQ ID NO: 461 - DNA, 499 bp, Neisseria meningitidis
cctgcaaaggctcttacttctttgatgtctttaaactccaacttatgccctatcacatttattaagtttagcaccctttggtcagttatcccatctaaatgatctaaaaaattagaataattttcttttcctaaagcttcttgcatgtttgttttgtctaatacggattttaaatcgagtttagttgcactaacttttggatgatttaatttaataccccactgcttacttgcgaattcatccaataaatcaccaaacatctcttcatacaatttatctatgtcatcgctaatttcaggaataattggtatttcagtacaacggcaacgtccatgatacggtggatgccaatcatctttaatctcttttccatgacgtccaccacaaatagaacaaacacgctcatcttctgccgaccagctttgtgtttgcttaacacctatatcctttagcgattttcttacaccttctaccgcaaaatgtgaatattccgttctaa

SEQ ID NO: 462 - DNA, 504 bp, Neisseria meningitidis
  misc_feature (249)..(249): N is any nucleotide
ccgattaataattttattcaaaaagcgcgtcgagcaacaaaaaccatcggacttggtggcaatggtcagttttttcggttatcaatgattaccgaacacttaggctatcagccttggggaaatgctttgttggatgactatgagttaaccattaaattaatgctgaaagagttatcgattgcttatattgacgaggcctttatggctcaagaagcactgagagatgtgaaacgttttattcgtcaacgngtcgttgggttcaaggaaatttagattgtctagcgtatttacccagggtgattaaatcaaagtcattaacgctaaggcagaagtgtggaatctattattttttagcgcaaccctttattaatctcgtagcggggatgctcgtttttgtcttaactgggcttcaactgcaacacttgtataggttaggcttttcgttatcgcttgtcattagttttgttttggccgtcagtatttcgttagttttcggcatttttt

SEQ ID NO: 463 - DNA, 506 bp, Neisseria meningitidis
cccggtttgcaagctgcgcaatgcttaacgttagaagaagtagccaaacaaatggctgctgaaacaatcgatcaatgcctgttgcccattgagacagcagtagaacaattcccacgaattgatttatcagatgaattgtatcaaaaagtaaaaaatggcatgcgtttgcacaaaaaagaattaggaataaaggcaatgccagaatccttagtcgccttattttaccaaaatcaagtggttagtttatacatgccacacccaacgcatgataaattattgaaaccaagtaaagttctacggaacaattaaataaaaaagaaggaagtttttgcacatgcaagttattcaactacatcatccctatgaacccaatcaaattcctaatgaagaagtcgtgatggtcctaggcttttttgacggtgttcacaaaggccaccaaaaagtaattgaaacaggtaaaaagattgcggaggaaaaaggcttgaagttagctgtgatgaccttcg

SEQ ID NO: 464 - DNA, 227 bp, Neisseria meningitidis
ccgaggggattggcctgatggaacggaaaaaacaggggcagggacatcccgcccggatatacgttaaaaattttatcttggaaccggaacccaccgcgccggttcagactgcggaaaatcagcagtcaagaccgcttcccagtgccgccgtcaagactgctgaaaaaccgcagtctgcaccacgggaaaccagcggtcaacagtgcggcatttccgcccctaataat

SEQ ID NO: 465 - DNA, 503 bp, Neisseria meningitidis
ccggatctaatcctagttgtccagaaatgtacaacgtatttcccgctaagacagaatgtgaataaggtcctacagtagctggtgcctgtgcagaattaatcattttgtttgtcatcgttttcctccattctatgattctttattttcaattaaagtccctgtttttccagataatccttctttggctttttctaataacgtaatcaatgtttttcgacctggcttagattcagcaaacttaatcgctgcttcaacttttggtaacattgaacctggagcaaactgaccttcttgcgcatattgtttcattttttctgttgaaacattccctaaggcttcttgattttctttaccaaaattaatacaaactttttcaactgctgttaaaatcacgagcagatcagcatccacttgttcagccagtcgttcactacaaaaatctttgtcgatgactgcattgacaccttttagtcggttcccttcttgaatgactgggtatgcac

SEQ ID NO: 466 - DNA, 492 bp, Neisseria meningitidis
ccgaagaactttttttgaacccacattgacaaattgctcaattgcctgcgtggcaccgccacggttatccaagagaacttgccgaatattcctatgctcagtggttcgatcaaggacaacgatcgaatggcctcgttcagcaaacttttcaatttcttttgttggaaatgtccaatctaaaataattgccccatccaccattttttcaggaatgataagatgtgactttttaccgctgcagacaatcatctcataatcaaacagtgctaagcctttcttaattccctccaacaattcaccataaaaactaccgccataatcagccaaatagacaccaataatattggtttgacgacgttttaatgtgcgagcgggcatgttaggaacatagtttagctcttcagcaattgcttggatgcgcgttcgtgtttcttcagttacctttgaactaccattcaatgcgtaagaaacggtcgagattgatacgcctgc

SEQ ID NO: 467 - DNA, 523 bp, Neisseria meningitidis
cccttgatttttaagaatagatacagtagcataagaacaactagttctttcactggcaatcgtcaatgtcatatagaaaagaatgccctatctgtattatctgaaaaatcaaacaatcataaccaattagaaaggtggttattatgtataacttattaaccaaacaggaaattcagttactttccctaattgaatacttgtatgacagtaaagaaaaagtccccatgcaagtactccgacgaaaatatgaattttcccattacaatatcaacaatttattgaatcaattaactttgttaatttctcgagtcaatacacatgaaaatgtacatattcgtattattaataatcaacagtccatagaattagtcgcggatgaaaatatcccgattgagttaatgaaagaagctgttgtccgcgggtcactaacctatatgttagcccaggatttacttttaatacgctacacttcagccaaagatttttgtgaagagcctttattaacttttctattttttaacag

SEQ ID NO: 468 - DNA, 482 bp, Neisseria meningitidis
ccaactagaagaagaaaatcaactatatcagcaatccattaaaaagctaacggagcaattattaatgcaaaccaatgaagtggaagcattacaaaaacaagtagtcgaaaaagatgttcaacttaaacatgttaaagaaacattaagtgataaagaaacaactatcacttctttacagaaacaattgtctgaagaaaagatgcaacagagacagaccagtgaagagaatttagacacagccgttacgctttctcaaaaagaaattggcgaagtgttattagaagccaaacgtcaagcaaaagatacaattagtcaagccaaccaacaagttgcaacagttcatgaagaaatggaacaacgtttagcaacttttacacgcatgaagcaagtggcaagatagtaccaagcttattgtgaacaaatgcagacaatcaagaatgaatcaacaggaacgtaccaacagatagagcagttattagcag

SEQ ID NO: 469 - DNA, 523 bp, Neisseria meningitidis
ccggtgttattcatgtttgattattcgaaagaaccagtaaatgattattttctaatcgacatgaagtctttttatgcgagtgtcgaatgtatagaaagaaatttagatccattaacaacagaacttgttgttatgagtcgaggtgacaatactggttcaggattgatattagcttcttctcctgaagcaaaaaagcggtatggtattacaaatgtgagtagaccacgtgatttaccacaaccatttcctaaaacactacatgttgttccaccacgtatgaaactatatatcaagcgaaatatgcaggtaaataatattttcagaagatatgtggctgatgaagatctactgatttactcgatcgatgaatcaatcttaaaagtgacccgatcactgaatctttttacgactgaaggaacacgaagccaacgtagaaagaagctcgctcaaatgatccaagaacgtattaaagaagagctaggattgattgctgcagtaggtgtcggagataatcccttgttag

SEQ ID NO: 470 - DNA, 469 bp, Neisseria meningitidis
ccggctccaacgtaccaactgtttttgaaatgattgatgatgccaaagtaattcctggtttaaccttaacagaaactgtctctttaaactatgcgatggaagaagaaatggctttaacacccgtcgactttttattgcgacggaccaaccacttattattatgcgtgatcgtttggaccaagtgaaagcgggagtcattgaagaaatggcacagcattatcagtggacagcggaagaaagagcacgacacattgaaacattagaaaaagtaattgaagaatcagatttaaaaaatttgaaagtagggtgaagaaaaaatgggaacttcgatgatgacacaattattcggtgaatttttcggaacgatgattttagttttactaggggatggcgtctgtaccgcagttaacttgaagaaaagcaaagcctttgcttctggttgggtcgttattgctttaggttggggcgc

SEQ ID NO: 471 - DNA, 516 bp, Neisseria meningitidis
cccgtcttaaacggctctacactagagaggtatgttacagcatatctctcttttcaatgctattatagcacaacgaccatcaaaagaccatcaataaaaatgcccgagcctcttatttttctaaggctcgggcatttttattttaggggccagtcactaaattccacgtgacggcggcttggtattgttggccagccataccttggttggctggcacttctagtttgatgttagcaaacgtgaagtccaactgatagacgtcactgcctgtgaactgtttgtttgcgaccaccgctgttgcggtattgtcggcggttaaagtcacggtgctggtcttgccaagtggtgtcctggtttctgttggttggttgtaatcggtaaagctggcagcagcggccgttcctagcaacaagcgggtcgttgttggcaagctgtctgtggctgattttggttgcaatagctgggccgttaaactccaattggcttggctagtattcaggcgtaaattagggttgc

SEQ ID NO: 472 - DNA, 513 bp, Neisseria meningitidis
ccagacacagaaattgaacgcaatatgattgaaacgagtcaacttgtcagccgtctaaaagagaagtaggggtgtgcaagcaaatgaacttagaaggattaacgacagaagccagaaatgaagcgactaaaaagattgaccaagtgtcaacattagaaatggtaactttaataaatcaagaagaccaaaaggtagcacaagcaattgaaaaggtgcttccgcagattgctgcagcaattgatgcagcggcagaacgatttaaaaaagggggccgtttaatctattgtggtgcaggaacgtctggacgtttaggtgctttggatgcgattgaattaacacccacatatagtgtgtcgccagaacgcgcatttagtattttagctggtggtgaaaaagcaatgtatcaagcaattgaaggcgctgaagactcgaaagaattagctatcgaagatttaacgcaacatcaattgactgcccgagatgtcgtaattgcgattgctgctagtggtcgga

SEQ ID NO: 473 - DNA, 277 bp, Neisseria meningitidis
cggaaataatagggattctctctgctttattaatgtttatttttgctcctacattaagtaaaataagtccaatagttgatcatactgcgggtatcacagcaatccgtagcctttatttttttttattaattattcctatacttagcgcactaagagggtattttcaaggtctaaattatagtttttcttttggtgtttcccaactactagaacaattagttcgagtagtttgtattttagtaggaacctatctaattatagttcaatttaatggtag

SEQ ID NO: 474 - DNA, 486 bp, Neisseria meningitidis
cccggtcaagtttacttagcaaaagttgtccgcattgaaaaatttggtgcgtttgttaacctaattaaaggcaaagatggcttgatccatatttctcaattagcaaacgaacgtgtgaacaacgttgaagatgtcgtgaaattaggcgacgaagtccttgtcaaagtaactgaaattgacaaacaaggccgtgtcaacgtgtcaagaaaagcgttattaaacgaagaaaacaaagaaaaataatttctttttaaaccaacgaaaaccaaggaagcttcctttcttttcgttggttttttcgttgaaaacaagccctaaaaaagaaatgataaaaaaagctaaagacgatcgccaactcttttgtttatagtcaattagtggtaaaattaatactatcagtctgaagaatatctggggtgtctttgtgaaaaaatttaatccaaataaaaatataatcattaccttaattttagtcattattttagt

SEQ ID NO: 475 - DNA, 413 bp, Neisseria meningitidis
ccttgttaaagttaagaatacagcgttgacatcatccattaccccataaagtaaagcgaataatgagataaccacagattgtgttaacacaacgttacgagaaacgccatatttattttcgcgatggaaaccaaattttggtggcaataagccatcacgagcaacttgaataattgtttttgatggtccagtaacccaagcagataattgtaataacacacctaagaagaccatgaaactaaagatattaccaataattgttggtaaacctaaaacgtcacaataaagcaaaattggttgtgtaatgttagacaattccattttgccatttggaacaatattagctacatacattgcattaatcacgtttaataaaactcacccaattaatgacatgaaaacgccttttgtat

SEQ ID NO: 476 - DNA, 493 bp, Neisseria meningitidis
cctggaaaattgtggtgcgatgactttttaaaacaatcgtactgcctaattttgcttgttggcgctggttatttgccagtgtttgttgctcgataggtaagtgactcaaacgttgccattccatttgatgaggtgtgaaaacaactttttcaggataggtaagggaaaaattgccttggctaaacagggtaattgctgagccatcgataattaaccattgttgtttttgatgttgggcgagtaccatctttaatatttgttgtgcagtagcatctaagcctaaacctggaccaattaaaataacatccgcttgctctacgacgttcgtcagaaggactgtttcttcaaagcccacgaccatcgcttctgggcatcttgcatgtaaaggcccgttatttttaacatcagtaatcacagtggtgagaccagcgccactattgatacacgcttcggtactcatgatgatggctccgcatattgtcggtttctccga

SEQ ID NO: 477 - DNA, 400 bp, Neisseria meningitidis
ccaaaattttggtaaactaaaagatggaagtattggggtaaaaggtggttggcgaatttattcaagcgggccgggaatttatttaaatcaattaattacagctgttttagggattcggcaaaaggcccaaagtgtagtttttgatcccatgttaccagaaaaattgtctggtttaacactaacttaccaattgtttgataaacctgtcacatataaattttatccaaatcagtcagcgaaaatagttatcgatggtcaagaggttccgtttaagtttgaagaaaacccttatcgagaagggggaatggtagttcaaaaagacgaggtgctttcattattaattgaagcaagtgttattgatatttaccattagataggagagtagtccatggtaggaatt

SEQ ID NO: 478 - DNA, 494 bp, Neisseria meningitidis
cccgttcgtttttatttcgattgctcatattagcaatttcggctcttgcccgcaagaacttgtcttccatttcggaaagctctgctttaagattttcaatctctgttgcttcaacttctacttcagaaacgccagcagcatcaacagcttccatttcttcttgtaattcttcttgcttctcttcttttttactcacttcagcaacttcctttctctttatgcatctacttcttatcctaacaaggtttgcttaattacctaaaaaacggtaatagtcacctagttgtgaagctagctcatgtcgaaacgtgtctaccaaaccgaatatttttgaatacggcatactggttggtcctagcagggcaattgttcctttgccatgtcctgatacttcatacgtagcagtgatcatgctcatatcttctaagagattgttgccaatttctgagccgatacgaaaaacaattggattttctgttgttgcagaaccattt

SEQ ID NO: 479 - DNA, 527 bp, Neisseria meningitidis
cctgccccattcgtttaccgaccccaccggcaataattaaagctgtaatcatttgatacaaaatcctttctctaactagtcaaccactagttttatttcaattttgtttaacttatatattcatcaacacagccaaaactgcattcaatcttttacattttctcataactatcagtaagtttcaataatttatcgtagaccttaatcgaactgtaaatgagagtgtaaaatattttgtgtaaatgaaaaaatccatacaaaaaaggaagtcgcttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttctaattcaggtaattcgagaaacggttcttactatcgatcaatcaaaa

SEQ ID NO: 480 - DNA, 519 bp, Neisseria meningitidis
  misc_feature (508)..(508): N is any nucleotide
ccgggaaaaaaattctattctacaaaataaaaacgttagaaaagccattagttatgcaatagacagaagtaattatgctaaaaacattttagataatggttctatttctgctgttggtgttgttgctaaagacgttgcttttgatcctagtacaaaaaaagattttgctaacaaaatgttggtgcattttgatacagaaaaagcgcaatcctattggaataaagcgaaaaaagaattaaatattaaagaacaagtaactttaaacattttaaccaatgaagaagaaacaaccaaaaaagcagctgaatacattcaaggacaattagaagaaaatctaaaaggtttaaaaattacgataacaccagttcctgcaaatgtacaaatagagcgagttatgaaacatgattttactattagtctaagtggctggcaggcagattatcctgaccctatgagttttttaggtaactttgaaagttacagtgtgttgaattttggagggtatagncatactaaata

SEQ ID NO: 481 - DNA, 496 bp, Neisseria meningitidis
ccggtgaaatttcaccgaaataaacatattctgcttgatacatgatattgcctaattgaaaagcgtcatttactttgtccttgttttgtacataagtgttgtatggaattgctgtattccaataaaacttagctagcctgtgttgatcttgtttcgaataatttagcaaatggctagcaatttccgtattaaacacaaataatttatctttatttaaacggtctatctctatttctaaaatatatggatcgtcattcattagctgcagcaattcatagccaagacaactatcttcttcaaacataaaagtagcacatctaagatcgtagcctttccacccgtaagtatttagaatagaataggtttgctgattaaagagcgtatggtctgtacctgtctctcttcttaaaagatcctttgctttttttactcctactaaaccgtgttttctaatgctattgatattggacttatctgttaaatgaattaacttatt

SEQ ID NO: 482 - DNA, 522 bp, Neisseria meningitidis
ccagcgctgcttcttcgggatcaggcgtcgttaaaccaaactctaaatgtgcgccgttagttcctaaaaaagctttgttaaaacgaaaatgttgtagctgttccatactagtggcaccaatgattgctttagtggagagcttcaaagtaccaccaagcataatagtgggaatttccatatcgctaagttttgcagcgtgatgcacggaattcgtcactacatggatttgtttcccaactaaaaaagggatcatttctaacgtggttgaaccagcatctaaatagatcatatcgccatcttgtacacaactaacggctaaagaagcaatcttttgcttttcgtgcgtgtttttgattgatttttccgtcatgttttgttcaaagcctaaattaagaatacgcttagcgccgccgtgaatgcgttctaacaaattggcgtcttctaattcttgtaaatcgcggcggattgtggattctgaagcattgaacaagctagcaagttcttgcgatttgacgactgatt

SEQ ID NO: 483 - DNA, 486 bp, Neisseria meningitidis
cccgcacgttctaaaatttcagcaatttcctcattggttaaaagcggtgcttctttcagttcgtgcttatcaatcagctggaaatttctctccgcacgtggccgtagttgggcacgaacttttgaaaacttcacaacgtcgtctgtaatcgtccattctcctgtaccttcccaagcctgcactgctcgaggcgccacgtaattatcagcccagtataataattcttctttttcaatttcaaaggtcgaaatattgtctaaacgaggttgaataatcgtcattcgcacggtttcaaattcgtaaataatgtcgtacttatccaccgcaccaagcgcatataacatcagttgagggtttaaatacgcatcaacaggaacacctttgccgtatttcaagtcgataatttcaatcgtcttatctgataagacaaccacgtccgaagttccaaatccttctgggacccattttgaaaaatctactttttgt

SEQ ID NO: 484 - DNA, 514 bp, Neisseria meningitidis
cccaaagtgatttaacgtttaattcagcgtgggcgtttaatccttcgaccaatggttatgcgttaggtttagcaatgatggacggtgagcgccgtgtaaacttgttaaattttgccaaagaacaaaagaaagattggcaggctgtcccagtacaactcgagtatatgtggaatcatgacggctcagacagtgccttgctgaaacgtatgtcgaaaagctctgatgtgaatcaattagctgtagatattttggtacattgggaacgtgcaggcactaaaaatgatcccaacgaacaaatcaaacgaaaaacaagtgcgaataattggtataagagactgtctacaggttctatgggggcaggttcagccaatattggtggtggcaaaattgatgtgttagaacaaatgttagggcaaacagtcaatggaggtcagtgttatggggggacttcttattatgttgaaaagatgggctttcaatctttaatgaatacagggcatatgtttgccagtga

SEQ ID NO: 485 - DNA, 506 bp, Neisseria meningitidis
cctgcccgagaatgtggcggaggtattaaaattgcgccttagtttgtctaattcaagcacgaaaaaatatctgatgatggataatgcacgttgttcagataatcgcattcatggcattttacaattttacggtgccaaccgcacaggacggtgggcagggcgattattacaagtacagaacttgcctagaaactatttaagtgaaattgattttgcccgtcagcttgtgaaagcaaaagatgttgaaggcatcgaattaatgtatgaagatgtgccagacacattgaaacaacttatccgaacaggtttagttgccaaagaagggcatcggttcatcgtgtctgacttttcagccattgaggcccgagtgattgcttggtatgccaaacaagattgggtattagaagtattccgcacacacggcaaaatttacgaagcaacagcggcgcagatgttccatttaggcgaagtgacggactacgactggaaaagccacgaaggtaaat

SEQ ID NO: 486 - DNA, 473 bp, Neisseria meningitidis
aagaaaatttatttatcgctagtacgatcaaagaacgggatcgaaaagtagttctagccgaagctttccaggtgttccaattagaacctgccttacttggtcgttcctttacttcttttacgacttttgaaaaaattacaatgcgcctaatacaacttttgctttcaaaaacaagtacgctcgtgattgatgacatcttttcttcattaacgattggacaacgtcaagaaattttacctcaattaccactagcagttcaaccaagaaacaagcgcttgctatttctgacaaaagatccacaaattcttgatagtccctatgtgcaccccctgtctctacatgcgttattaaactcaagaaaacgtctggcactgattgctaccagacgttttctttacgttctcagtaatttcaacatcaggaactgaaataataaacgtggcgactttaccaagttcactctcaacattaat

SEQ ID NO: 487 - DNA, 479 bp, Neisseria meningitidis
ccgctcattaataagaacaggttcgggtagtagtatagaagatgctccaatgttcgcttgaaattctggtaagatatctgccagtgaataggataaagtatcttttgtgtcggtgaataccttattttcgctatctaaatgatacatggcgtgaataagttcatgagatatcgtgaaattttttcttttttcgcccatgttagaattataagctagcgtagtctcgtaatcatctttaataatcatacctgatatagatctacgtgctgttttttcaaatggaaagggccttattttaattgatttagatgttaatatttcatcccaaatatatctatgctcataattattaacactcattcccaaacataacatgtgtgctgaaataaattcgttaatggtaccgcaaaagttaaggtactcgtctacttctactgtcatcctgaaaaccaccttgtaattattcacttaaattttct

SEQ ID NO: 488 - DNA, 539 bp, Neisseria meningitidis
ccggcttcttcaggccaaatcagccttctgcgcgaggggaagacgtttggagttggtttccagctgcggagaccaccagccaagcagcagtgcgactttcgcggttatgaacaaccggaaatggtcaagaaacggcctgtcgtcgtcatagcgcgaaacaggcacaacggcaaactggtaacggtcgtacccttaagcagcacagaacctgtccctttggcggactaccaccacaaaatgagtggaaaccccttaccggacaagccgcacatccaatgttgggcaaaatgcgacatgacggcaacagtcggattggcacgattagaccgatacaaacccaaagggtgcgaccgctgcattccaataatcagtgaagaggattttcaggcgattaaaacagccgttgccaaggcattcaaactgtactagaataaaaccgttcccttaaaggggcttgcaagactattctgaaatatgggcagccgcgcacgggcgacaggcgatgacaagccgtccgtgcgttttatggggcgcggaat

SEQ ID NO: 489 - DNA, 335 bp, Neisseria meningitidis
tattggcttcatttaatgctcctgaaatccaagcgcgtgctgctcaaattgaagatttgaccaataaattccaaatcagcagcacaccgactgtgattgtcggcggcaaataccaagttgaatttaaagactggcagtccggtatgaccacgattgaccagttggtggataaagtacgcgaagagcagaaaaagccgcaataagttgaggattgaatgagtaaaggccatctgaaaataggatttcagacggccttttgtatttaggctttatagaagagatgattgcttaaagccttatggttttaaatcagaatatatagcggattaacaaaa

SEQ ID NO: 490 - DNA, 384 bp, Neisseria meningitidis
ccgaagatgatgctggctttgcttcttctatggcccggtggtgtttttacaggaggacggctttgggtaattcgccttgtacgagcaagagcggcaggtagtctccgggcaggcgcagggcgacatcctgcatttatttgcgcgaggaaaacaagacgagcgtgccgatggcttcggtgggcgaaataagcttgggcagccattcgatgacggcggcggtgtgggcttcggggtctttagggctggcgtatataggggggatgtagagttcgccctgtttttcaaagtcaaaggggcttttaaaggcgaaggtagtggtttcaggcagccattacaacccggtttagcgcacatacaagttgaagttacccaaagattacaggg

SEQ ID NO: 491 - DNA, 191 bp, Neisseria meningitidis
tactaactctgctgtcgttcttgcagttacacctgcgacaaacagttcaatgagtttatttgtttataccggcttagacgactttttctcataagggcaactctaacttaatttggatttccctacttatctatgagagccccttgtttttaattgactataatccgctatattgtgagaagctggatgac

SEQ ID NO: 492 - DNA, 405 bp, Neisseria meningitidis
  misc_feature (379)..(379): N is any nucleotide
cagctcggtaataattacgaattcgagctcggtaccagattccctgtcggagatggaggagtttgaccgcctgattctgctgatacgcaaactgtatcaaatattggacgggcaacatatcctctccagagtaacggtttgccttcaccaccaaaaccggcgcgacctgattgccttggataaagcggctgccggttgcgattcggcaatgttgcgcgcccaacgttggctcatctacacgcaaattgcggaacgccttgccgggtcgggcggcggtttcacggttacggtagaaagcgtgtccgccgcctgtccggagcttgaaggacgctatctcgagcttgtccgccgcgccgccgtctctttcggtttcacgcanagatgggaaaatccggcaagcgggca

SEQ ID NO: 493 - DNA, 903 bp, Neisseria meningitidis
cctttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaaacgctatgccgtctgaacattcagacggcattttaaattccggcataatcaaatcaatatccccccttccgacaatttatagtggattaacaaaaatcaggacaaggcgaccaagccgcagacagtacaaatagtacggaaccgattcacttggtgcttcagcaccttagagaatcgttctctttgagctaaggcgaggcaacgccgtactggtttttgttaatccactataaaatctaaagaaaccttttttcccgataagtttccgtgccgacaggtctagattcccgcctgcgcgggaatgacgaaatttcaaagttatggcgttatcggaaaaacaaaaaatcaaagccggagaatttatcccaaacaaccggatttcaaaaaaccagatgcccggcgggaatgacggatcttaggcttctgtttttgtttctatagtggattaacaaaaatcaggacaaggcgacgaagccgcagacagtacaaatagtacggaaccgattcacttggtgcttcagcaccttagagaatcgttctctttgagctaatgcgaggcaacgccgtactggtttttgttaatccactatattttttcaggaatgacggtttggaaattgcccgaaaccccaaaaacagaaaccagacaaacaggttttccgccaaagccggcattttccgactttgc

SEQ ID NO: 494 - DNA, 382 bp, Neisseria meningitidis
ccgggtggatggtatgcgcacggatgtttctgaaataatcgcttaccgtgcttgtgttgtttgcaccggttgcttgcggataatcgtgggtaatgcgttcggcggcataagctaaatccgcctgcacataatacgggctgcggctgccgtcttcacttgccgcctgcgctgcggaagataagacaacagacgagaatagaagagaagagaagagaagagaagacaagagaagagaacagaacagaatagaacagaaggttttttgggggctggattcattttcgactccgtattcggttttaactgattaaaaagaacacttttcaatgatcttgcaggagcggactataccaggtttgtggcgatgtttcaacacaatata

SEQ ID NO: 495 - DNA, 1034 bp, Neisseria meningitidis
caggaaggacgcggcatcgggctgattaacaaaatccgcgcgtatcatctgcaagaccaaggtatggatacggttgaagccaatttggcactcgggctgcccgtcgatgcccgcgatttccgtttggcggggttggtgaatctgattgcgtgcggaagcacccgtttccgattcggtgcggagcaaatggcggcactttatgtaccgttctgcgtgttgaaacatataggcagataaaaaagccgcccgttgaaaagcagacgacttatgttttgtggcactaatttgtcccgataagcattaactatataatttatttatcattattggtgcggacggagagactcgaactctcacacctctcggcgccagaacctaaatctggtgcgtctaccaatttcgccacgtccgcatgggaattggacgattatacagattttgtttttttgtgcaaggttttcggcggggctgttgatggcttggggtttggggcggtaaaatctgtttttcgtccgcctgacatcggaatcgggcggttttttgtttttattgacggaatttgggtatgcctgctgctttgattaaggattttctgctgactcagggtttgaagctgccgcttgacgaggttcgggcggcgtatctgacggcgcagacggtaatggatatggggacggcttcgatagaccgttcggttttgtggcgcagtgatgagggttggaaacttgccgattacctgtcgtgccacaatgtccgcgaagatgcactgaaacggcttttcatggctttggattcggtgttttcgcgctcgacaggcgtgcggagtgcggcggtctatgccttgatgccatctgaaaaccaggctttccaactgatatgcctgtcccgacagggcgaggttttggaaaacctgtgggatttggatgaagcggcaggcaaggtttcgctggcttgccgttcggcgcaaagcggttggatgaatgttgcctcggatgtacgccgttggctggatttgggggagctttcgggagaac

SEQ ID NO: 496 - DNA, 272 bp, Neisseria meningitidis
atcaacagcgcgccgtatttttcggtcaatccgcgcaaggctttgacaaaggcttcggtcgggcggacgaggttcatattgccgacgaagggttcgacaatcacgcaggcgatttcattgccgttttgagcaaaggcttcttcgagttgggcgatattgttgtactcgattaccaaagtgtgtttggtaaagtcggcaggcacaccggtggaagacgggttgccaaacgtcagcagaccgcttgccggctttcaccagtatgctgtcggaat

SEQ ID NO: 497 - DNA, 550 bp, Neisseria meningitidis
ccaacatacaggccgctgtagaaacatggcggcaaatcggatatttcagtctccactataaagaagcagggggcggactgtcaatactcaacgcctgaaaacaaccgtaaaacagcctgtttcctgatagtctatcatgccgaaaaatcaattccgtgtcattactttagggggattttttccatatcgcacgattgccgttgcacaaaaacaacaaacacaacggcaaagccccataccgtaccggcaagaaaatatgataaattataaacaatgttcagccacccgacacagacccacaccgacccgccatgaaattacaacaattgaaatacgccttagaagtttaccagcacaacctgaacgtttccgaagcggccgaagccttgtttacttcgcaacccggcatctccaaacaaatcaaattgctggaagaagaaatcggcattcagatttttatccgcagcggcaagcgcgtggtttcggtctcgcagccgggcaaggtggttttggatattgcgggacgtattttgcgcgatgttcaaaacat

SEQ ID NO: 498 - DNA, 662 bp, Neisseria meningitidis
cttgccgattaagtgggtataacgttcgtgttcaggattgacggcaacggcaacgtcgcccagcagcgtttcaggacgggtggtcgccacgataacggcttcggcgggattgtccgccagcggatagcggatgtgccacatagagctgtgttctccccacgtcwgacgaccttttccgtttcaaccaatccctgcgcttgattattggtaataattcctatttaattcatttgttagacaactcgttcctatccaatcatgaacaccgccgccatctaccgccagtaccaaacctatgtccgctccgataaatccggctgggcgttggacggctgttccgacagcgcgctcattgcgcaggcaaaacagcccggtttgcatctggaaatgtgcatcaaccgcttcgattcgggcatcaccttgtcgcggatgcgcggcggcggaacgggcgcgtttcccaccgaaatccacaatttcagccacaactgcgccttgttcgtcatggtgtcggggcagaaccggttacaaatgggcggcagggaataccgcccatctgccggcgaaatctgactggtacgcggcgatttggcggacgtatccgaaaccctgctgcccgacaacagcggcatgtgcgcgctgcatttggattttgtcgctggaaa

SEQ ID NO: 499 - DNA, 350 bp, Neisseria meningitidis
ccgccattaacactgggtaagttaacaaaccagttgggatagcaatggtgttattactatttcttttttgcgctaatttctttgttttaaattgggtcattctttgtaattcacctagattactttgtgtcagcattagataacctaacatggtatgttccatcagatcactttgtaaaaataagttcacttttccataatcaagtcctagtgctaataaagttttaacaagttgcaagttgttatctttgagcattgttggttcaaaatcaacagtaatagcatgaagatcagcaacaaataaaaacagttggtattgactttggagttgttttaaaccttgcattacg

SEQ ID NO: 500 - DNA, 270 bp, Neisseria meningitidis
cccgcgttaaaacttcctttaaagtttcaatttgttgtgaaccccccttaagcttaaattcacttgcaaggttaacctttttaagatcaactaaattaatttggtttaaattcaagtttttattagaaactttaaagttttctttatgagttactactatttgtttatctttggttaattgaatatcaattcaaataccatcaaaatcaaaaacttgggctgcttgaaatgctaatttggtgttttctggtgcaatagaactataaccgc

SEQ ID NO: 501 - DNA, 691 bp, Neisseria meningitidis
cagtgagtttttttgacaagaaactcatgggctttttgtggatcagagccaatctgaacaagctgctattagcttttgaaatttatatcaggatttaattattaacaaactttgtatccctgcttttgttggtttgaaaagtgaaagtgaaaaatttgcaggtgctaaaaacacatggacaatagaagcaattatgcctgatggacaaagtttacaatgtgccgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaaaacggttatccacagaatcaggggataacgcaggaaagaacatgtgagcaaaaggccagcgaaaggccaggaaccgtaaaaaggccgcgttgctggcgtttttccataggctccgccccctgacgagcatcacaaaaa

SEQ ID NO: 502 - DNA, 282 bp, Neisseria meningitidis
ggtatttggtccattaaggtgagaagttattacgtattattaacaaaaagggtgatgtttaaatcaaattcatctttttgtttgttgatcttgggaattattttttcaatataaccatcaccattaataattgtttgacagattttattaatggttttttcactccacactccgttaatgttaatgtaactgcgaaacttacgtggttttagttttaactgctggatatttcaatataacgggataatttttaactgctttttattttgtaaattcttacaa

SEQ ID NO: 503 - DNA, 620 bp, Neisseria meningitidis
ccagaaacttagtttttggaaccagatcatataacgatggtcattaggtggttgttattgcaaccgaaacagatagttcccaaattaattttctaaacggttctactaatcaaggtacaagttctcttagttgaggaggtaccttgggtaccaccatcagacaggtgcaaaaccgttattctacttatccaaacggagttaaatttttaatttggaatgatattgctcctggttcagtaaagtgaaacccatatgcacgttttcctgttgtggatagaaaaaacgaacttgcaagtcagggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaagcggtttgcgtattgggcgctcttccgcttcctcgctcactgactcgctgcgctcgttcgttcggctgcggcgagcggtatcagctcactcaaa

SEQ ID NO: 504 - DNA, 352 bp, Neisseria meningitidis
ttaaatcggaaatcatctaaagtatagacaaaaaagcgatagtcatcaaacttattaactgctaaattaagtaaatcagttagtgaatttttcagtttttctaaagcttgatttgtttgactcatcaagtaaaacagtttttcataattgatttgattctgagctaaactttgatggtttaagttattaatatttttagtaattagatcgcagttctcattaagctcaataattaaatcatgcacatctgtttcattttggaacactaattcaatggctttaattgttgtttttaaaagctcatttttcttttcatattgttgaatttgattacgaaaatcatcaatatttt

SEQ ID NO: 505 - DNA, 366 bp, Neisseria meningitidis
ccaaatttaatgtactaattctgttagatagataagaattggctactaactccacctcctactaacaacattttaggggcaaattttttaattgcatttttaacatgatcaatgtaatgatcaataatagtagcttgaaaattggatgctaattcactccaatcaattcgggttttattagcacttatttgtttaatcttgtttaaacactgagattttaaaccagaataggaaaacttagttcacttagtagaaggtttaaagaaatagtgaggtttaactaattctttattaaaaagactatcaattttactaccagcaggataatcaaagcccattgctctgcctatcttgtcataaacttca

SEQ ID NO: 506 - DNA, 378 bp, Neisseria meningitidis
agataagaaatacaaaattctcattgaacaagagttaagtaatcccaattttcttagttatgaaaatgacgaattaaaagcacaatgtcaaaccaaagaattaactgaatgattagttcaaaaaagtaaatctttcattttttggatgaataatgctggttttaaaaactttaacttcattgcactttatcctattgataaaaatgaatctaaattaaaagtaaaagctgtaactgtttctcaatatgataagcagtttgaaacaaaggtatttgcaacagaatttatccctatccacaagattaaccaacagatcgatgatgtcaagattattgggcaaatctttgaattaaaaacccatgaaagtttaactggtaa

SEQ ID NO: 507 - DNA, 634 bp, Neisseria meningitidis
cccaggattggcaatttttatgcctggttgcatcttactttcctcgggttcttttagaagttatatcccaactcctagtttaagaaatactgttggtaatcacaacagttatgttaataatactgtccctaaaaacaatttttatgaaaagttttatgatctaacttttgctttaaatttcactaatcagaaaactcaagagtttggtactggttggttaattgactgaaaaggagatgaaactaaagatcttaatacattaactatgggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgaacggtatcagctcactcaaaggcggtaatacggttatccacagaatcaggggataacgcaggaaa

SEQ ID NO: 508 - DNA, 337 bp, Neisseria meningitidis
atccttatagctatttcgacgagatccagctatcacggtccactaattggaatttcacccctaatcacaagtcatccgctatcgtttcaacgagagtcggttcggtcctccagttaatgttactcaaccttcaacctgctcatgactagctcaacccgtttcgggtctatgataacaaacaaacgctctcttaaaactcgctttcgctacagctccccatctcctggttaactaacgcttgctatcataactcgccggctcatacttcaaaacgcacgccatcacacattaatgtgctctgacacgttgtaggcatatggtttcagaatctatttca

SEQ ID NO: 509 - DNA, 312 bp, Neisseria meningitidis
ccgtgagttgttcacgttgttttaaaagtgattcattagctttactgaaagcagtttgctcaaggtttaactggtgttgttcacgttccagttctagctgagcttgtactgtgtcttgcttttggttttgcagcgcttgaaacctgttatcaagttctagtttgacctgattatttttttcagctaacttgtcaagttcacgttgcttagcttcaatttgtctaaattcttggtccttttggagttcaaaaacctgatagtctttttgtagatcactaaaagcaatctttagttctgtttccttttgggttt

SEQ ID NO: 510 - DNA, 256 bp, Neisseria meningitidis
tttgcaaaacaacctgaatcaacaactgatagctacagctttgacagtgatttacctcaaccaacccttgaccaaccttctttagatgatcatgttcagtacaactttgatcaccatgaagagctcaaaccagttgctgaagaacaaaataattatcaagttggatttgatcaagttcaagctaatcttgataataatgaggaaatacaaccaactgctgaaaaaaaagtaactactgattttgaaagtaaacaag

SEQ ID NO: 511 - DNA, 283 bp, Neisseria meningitidis
cctgacaaactaaatcaaagtgaaagatatttttcgcttagcttcagggcaaattttttaaaagttaattttgataaatgtgtttttgcaagtacaaaaacacatcataatcttgctttagttcacaaaaaaattttcgaattattcgttgaagatgaaagataaatttagttttcaaaaaaactatgatttcaacttagttagtgatgggctttatgaaatttgaaataatgctggtttttttaaacctaaagataaaaacaattcttttacagcaattctt

SEQ ID NO: 512 - DNA, 226 bp, Neisseria meningitidis
cagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcacccggactcggtaatggcgc

SEQ ID NO: 513 - DNA, 271 bp, Neisseria meningitidis
acctgtttcaagtgaaagttggtagttgtgttcaactgaactaattgcatttcttctaacctgagcatcaacttgtctttttctttggcgggttttggcttgctcacggttttgttcaaaggtgagagtaacagaaggtaatcccccattaaccaatcaggacttgtcaatgttgtcaagttcactagcagttttatcattagtgtttttagtaatgtttacagaagaaaagccctgaatgaataaactgttagcataacttttttcaaca

SEQ ID NO: 514 - DNA, 721 bp, Neisseria meningitidis
ccagccactaggtaagttaaccaatagtggtacatactgggcacggggcaaacatcgtgttaggatcaaatagttcagttactggtaaggtgaataacctattaaagtcaatctggttaccaggtttaaagctaattttttcagtatcactatcactagttgctccctggccattgataaggttaacaaggggagtagatactacgccagttagtttaccatccatcttggtaaatgtactatcacctatccctatttcactcttattgttttgtttactatcaaagaactttttaaggggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgc

SEQ ID NO: 515 - DNA, 329 bp, Neisseria meningitidis
ccgatctgaaggcttggggattttgtagtggagttgaaaactatgcgagacacttagagttgaggatggctaactcaaccccttacagtatctttgattattttaagggggattggttactggttattgatgaatcacaccaaactttaccgcaacttaatgggatgtataacactgatctttcaagaaagcaaagcttaattgattatggttttcgactcccatctgcacttgataacagaccgctctcatttgctgaattacaacaaaaaatgcaaaaagttatttatgtttcagcaactccaagagataaagagattagtttaagt

SEQ ID NO: 516 - DNA, 279 bp, Neisseria meningitidis
gcgaagatgatcttaagggcttagattccaatcaaactcaagcaggaaatgttccagaagttgagaccgtttttgtttacgaagatgatcttaaaggcttagattctattattaaagacgaccaacaacatgatgaaattgctaaacatgttgaacatttaagtcaagattattctaaagagataaaagatagtgctaaagcagatttatctaatatttctgatgatattgattcagtttgaaaagaattcggttcttttactgatgagacacaaaaaa

SEQ ID NO: 517 - DNA, 588 bp, Neisseria meningitidis
gactctagaggatccccgttattagtcactatccccttatgaaaagactatttggaggttaaaattctaagtaccatggagttgaaaacccctaactttaagctaattgatgaaaagattgctgaatttaataagagtaatgaaaacctgattgtaaaactacttcaaaaagaaaaggaatttgccacaaaccaagttactgttcagtttgatactcagtcaaaaaagtcagaagaagtgaaaaaacctagtaaaaaaatactgaaaagttatcactgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgaacggtatca

SEQ ID NO: 518 - DNA, 334 bp, Neisseria meningitidis
aagtttatttctttttcttttgcctctattatatttctgtgaatgatgtggttttattttgttattggaaataataacgttattcatttttttcaaaattttattcaattcacttttattaattaatattttcatttttgattaagtattaatttctgggttatcaagggttatgatatttatttctatttttttattttctttaatatctattatttattataagaactaaaatgtctataattttgttcataaaaagcttataattaagcataaatgcttaattatagtaataattaatactctctaaaatagatactattatatataacag

SEQ ID NO: 519 - DNA, 320 bp, Neisseria meningitidis
cctgcaactaatttaattgcttggagactgaatgcaatccaaagtggcaatattaaaccttcaactacttttaagttggaatttgttaattttaaacaccaacagaagtttgtattaaattggtttaaaaatgaaagtgaatcactgcgtgatttccaatcacagtttgagagaatcaataagttagtggaaagggagtttgttaagtaacaatgttaagtttagcacaattagaaagttggttttttatcgctccagcactgcttttagcagtattgagtggttatctcgctgaacgcgttgggatcattaatattgct

SEQ ID NO: 520 - DNA, 312 bp, Neisseria meningitidis
tttactgtggtttggattaacttatcctcattgaatttcactggtagtgctgcagttctgtgatcctgtcaaacgatggcattataaacaggcaaaccattttctttatttcataaaactattgtttctctttgattggtaataccaactgcaatcacttcatgagatttgatttgtgctttatttttagcactttgcatggtagctagttgggctgatcaaatttctagtggatcttgttcaactcaaccactattaggaaaaaaagtgttaaattcgttttgtgctattgctatttggttaagattgtga

SEQ ID NO: 521 - DNA, 524 bp, Neisseria meningitidis
gttgatggcgagataacgtttgtcgtaatctggacacgtaaaatctaaagaaccgttttcgagggcgatgtagcggttgtcggcggcaaccaaaatattgccggggtgcatatccgcgtggaaaaagccgtcgcggaagacttgcgtgaagaagatttccacgccgtaatcggcgagtttgtgcaaatcgatgccgtctgctttgagtttggcgatgtcggaaaccggcgtgccgtccatccattcgatggtcagcacgtcgctggtgcagtagtcgtaaaacaccttcggcacaatcagcatatcgctgttttggaaattgcgtccgagctggcttggcattgccggctcgcgcatcaagtccaactcgtcgtgcagatatttgtcgaactccgcaaccacttcgcgcggcttcagacgcttgccgtcggcaaacagacgctcgacccagcctgcaccaaagcgcatcagcgacaaatcctgttcgatcacgggcaaaaggttggggcgcaaaactttaaccg

SEQ ID NO: 522 - DNA, 705 bp, Neisseria meningitidis
tagaggatcccctgatccactgttaattgatcaaatgcatttaagccaataagctaaggggcaataactttattaacgttatcaacggcttcgttaacgcctttaccaaaataattttttggatcattatcacgtaattcaattgcttctttctcacctgtagaagcacctgatggaaccatcgcttcacctacatgaccagatgccaatttaacaacacaagctactgttggaacaccccgagaatcaaaaacttgataagcaaaaatatcggttatttttgaattgatgtttagatttgaacttcccgggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaagcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaaggcagcaaaaag

SEQ ID NO: 523 - DNA, 719 bp, Neisseria meningitidis
cccgttaaaagcctttgattattccaaagccttttgaataaggcgtggcttcacgtaaattaggtcaaaattttacggttaatttaagcgtcattaaaagaatttttgcttttgttaaaaatttaaatccacaagcaattgttgaaataggtgttggtaaaggagcgttaacaaattatttgttaaaactcaaaataccttacaaggggatagaaattgataaacgcttaattgaatatcttctagttgaaaagatattaactgaagaccaactagttaaaggcgatattctcaaaaaggactttaatagtttttttgaaaatttaagtccattgggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaagcggtttgcgtattgggcgctcttccgcttcctcgctcactgactcgctgcgctcggtcgttcggctgcggcgagcggtatcagctcactcaaaggcggtaatacggttatccacagaatcaggggataacgcaagaaagaacatgtgagcaaaagg

SEQ ID NO: 524 - DNA, 208 bp, Neisseria meningitidis
tggcttttgcaatgcaaacatccaaaaccacacataaccctttgttaaccaatcaatagtatcagataaaaatccaaaaataaaaccccaaataggaccaaagatccatccgaacaatgcaaagggaatccttagaaaactaatgcttaatacattagtaacactaattgaaaagatagaaaagataaaggttagtgctaataaaaca

SEQ ID NO: 525 - DNA, 295 bp, Neisseria meningitidis
ctagaggagtcccaagtttgaatcgtcatttaacaagaaatgaacttgagaaagcttaaataaaattcgctctttgattaaacaaaaaataagctcaaaagagatttttactgattttgaagggagtcaaaaactaaatgcaattgcttattttgaagaggaatattctcaacatgaaatattaagagtgatccgctttggtgattatagtgttgagttgtgtggtggcactcatgtagctaacactgcttcaattgaagattgttttattactgatttctattctttaggagct

SEQ ID NO: 526 - DNA, 310 bp, Neisseria meningitidis
ggagcatttaaaaaccaataaacaccaactccagcagcactaaatgcagtaatagcagcaaacacaaagtaaaaaattaattgcatctttttagttttgttgagttgttcaatacttttttgagaatgggctttcgcattctcattacgcttacttgcccacacttgaggaagtttttgagagagaaattggactggtaaaacaatcactaaaaagatgcatgacaggtcacccagttgtagtgaaattagagacaatttctgttaaaggtacttttgaaagatcccaaaagttcaataagatgattgct

SEQ ID NO: 527 - DNA, 388 bp, Neisseria meningitidis
cccaaagttactcaagaaactcgcttagaaaatattaagggatggaaaaaaataatagagcaaatttatcaagaactgagggttgtaagaagagatgcattacaaatgattaaaaaagataatcacaatgaggatttagaaaactctttaaaagctgaaatagaaaaaattaacaaaaattattctaatcaattagaagagattcaaaaagacaaagaagaagaattgctaacaatttaaatgaatgaaaaagcaaaacaattcatcaaaaagcgaacttcagtattcattgctttattagttgtattttgcttttttcttttaattagcgcatttgctgatggttttaacttttgatcaccgtgatcagcagatttcaattcaagaa

SEQ ID NO: 528 - DNA, 382 bp, Neisseria meningitidis
tttggaattcaacttaactgatgatcacatcaaaattgttcagagacccagatgacgctaagttaagtgatgccacctttgttatttttgatattgaaaccactggattacatggtaggtatgatgatgttattgagttttcagcacgcaaaattaagaataacagcgagatagatcatcagcaattctttttaaaaattgacaaacctatcccaaaaacaatcactgaaatcaccaaaataactgatgagatgcttgaaggcggtattgatcaacagcaaggtttagaaaagataagaaattatctagatgattgtgttatggtagctcataatggtattaattttgatttaccctttttgcaaactcaatttgaaaaata

SEQ ID NO: 529 - DNA, 277 bp, Neisseria meningitidis
cggtcattttactacggtgtaaaaaacgtttcattgcacagtcgagagatttcaataattttaaaatttatatttttattattaccacatgcgacttgaaatagaaaacgggcttgaatttgtcaatgatcctgtggtaaatgaacttggcaagatctgtttttttcatccttttacaggtaatttaacaaacaaacttagtttcagaagtcatttcaatagatacagtttttatgccattaactacccagggcatggtaatagtgttattaacaat

SEQ ID NO: 530 - DNA, 354 bp, Neisseria meningitidis
caaaaatacactaaaaaaaccagttattatccatgttggaactctattggaacttgggaaaggtttattgctgctttacttgaaaaaacaagtggtaattttcctttatggttagcacctgttcaagccgtaattattcctgttaatatccaaaagcatttaaaggcagcaaaaaaactttataacaaattgctaaaagaaaacatccgtgtaaatttagatgataatcaagatcgcttagctaaaaaagttagacaagcaatcattgaaaaaattcctttacaacttattgttggagataaagaaatagagaatttagagaagttgacatgccgtggttttaaaggtgaaaaa

SEQ ID NO: 531 - DNA, 309 bp, Neisseria meningitidis
ggccctgctggttatattgctgcggagtatgctggcaaacataaacttaaaaccctagtgattgaaaagcaatactttggtggggtgtgtttaaatgttgggtgtatcccaactaaaacgttgttaaaaagagcaaagattattgattatttagttcatgccaaagattatggtatcactattaatggtcaagctaaacttgattgaaaacaactgttaaaacaaaaacaggaagtagttgataaattagttgcaggggtaaaaacaattattaagggtgctaaggtagaaagtattgaaggggaagct

SEQ ID NO: 532 - DNA, 252 bp, Neisseria meningitidis
  misc_feature (50)..(50): N is any nucleotide
ccaaaaatggttttgaccattcttggtaaatttctaatagtcgggagttntcccgtggtgtttggtgacatttgcaataggttgtataaataatctaaatttggataaaaattactttgattattggttgaaatattaaagctttttaacgcttcatttttatcaattgattcatcaattctttgattaattaaactaacttctttaattgcatttatgaatttatctttaaatttaatagttggtttaatt

SEQ ID NO: 533 - DNA, 211 bp, Neisseria meningitidis
ggtcaaaaagcagctttagaacgatttagcaattagtagtggaaccttagcatataataacgaaattaatagtggttttaaagatgttactgttgataatttaggtgatgctagaaaggttcaaatagctaaagaaaaaactactgttattggtggtaaaggcaataaggataaaatcaaaaagcatgttgaacttctaaacggaagatta

SEQ ID NO: 534 - DNA, 235 bp, Neisseria meningitidis
ttggtcccatcaattggttggtaaatttgggaggatgtacaagagtttctatatgcattgccggtagtgagtttaaatccagttgaagcattggggctgggattgttgtttaagccaatggagttgcgcatcgatcgtcactgatttgaatttgaaccaagatgtacctctatctggcttttgcccttttgtttggccaaactactgtttaaggtatatttagtcaaaggttgtt

SEQ ID NO: 535 - DNA, 165 bp, Neisseria meningitidis
cccgccttcagcgccaaaaccattacaactatgacatgaaacttttctttcatatttgatggttttgttgcaaccattagtcatttcaaaaaagttaatttcaattactaaagcaatatcaaggttatagggaacaacaatttgttgttgacgttttttagaacg

SEQ ID NO: 536 - DNA, 338 bp, Neisseria meningitidis
ctactgttttttcatttgaagcggattcaactggcagagcactagtaaatactctagtaattattttgattactatcaccattacttttccactagcacttttaattgcaatttgacttaacgagtacaataattcaaaagtggttaaaaatgtttttaactttgtaattgattcactaagttcaatgccatctattatttatggattatttggactttctttctttttaagagtcttgcagttaagtgctggaggagctaatggtactagtttaatagcaggcattctaactattagtgttgttatattactcttccgggtaccgagctcgaattcg

SEQ ID NO: 537 - DNA, 326 bp, Neisseria meningitidis
cccccaaagataaaacccctcgcttcaggacatactatcgcttctgcattaatagctttaataaactgtgccatttgggttagcacaaaattaaatagttggggattggaaaatactggggtaatgtcataaaacaatgtaccttggttgggaaaattttcaaagcgcttgattgcttgatcaagcaacttaaagttttgatccataaatatcttttttttaaaaactgttaattcctgcaattaactgctcttcaatctgatcaatctctttaaaaggatgttttttgtgttttaagctcaaacgggaatgaacatagttgaaag

SEQ ID NO: 538 - DNA, 347 bp, Neisseria meningitidis
gacatcttcttttctatccagggatagttacttttaagcatggtgaagcacggcatgaagctttaaagattattcctagtgaattacttttaagtgaactgactcaccgtgattaaccccttctccttttcgaggcaaagttaactgacctgaatatgtagttcatactgttagcactgttgctgaaataaaaaaaatagaaattgctgaaatgaagcgaattattgttaaaaatgcaaaaaaattattttgacattaaaagttaaataaagcaatttatttaacaaatggatgttagaactgaaagattaaacgaattgttttttgtttatcataaaaacttaaaa

SEQ ID NO: 539 - DNA, 277 bp, Neisseria meningitidis
aaattaccttgcgttgacaaacaagatattaaaccagaagaagcagacgaacttaaaaagcgttttgttgaagttggtgcaactgttgaagttaaataaagatggcagtacaacaacggcgttctagtaaacaccgtcgtgataaaagacgttctcacgatgcacttactctacaaactttaagtgtttgtaagaaatgtggaaagaagaagttatcacatcgtgtgtgctcttgtggtatgtacggtgaactaagagttaaaaaagctcactaatt

SEQ ID NO: 540 - DNA, 223 bp, Neisseria meningitidis
agttagttgtaaattcgcttcaaaaacaccaaaagctcaccaaagaaatagaccttgatttcaccaagcttgatgagattattgcaaccatttttgatgaaactaagaatccaaagactggctttactaacttcattaagcagtttgaaaaaaccaaagcaaaactaacaaaaaagatagctgaaattactaaacttgatcattcaacgccaacaaattatca

SEQ ID NO: 541 - DNA, 256 bp, Neisseria meningitidis
actagtttcatggtaatcaaagttaataggatcaattcctgcataagcagttttaggtaaagtactggtttggataaacaccattgcatcttgttttaaacgagtttgaacttggtagttcatctcttctggtttggaatttatcttaggattggcaaacctacccaataagaatgattgggttttttgatcaaatggaaaactaagaccatttccatctttattgtatggttgataatcatgatcattctttaaa

SEQ ID NO: 542 - DNA, 335 bp, Neisseria meningitidis
caagaaaaatagatcagtaggatcaatccttttttatgtacctagttttattctgattattgctattctaattggttcttttgttgctggtagtttattgttgcaagatgtcaataattatcgtgattctgcttgggaagttagtttatttttctcacctaatttaattgcaacttttttttcaattttgttaacaggaacagtagttagttatcttttccctcgttataattttgctgaaattaaagtatttactgataagcttgaagaagttagaaaagcattgttaagtgataatgctaatcacagtttatctattcaagaaacgcttggtg

SEQ ID NO: 543 - DNA, 298 bp, Neisseria meningitidis
ctggttattcttggcctttttagcgcggttaaaatggtgcacttatttttggagttttttaaagctttgtttcacaattttaagccaacgctttacttcgttatgtgcttcttgtcagggttggggtgaagtaaggtcaatccctaagagtttaatggtttcaagtggcgctaaactagaacctgaactgaggaatttaaagtaattatctttcatctttttatcaccactattaatttttttagctactaaaatacctgcaacttggccaatggcatacttgtaaacatagaagtta

SEQ ID NO: 544 - DNA, 222 bp, Neisseria meningitidis
atgtaaacagtgttaatttaacaaataatgaaaatgaaattaaagttaaacaaactaaaaaaacaatgtgtgaaagatgctgaaattttcaaacaatcattaagccaaaattagatcataatttgtgctcacgttgttttaaagtgtgttaaaaaaataattgtgaaaaggttttcagatcttaatcagattgatatttctcaagcttgaagttttctttca

SEQ ID NO: 545 - DNA, 276 bp, Neisseria meningitidis
ggcaaaaccctcttaacaattctttgtacacaaatactatggcactggcaataacaatagcaatgataatgctaaagggtaaagagattagtgaatagagaaaactattgcgtaacccaacacaaagttagattcactaaacagatcctgaaaggttcgtaaactaaaggattgggaggagagatcatacagatcactgttagcactaaaacccttctgtaagcttaaaaagaaggggataatggtaaacaaaattgttgttaaaagcgcagggag

SEQ ID NO: 546 - DNA, 316 bp, Neisseria meningitidis
acctttttcgcttttaggtagtttaagaaaaggttatatgctagatgaaatgctcttagaacagtaaatatttgctacaatcataacgctttagtttttagttgatacaccaaaatccgtagtcaatttattaactaactagtgaactagattttgatgaatagcgctgtaaaatatcctgagctgaagatcaaacttgagtcttatgatagcacccttttagatctcgctattaaaaagatagttgaggttgtaaagggtgtgaacattaagattaaaggtcctttacctttgcctactaaaaaggaagtgatca

SEQ ID NO: 547 - DNA, 258 bp, Neisseria meningitidis
tcctaagttatttgattactttaaccgaatttgttgatattggtgatcaaattgttgttagtggtaagccaatgttaactaaaacaaaggtattaactttagctgttgaagagatgaaaatcattgctaagtgtttattggttccacctgaaaagtgacatggacttactgatattgaaacccgcgctcgcaagcgctttcttgatcttacctataacttagcaatgcgtgatgtttttctgaaacgcactaagatta

SEQ ID NO: 548 - DNA, 300 bp, Neisseria meningitidis
caaaaatgaactcacgatccacggaggaggagttgatttaaagttcccccaccatgaaaatgaaaatgccttacacatggctttatataaccagcccattaccaaacattggatgcatattggtcatttgatgattgaaaaccaaaagatgtcaaagtcattgcagaacttcttgttagcagttgattttcttaactttcatgattttcgtgttttgcgttggatcttttaccaaaaacactattagcatcctattgatctaaaccaatcattgattgaaaaagctaataatgatattca

SEQ ID NO: 549 - DNA, 290 bp, Neisseria meningitidis
aacctagtgaagcaattgaagcagtattgaaatattggagttttcatcaggacttaaatttcattctgatcggtgatgaaaaggcttttgatggtcttgatatacttccaaaaaatattacaaaaaaacttgctaattctttcattgaaatgaccgacactccactaagtgcaagaagaaaagttaacagttcaatgcaaatagccataaacttagttcgtgaaggtaatgctgatgttgtaatttcagcaggctcttcagcagtttatgcttctttaacaaatgatgct

SEQ ID NO: 550 - DNA, 577 bp, Neisseria meningitidis
caggcatttatctggaaataactgaaaccgaacagacctagattcccgcctgcgcgggaatgacggctgcagatgcccgacggtctttatagcggattaacaaaaatcaggacaaggcgactaatccgcagacagtacagatagtacggaaccgattcacttgttaaagaatcgttctctttgagctaaggcgacgcaacgccgtactggtttttgttcatccactataactaaggaaattcaaattaacttagaattatccctatgagaaaaagccgtctaagccggtataaacagaataaactcattgagctatttgtcgaaagttcaaatttccattttaaaacaattagtaaaatcgagtttatcctaattgtccaagacaacccctataatactataattcagaatataaaaatgggttacatctaaacattacggaatttttattccctcgcctgaattctattgtcagattcaacgagacctcatcatgtcaacgactccaaccttccctacacagactttcaaaccgactgccatggcgttagctgttgcaacaacactttctgcctgc

SEQ ID NO: 551 - DNA, 515 bp, Neisseria meningitidis
ttgttaatatattttcgcgattaacgtttcttaatattaattcgggtacaatcctttccgctgattaccgctgccgtttctcccttttcggcagtgcagcaagtaagacgttttcccgcaatgtattgaccattcatacttacccttggtatgaatggttttttttgcacgttgaaaatgccgtctgaacgttgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcaatcaaa

SEQ ID NO: 552 - DNA, 375 bp, Neisseria meningitidis
aaccgctctgccgtcattcccgcacaggcgggaatccataccttagcacaacagtaatattcaaagattatctgaaagtccgagattctggattcccgcctgcgcgggaatgacgaattttaggtttctgattttgtttttctgtttttgtgggaatgatgaaattttgagttttaggaatttatcggcaaaaatagaaaccgctctgccgtcattcccgctcaggcgggaatctagaccttagaacaacagcaatattcaaagattatctgaaagtctgatattctacattcccactttcgtgggaatgacgggatgtaggttcgtgggaatgacatggtgcaggttcatgggaatgacgtggtgcaggttcgt

SEQ ID NO: 553 - DNA, 596 bp, Neisseria meningitidis
gtgcgccgattttccaaatctgtttgaacaccgcccaatccggtttgccgaatttcgccgtcagtccgaatgggcggaagaaattttccttggcgatatgaatctcctttggccgagtctgccgcttctcgatctgtttcggcgccagtccgcagcctgcgccgcccaaagcgggcataccgaatttgccgtaaacgaaaatatagttcagcggcacgttcaacacaaacgccgcaaagctgaccaacataatcaggcgcgggcggttcaggctggaagtgtaggcgtgcagcgcgcggtgtaccattgccgccggcatcgccaagctggtgaacaacatatactgcgccatcgtgccttccacataatcgctcaaggtcagccagttgcggaaggcgtaatcgccgcccacatcaagaccatgccgaacacgcccaaaaacagcccgaaccaaatcccctgccgccccgtttcgcccacttcgtcggttttacccgcgccgtaaagctgggcaatcatcgggttcagcgccgccataatgcccataaaggtaatataaaccgtggcaaacgcgctgctgcccaaagccaacgccg

SEQ ID NO: 554 - DNA, 302 bp, Neisseria meningitidis
  misc_feature (287)..(287): N is any nucleotide
  misc_feature (297)..(297): N is any nucleotide
aaattattttattttgttatgaaaaccttcgaaaaaacatggtctgcacaatatcgggatatggaaatttcagtacggaatttttggaatttggagcggacaagggcggaagtctatatcaacggaaggcgggtttatcataacgaagccgaaatggcgtctgcttctttgcgttagctaatgggggaatacctggaatttgaagaaagcggtacgaaaattaccgttgaaatcggcagcgcgtggcattttaatgaaactataagaaatattaatacacatttaangaggtacganacttc

SEQ ID NO: 555 - DNA, 734 bp, Neisseria meningitidis
aaagacggcgttgatggttttaacatttgcgctcattcggatttgagccatggcaatcttcctttaatgtggtggaaatcatgagtgttgccgacactgtactgctgcctccggtcgaactgccgtttcgggatatggcagacgcatccttcctaaccgcatccgaatacccccaaacctgaccgaatgcaaaactgctgccggaaacggtttgtatgacacttctactactggatgttgcgggcgcattataatatttttccatccgtcttgaaacatttatttacactttatttacactgcggcggcaaatcggtatacgagcgtcaatacacgttaaaatggcgttttgcaccagtttgggagtgatgatggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcg

SEQ ID NO: 556 - DNA, 758 bp, Neisseria meningitidis
ctagaggatcccgtaggcggtgctacagagttcttgaagtggtggcctaactacgggtacactagaagaacagtatttggtatctgcgctctgctgaagccagttaccttcggaaaaagagttggtagctcttgatccggcaaacaaaccaccgctggtagcgtgtgttgttttgtttgcaagcagcagattacgcgcagaaaaaaaggatctcaagaagatcctttggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctctccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgccccctgacgagcatcacaaaaatcgacgctcaagtcagaagtggcgaaacccgacaggactataaagataccaggcgtttccccctg

SEQ ID NO: 557 - DNA, 692 bp, Neisseria meningitidis
cattccatagtttgcctttttactctgttaattgtgtcttttggtgcatagcagttttaaagtttgatatagtctcacttgtctatttttgcttttgttgcctgtgctattggtgtcatatccaagaaattattgttatatccaatattatgaagctcttcttctgtgttttcttctaggaattttatagttttttattttaatgtttaggtttttaatccatttagagttaatattttgcttatggtgtaagataaaggtctaatttcacttgtttgcatgtggatgtccagttttcccagggccatttgttgcagattgtcctctcacccattctttctcacctttaacactgctgtgaatggcctttattttctaccttacaccatttgactctctccttcctagaaaaaaacctttctcaatcccacttaaactcatttagtggattgcattggtctggattatcagaggtttctgtaattaggttggctgtgccaataaatatcttcatggatatcctgaatttgttttgtataaagaagaaataggcagatgacattggtagtggatcggtgagaaatttgcaataaaactcaaatgtgcaagatgtgccacatttgtgtttcttttcctcaaattacaaatattggatttgccctccatccgtcacaatttctgggcaattcaaa

SEQ ID NO: 558 - DNA, 174 bp, Neisseria meningitidis
agcatgggcagcgtatcggcggcggcggcaagaaagctgcccgccgcaaacacgaccagtcccgcataaatggttttcttgcgcccgaacttgtcggaagcgatgccaaagggaatttgaacaaaacccggggcaaccccttaatggccaatggcaaccccgacaacggtttgg

SEQ ID NO: 559 - DNA, 501 bp, Neisseria meningitidis
cgtctgaaggcttcagacggcatttgtgcgtttgtcgggcggtgtttagggggcggtaacggcgtgtttcggcactttgtccatatcccagtgtgccaccgcccagtcgagcagttcggcagggcggtcggtttccggtgcttcgggcagcttgaggtaacggaacacttggcggatgagttgttcgcggcggtttaaagccaatgcgggggcgagcgtctgtttcgaccagttctgcccttgtgcgttggtcatcagcggcaggtgggcatattgcggtgtctgaacgtccaaacactgctgcaaataggtttggcgctgcgtggcaacgagcaagtcttgtccgcggacgatgtgggtaacgccctgttcggcatcgtcggcaacgacggcgagctggtatgcccagtaaccgtctgcacgacgcatgacgaaatcgccgatgtcgctggccaggttttgggcgtaaccgccgacgatgccgtctgaaaagccgataat

SEQ ID NO: 560 - DNA, 250 bp, Neisseria meningitidis
gaatgacatattcataagtttcccgaaattccaacataaccgaaacctgacagtaaccgtagcaactgaaccgtcattcccacgaaagtgggaatctataaatgaaaagcaacaggcatttatcggaaataactgaaaccgaacagactatattcccgcctgcgcgggaatgaccgctgcagatgcccgacagtctttatagcgggttaacaagtgtcaggacaaggcggctacgccgcagacagtacaa

SEQ ID NO: 561 - DNA, 1082 bp, Neisseria meningitidis
agcatggcgcacagcaatgccgtctgaatacgcctcccgctcggtacacggcgagatcggcaatggcagcggtactttggccgccgatatgcttaagttcagtaaccttacgccaccaaaacccttgctagctaagggttaaacagctcacttgaaatctacttaagtctaatctaaactatccaatatggatagatttttaaacatagggcaagcagcaaaattattgtagctgaaagcacaatcactcgctggtggtctcaaacacgtgccgactacctcgccgaaaacactatcagccgcgataaaccgtgggaaaagctcgttatcagccgccgcacttggtactatcgcgggaaaccgatgctgtctgaaacgcaacaggagaaaaataatgagccgttacctgattacctttgatatggataccaactgcctgaaagacaattaccacggaaataactataccaatgcctactccgatattaaaaccatcttggctagacatggatttgagaacattcagggcagtgtttatctaggccgtgaaggcatcagtgaagcacacggaacaatagccattcaggaactgaccgctcggtttgattggttttactcctgtatttcaaacattaagttttaccgccttgaaagtgatttgaacgcacaatttatcgctgatggtgtgtatcaagccaaacaggctttccttcaacgtgttgaacaacttcgtatatccctaacagaagctggattgtctgatgagcaaatcaatcaggttctggaaaaacagaaatttgaattggaaagtcctaacctgaaattaaattaacctcctttactcaccaacatccgccgcagctctgtcagtttttggcgcgctgcggcgatttctgtgcgttttagagcttcgggtasggtgtgaaacaactcactcgaaatttacttaagtctaatctaaactatccaagcagtaattagtacawaaaaggcaaacttattttaggagtttaaaattgcagctgcgataaaccgtgggagagtctcggcatttcccgcgccactttgtacaaacgtggcaa

SEQ ID NO: 562 - DNA, 615 bp, Neisseria meningitidis
catatagccgatggtatagatatgcaccatcaacgacacgcccgttaccacgaccatcatcatcgccgtcatcgtatcgaccaagaagccgacggagaaatccaagccgcccattgtcagccaggtatagacattctcgtcaaacgtggcgcggctgccgtcaataaagccccacagcacataagccgacagcacggcggacaccgccacgccgagtatcgtaaccgtatgcgcaccggcacgtccgattttgttgccgaacaaacccgcaatcagcgagcctgccaacggaacaagggcaattatcaaatataaagtcatatcgttcatttgattgaatccgattgatttaaaaatctatgtttgtttcgtacaaaattacttcggaaaaacaaatccaacacgctccaatcgtttgcgtgccacagctaattgctcttcagtaaataaatcacaccacggcttttgtaacaccagatattccatactgtatttcaaggcgtggactccgccaccactcaaaatcagcttgctcggcggcggttagttcggagatgaccactttgtccccctctttcaacccgctttttacttcggtattcatactgtctctca

SEQ ID NO: 563 - DNA, 381 bp, Neisseria meningitidis
cttcaaccatgccaaaacgggcaggacggcggttgtcgacttgctcatcaacacgcccgccatccaagacttcatcctgaagggcgacctgatgaacatcagtaaaatcatggaaaccgccaaaaccgacggaatgcagacgatggatcaaaaccttttcgaactgtaccgtcacggcatcatcagttacgaagaagccctgcgccagtccgtttccgccaacaacctgcgattgcacatccaactgcacaaagaaggcaaaacgcccgaactcctttacgacagggtcaacggtctcaacctcatttcctgatccgcaaaacccaatgccgtctgaaaaccgcatccccgttttcagacggcatgattttatccgtccgg

SEQ ID NO: 564 - DNA, 236 bp, Neisseria meningitidis
cgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcacggtcgcgcgtgtgggttttgcgggcggggtgtgcatgcgctctgttttacgcgctgcttgccggtttttccgtgccaa

SEQ ID NO: 565 - DNA, 397 bp, Neisseria meningitidis
atagcggatgtggtcaagtgtatcgacgaatacagcaaccgcccgcacggcgagctgccccgacatcctgacggcgggcattatacgcctaaggcttatcgggaaatgagcctggaacaggacggtatcgcgccggatatgctgtcggcgcaagagctggcgacgatgtttatcccgcaagaggtgcgaaagttacagcgcggctggctggatcatgcttaacaactcttatttctcaaccgagctggcggagtatcacaaagacgaggtacgggtcagctacgatctgagcgatgcgtcggcggccaatgtgtttgatatggacggcaagtttattactaaggcgcaggccaacggcaatacccgcgaggctttcccgacggctcgtatcgaccgg

SEQ ID NO: 566 - DNA, 386 bp, Neisseria meningitidis
cctgggttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgagaaaagtcgtgattcccagccttcttttgcgacgccgcaaccggtgccggtcagttcgaaaagaatggcattttgttggccgccaaaatggacgcgaccgtatagggcgtcttccgaacccatcaaccaacagagctcatacatacgaccgcccgaaactttggattctttgtagataccggaaccgacaacttcttcgg

SEQ ID NO: 567 - DNA, 318 bp, Neisseria meningitidis
ccggcatcctgcccgaagcgatgctcaactatctggcacgcttgggctgggcgcacggagacgatgagttcttcacaatggaacagttcatcgaatggtttgatttgaaagacgtttccccgtctccaagccgtatggacttgaaaaaactctactggatcaacggagaacacatcacaatcacacacaacggcaaactcgccgaactcgtcaaaccccgccttgcgttgcgcgatattcatgaaaccgaagaacctgctttggaagatgtgttggaactggtcaaagaccgcacccaagacttggtcacgcttgccg

SEQ ID NO: 568 - DNA, 471 bp, Neisseria meningitidis
cgcccaagagtgcggacatcggtacgaaatgcgcgtctttcaaaccgagctgttcggcaagtcggcggtatgcctccacaatggcgttgaatttgtcttcgctgtaatccagcaggtccattttgttgaccgccaccacaatatgcgggcagttgagttggcggaggatggcggaatggtgtttggcctgcggcagaagctgcaagggctgcgcgccgaaatccagttgggatgcgtcaaccagcacgactgccgccgaagcggtgcttgcgcccgtaaccatattgcgcgtgtattgttcgtgccccggagtgtcggggatgatgaatttccgtttcgccgtggaaaaatagcggtatgccacatcgatcgtaatgccctgttcgcgttcggcttccagtccgtcggtcaggatggcgagaccaatgccacggtttccatgccgtctgaaaccggcgcgcccgttcccgt

SEQ ID NO: 569 - DNA, 177 bp, Neisseria meningitidis
atctgcttttttcaccgcgcgcggtttgccgtctttattggtaaatttgggcggatcgattatgctgcccacaagccggtaatccacttcgaatttatggcatgaatgatgaatcaaaaaccggttgaagccgtttttgctttgggcgatggtttgcatattcaaaaaatcgccaat

SEQ ID NO: 570 - DNA, 681 bp, Neisseria meningitidis
  misc_feature (668)..(668): N is any nucleotide
caggatccttggtggcctcctgcacgggttcgggcaggcttaaaaggcgcaggctgttggaaatcgcgcttcggcttttaccgacggcttgggcgatggtttcgtgggtcagcccgaactcgtcggcaaggcgtttcaagccttgtgcttcttcgatggggttgaggttttcgcgctggaggttttcgatcaaacccattgccaatgcggtttcgtcgctgatggttttgataacggcggggatttcggtcaggccggcaatctgtgcggcgcgccaacggcgttcgcctgcaatcagttcgtatcgggacagtccgtgttcgcgcacgatgacgggctgtatcacgccttgcgccttaatcgaatctgccagttcctgcaaggcttcgtcatcgatttgaacacgcgcctgatagcggccgggccggatatctttaaccgcaaccgtggtcaatcggtcgccgctgctgttgtccgcgccgttggcgagcagcgaatccaagccgcgccccaatccgccttttacttttgccataccgccctcccgtgcctattcagataggatgttaaatcgggtattttatcggatattgggtgttgccgacaatttgtatccgcgtttatcggatttctgttttttcactataatagccggtttgccgttgcangcggttttatggg

SEQ ID NO: 571 - DNA, 668 bp, Neisseria meningitidis
  misc_feature (307)..(307): N is any nucleotide
  misc_feature (317)..(318): N is any nucleotide
  misc_feature (320)..(320): N is any nucleotide
gcctgtatgctcttctttgaaagtttcgtatacgtcatgggctaaaagggctgttccgacataaggaactgcccttgtgcttaatttcgcgcctaagcgggcaagtttgccgacccccgccaatacgccagcgcgggaaactgatgaagatacaaccgaactaactttacccgtacttgatgctccagtagatacatgcctaacttttaaatcttgagcttctgaagttaaatatcttcccgattctctatcaaatacacctttccaaattcttcttcttttgtcatctgaacctcgaatacctaanatagtggaanngntccgacagcagagtcccaagaaaattacccggagcatttactgatgccaatgcaaatttagatacaaaaaaactaaagcataggataatctttaaaaaatttcgccctaggataataaacataacattttgcttcatctaatttaattaataatgtagaagaatcagggaattgaatttctataaaatctctatcataacgatgaaagaaattcctaaaaatatcaaatgaaaacgaagttttaaaaaccccttttctaatcaattccctataataaattaacgcttgtggtaaatctctataaatatgtgaatcagtttgaaaatttaactaaatgatattcagaaa

SEQ ID NO: 572 - DNA, 598 bp, Neisseria meningitidis
tgaatatccagtccaaccttgacgaacccttttccggcagcattaccggtaaccgcgcgaagaagccaaagccctgctaggcggcggcagcgttaccgtttccgaaaaaggcctgaccgccaaagtccacaagttgggcgacaaagccgtcattgccgtttcttccgaacaggcagtccgcgatcccgtcctggtgttccgcatcggcgcatgcgacttccaaccaaaccgcaccgccatcctcgatcctgtcggctactcgcccaaaaccaaatctgcactttcagacggcaagacacaccgcagcagaaccatttatgcagagtcccaagaaaatcaaaacgccaaatcccataccattaatcagaattcttcctattttttcgaatccactatttcttccaaagcggcaaaacccataccgtccgcaaaggcgaaacggtcaaacagattgccgccgccatccgcccgaaacacctgacgctcgaacaggttgccgatgcgctgctgaaggcaaacccaaatgtttccgcacacggcagactgcgtgcgggcagcctgcttcacattccgaatctgaacaggataaaagcggaac

SEQ ID NO: 573 - DNA, 366 bp, Neisseria meningitidis
cgttgttcggttcggttttcgtcataccaaattccttatttcttctgtctgagatttatgaattatttgtgcagcccgcattctttgctgtttctgccttcccaccaccaccgcccggagcggatgtcttcgcccgccttgacggggcggatgcaggggtcgcagcctatgctgggaaatccttgacggtacaaatcgctgtgaggcacattgttggagaggatgtatgcccacacgtcgtgttccgactagtcgaaaatcgggttgtatttgccgatgccccgtccggcatcgtattcggcatacagcagttccgtgcgtgtggcggattgttcgcggcgttgcccggtaagccacgcgtccgcg

SEQ ID NO: 574 - DNA, 861 bp, Neisseria meningitidis
tgtcgcgctgacgcgtgccgaggaacagctcaacatctattcsgcgtactctccaakacsgcaaaaacaaccccccgcctacwtgattgaaggctcgccagacatscgcgggaatgacggcatttctgcggcaatcggattatttccaaaccaaaagcgcgtggttgcgtttgccgcgccgaaggatagtgtatttgccgaaacgtttgtgttcgccgttcagcaggcaggcatcgtcggggcgttcggcggcgtggttggggttgttggcttcggcaggtttgccgttgagcaaaaccgctttgctgttcacaaagccgcgcgcttctttattggaggatgccaaaccggtttttaccaaggcttcgacgacattgatgccgtctgaaacttcaaatgcaggcaggccgtcgagggcgagctgctcgaagtcgctttcggtcaggctgctttggtcttcggcaaacaggctttcggaaatgcgttgcgcggcggcaagggcttcttcgccgtgaatcaggcgggtcatttcttcggcgaggatgcgttgcgcttcgggcttgctgccgcttgccttgtctttggcttcgatggcatcgatttcttcgatggacaggaaggtaaagtatttcaggaatttatacacatcggcatcggcgactttcagccagaattggtagaactgatarggcgaggtttttttcgcgttcagccataccgcgccgccttcggttttgccgaatttggtaccgtctgatttggttaccaaaggcagggtcagaccgaatacttgtttttggtgcaggcggcgggtcaggtcgataccggcggtgatattgcctcattggtcggagccgccgg

SEQ ID NO: 575 - DNA, 756 bp, Neisseria meningitidis
taccgcgcacgggcgtttgaaatagaaaccgatcaagagatacgacaccaagcccaccgcttcccaaccgaagaagagctgaatgaagttgttgctcataatcagcatcaacatactgaatgtaaacaaagaaatatagctgaagaagcgttggtagccgactttttcatcgtgcatatagccgatggtatagatatgcaccatcaacgacacgcccgttaccacgaccatcatcatcgccgtcatcgtatcgaccaagaagccgacggagaaatccaagccgcccattgtcagccaggtatagacattctcgtcaaacttggcgcggctgccgtcaataaagccccacagcacataagccgacagcacggcggacaccgccacgccgagtatcgtaaccgtatgcgcaccggcacgtccgattttgttgccgaacaaacccgcaatcagcgagcctgccaacggaacaagggcaattatcaaatataaagtcatatcgttcatttgattgaatccgattgatttaaaaatctatgtttgtttcgtacaaaattacttcggaaaaacaaatccaacacgctccaatcgtttgcgtgccacagctaattgctcttcagtaaataaatcacaccacggcttttgtaacaccagatattccatactgtatttcaccgtcattcgggacatttccgccctgctcggcaaaccctttgtcgcacctgccaaaacccaagccaaagcactcgcccggataga

SEQ ID NO: 576 - DNA, 376 bp, Neisseria meningitidis
agaatacgcgcgggtcagaacacgccgaccaccgtccgggttttgtcgttttgaaatattcctctaaatacggcaggcggtttttatcgacggacaaaccggttttcacgcccagtttgctcaaggtgtcgagcatacccaaatcgtaaacggcgatgcgttcggggttttgcggtatttgaacgtcgccgcgcgcggttttgacggtaacggacgcgccttcggtttgtgcggcggaaaccgcctgttctttggcttgtggggcagagtcggaattttgcggcgaacacgcgcccaaagcgagggcggtgcatacggctaaagcagtcaaacgtaacatacgtgtctccaaaatgggggatattggggcaaagcc

SEQ ID NO: 577 - DNA, 635 bp, Neisseria meningitidis
tactctagaaggatcccccggctaaagaactcggctacgcctccgacctcgacctcgtctatctctacgacgacccccaccccgacgcaggcgacgtgtacagccgcctcgcccgccgcctgaccaactggctttccgccgccactggcgcaggcagcctctacgaaaccgacctgcgcctgcgccctaatggcgacgccggtttcctcgcccacagcatcgccgcctttgaaacatactagcgcgaaaacgcctggacgtgggaacaccactcgcttacccgcgcccgcttcatctgcggcacgtccgagattcaggcggccttcgaccgcatccgcaccgaaatcctcaccgccgaacgcgaccaaaccgccttggcaggcgaaatcatcgaaatgcgcgaaaaacatgttccccacccacccgcctgccgacagcaacgtcaaatacgcgcgcggtggcgtggccgatgtcgactttatcgtccactatctgacacttgcccatgcccgacagtatccgcaactcttggacaactacggtaccatcgccctcttaaacatctccgccgactgcggtttgattgacaaaaccctcgccggccacagccgcaccgcctatcgcttctaccgccg

SEQ ID NO: 578 - DNA, 622 bp, Neisseria meningitidis
aattccagctcggtagcattacgaattcgagctcggtacccagcacaaccccttacatgtaccttgtgtggtgtcattggatcctagcaagaaaggtatccatttgttccccacaaaatctttatcatgcacgattgagtaggatccgctgttataagttttgccgtctgcacccgtataggtatagccgtttttctgtaaaacatcggcgtaatcattctgcacatttgtggctgtaccatagaaacgtgcttttctgattggggcaatgccattttgtttttgattgtttacccaatcttttaaggaaacgcttgctgtaattcccccacgactgtgattactggtatcaaccgaccagccgttacccattttttgaacctctcgataaatatcttgattcagtttttctgaattggttttgagtaaatagccttggcacactttattatttaattggtcgtaaccgacatacatcagttcagaaacaagacttgcaccgagccataaaaaatcttttattttgttattagaatcagatttatatttccctgttggaggattcatgactgcaataagcacactaccgtttgtactaatacgatgttgttttgctgcgttg

SEQ ID NO: 579 - DNA, 103 bp, Neisseria meningitidis
gtactatccgtactgtctgcggttcgccgccttgtcctgatttttgctgattcactatatcgacatcgccaaacgagacttcgtcatcgccgtttcgtctttg

SEQ ID NO: 580 - DNA, 2159 bp, Neisseria meningitidis
aatagattaagatataactattaaaatatttttagataggattatcggaattaaagtcttttatacccagtcgtccgatgcggtttatagcgtattgttgctatatgttcgttatgttatataacggttgcatcaaaatttacgcccacaggctttcccgacggtttgaaagtttgattttcgataacttggagacttaaacaatgcctacccaatcaaaacatgcgtctatcaatatcggtctgatacaggcaagggaagccctgatgacccaattcaggcctattctgaatcaggcgaatattaccgatcagcaatggcggattatccgtcttttggcggaaaacggcacgctggactttcaagatttggcgaatcaggcgtgcattttgcgccccagcctgaccggtatcctgacccgccttgaaaaagcgggtttggttgtccgcctgaaaccttccaacgaccaacgacgtgtttttctgaagctgactgccgagggcgagaagctgtatgaggaaatcggcgaagaagtggacgaacgctacgacgctatcgaggaagtgctgggccgcgagaaaatgctgctgcttaaagacctgttggcagaacttgccaaaatcgaggatgcgttgaactcgtaatacgccgtaacgcgcggaaacgtccgaccgacggctttttgaatcaaaactgctgcacatgggggatgccttgtgtgcagcattcttatataggggacagtttaaaggggaaaaatggcggatttgcagaaaaattttcaaacttcgttccgtgatgcgatggcatcttgcgcggcaggcgttcatgtcatcacgacagacggtgcggcagggcgttacggcattacaatgacggcggtcgcgccggttaccgacgagccgccgaccgtgatgctgtgcatcaaccggagtgcgcgaatcattccgatcctgtcggaaaacggcagcctctgcatcaatacgctggcggacgaacatcaggatgttgccgaacattttgccgggctgaccggcctgtcgcccgaagagcggtttgcctaccacatctggcatcgcggcaaaacgggacaacttgaaatagagggcgcgttggcgcacctgcacgggcatattgtcggcaaacatgaaatcggcacgcattttgtgttttacgtcaggctcgacgaaatcaaaaactgcgggtgcaaacgccccgcgctgctgtatttcagacggcagtttagatttttagactgatattcggacagatatatgaaagcgatgatactggcggcaggacgcggcgagcgtatgcgccctttgaccgataccactccgaagccgctgctcgatgtggcgggtaagcctctaatcggttggcacctatgccgtctgaagcaggcggggtttaccgaaatcgtcatcaaccacgcttggctgggtcggcagatagaagatgctttgggcgacggctcggcttatggcgtgaacatcgcctattcgcccgaacccgcaggcggtttggaaacggcaggcggcatcgcgcaggcattgccgctgttgggtgggcagccgtttttggtggtcaacggcgacgtgctgaccgacatcgattttaccgccgcgtttcagacggcatcgtccctgccggaacatatttccgcccatctgtggctggtggaaaatccgccgcacaaccccgacggcgatttttccctgctgcccgacagcagcgtgcggccggaagtaaatggcggcaacggattgacattcagcggcgtgggtatttaccgtcctgaaatgtttgacggaatcgaagcgggcagtgtggcgaaactcgcgcccgtattgcgtggcgaaatgcggcaaaaccgcgtgagcggtcagaagcatacgggcttgtggctggatgtcggcacggtatgccgtctgaaagaggctcaagcccttgcaggggcttggaagtaaaaacccggtttcagacggtatggcggattcggtttaacgtttcaacgccagcaccaacacgcccgccgttaccagccccaagcctatccattcctgcgtgttcgggcgttcgtccaagaaaaccaccgccatcagcgcgaccaagaccaggctgaatttgtcgatgggggcgacttgcgaggcgttgcc

SEQ ID NO: 581 - DNA, 543 bp, Neisseria meningitidis
cccacaggaaaaacggtcaatgctttcagcgggatttttttggggaaattcgtcatgtcgctgtcggataaggttttttatttctgctaaatactgcgccgcctccaacaatcctttcctctccctcctccggctggtgcgcctttgtgaatatgctgtctgaaactcggggactcagacggcattttgtttgccgccatcagtcggcaaactgttttttcatcctctctcggcgttcttgggactcaacagataaagtggctgtcgggcgtgccagcagccgcttcaaaccgataggctctcccgtatcggcacagaatccataatccccttcatcaatattgcggatggtcgcctgtattttactgagaagttttcgttcccgatcgcgggtacggagttccaatgcgtactcttcttcctgtgtggcacggtcggcaggatcggaggctgattcgtgttcttggagatgccctgtcgtagcggaagcattttcgatgagttcgtcttgcatttttactagcaattcgcggaaaaaagcta

SEQ ID NO: 582 - DNA, 125 bp, Neisseria meningitidis
aaagctggcttgcccgacactcagacggtctccccgccggcatttccacgccgcaaccctacgggcgcaaaagcccgaatcaacgccaaaataaccgccagcgtaacccgcgccggcgtattggc

SEQ ID NO: 583 - DNA, 252 bp, Neisseria meningitidis
  misc_feature (216)..(216): N is any nucleotide
caaaatacccttataatgagctttatgtagccaatcctaaatcggggacgagtagtttggtgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatanggcggaatacaataacggcaggcaagacgggtttta

SEQ ID NO: 584 - DNA, 915 bp, Neisseria meningitidis
taaatttgttgttgtccgatccggttattgtttgttctgacttgtattttttccgtgagtctcgcccgtaaggcggaagtggcgggcaatgcgtggcggaatgtgggtaaaggcggcattttgatttgtcggaatgcttgagaacccctctctttaaaacacccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcggg

SEQ ID NO: 585 - DNA, 162 bp, Neisseria meningitidis
tatttcgggcgtgatggaaatccagtcgtcccgatggcatgaacacgcctttcgccttacgcgatttgagcaggtcttcggtggcggcagagccgatcaggacgcgccctttgcccacgggctgtttggttgccttgctgtacacggttacggtgtccatac

SEQ ID NO: 586 - DNA, 410 bp, Neisseria meningitidis
gccattttgtggcattgttttgcgtataccgtgcaagatagccataggggataaccattttggtgccctgaaaatcaaatgtaaccgtatgttcaaatcctgtcattggctcgggattgttgaaactggtttgttcattaaagggtcacatgagggcatagttaaaacactccccattaaccaaattaaaagttgataaatgggaatagcctatgggcccctaatttcaagcctaggaattaggtaaaggatatattcctgggagataccaactccttaggtaaaaataatttaccaacctttggcacctagggataaattcccatacctaactaaaccggggggaaatatatttatcccaggttggaggggaacctttttccccggttccggcaggataggtacggggt

SEQ ID NO: 587 - DNA, 354 bp, Neisseria meningitidis
ctgccgaagccgtccgcctgaaccgcctgacacacggcgcgctggacgtaaccgtcggccccttggtcaacctttggggattcggccccgacaaatccgttacccgtgaaccgtcgccggaaacaggaattggtcaatagtcacttgcgcgccgttggcgaagtcaccgaattgagcttcccaaatggtcactttgtcacgtgcggagcaagcaaagccgtactcgaacgccatcacggcttcttcgttcaaaatggagtcgataaccaggaactcgcccatgccttcgcccatatggcgcagaggaacataagtatcgtcgtcccaattttcgcggttttgatcgtgcaatac

SEQ ID NO: 588 - DNA, 558 bp, Neisseria meningitidis
  misc_feature (280)..(280): N is any nucleotide
  misc_feature (464)..(464): N is any nucleotide
caatgcattgggcggcggtgtgaattaccaaacgctgcaaggccgtgatttgctgttggacgacaggcaattcggcgtgatgatgaaaaacggttacagcacgcgtaaccgtgaatggacaaatactctcggtttcgacataaacattcaataataaaacaagatcacataataaaaaaaataatgaaaatatgaaggataataggagggttaagttatttaatgggacttgttctctatgaatcataagacaccaaataatccatagtacgtttagcanataaaaactaccgatgcctaacctctttttctcagaacctattatcattagaattctaagtggaaaaatagaattaaaaaatttttttcttcgctctgtcgttaatgtatccttagttttccctaaaaaaaatataaacatatatatactgcacaatattggtaataaataaattaaaagcganaggtaattaaattgataattgtaaattatataataaacaacatacgaagaaaaaatattatagatgatttgctatacgaataaaaaaatatcct

SEQ ID NO: 589 - DNA, 413 bp, Neisseria meningitidis
gcgtgtgggacggcaaagcctacgacgacaacagcagttccgcgaccggcggcagggttcaaaacatttacggcgccggcaggctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgccttta

SEQ ID NO: 590 - DNA, 409 bp, Neisseria meningitidis
tacctgcgcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattgaagtttgaaccggcgacgaaaacaatgccgtctgacgacgtgtatggcatagctgacacgctgagcctaagtgataccgataccgagatttttatttacatctttataggcgagatccacagattggatacccaaattttcaa

SEQ ID NO: 591 - DNA, 249 bp, Neisseria meningitidis
ccgcaggttctggcaaaaaccgaaaaactttccaaggcgggctcgttgggcaaatcggaaatggaacggtatcaaaattgggcataccgccgccagctggcggatgctgccgatgccgccgcttagaaaacctgcctgaagcggattcccgacagcctcaaaaacggggaattgagcgtatcggatgccgaaaagcacgaacgcttgggactgaatgccgacgcggccaaatgggtcaaacagcattat

SEQ ID NO: 592 - DNA, 669 bp, Neisseria meningitidis
  misc_feature (431)..(431): N is any nucleotide
ctcggtaccttcgtaatattatgagctatgaattcgacctcggtaccctgtgcactttcaaagtatacaaccaaataaattaataataaggcaccaaatacaataaacaacgccgtaagcatgctcatagaaccttggttcgtcagtgtaaccagctttgcaatacccgaaggaatacctgaagcaatacctgccgtaatgattaaagaaataccgttcccgatacccctttcagtaatttgctccccaagccacataagaaacatggttcccgttaccaaagaaactaccgtggaaacatgaaactcaaatgaacttgttacaacaattccttgctgaaatacgaaagatgcaacacctagactttgaagaattgctaacaaaacagtaccatacctagtatatttcgtaattacctttctaccagcctncccttctttatttaaagccttcaatgatggcaaaatttcagaagcgagctgtacaataatagaagctgaaatatatggcataattcctattgcaaatatactaaagcgctctaacgacccaccggaaaacatattcaatattcccaggatgccgtttccagcgctttcgtataatttagctaaagcaacagcatcaactccaggtacgggtatatgggcaccaattcgaaaaacaatc

SEQ ID NO: 593 - DNA, 330 bp, Neisseria meningitidis;
aaaaagtggtttcagactaagaatgacgcaatcggcatttaggccgtctgaaatcagaagtaccgtttcccaatatcgaaaatccgccatgcggctaaaaatacttccttcatggagcagaaatgactttgttgagcttatttaatccgttgcaaactgccggcatggaacaagagtttgatgccattaaaatcggtattgcctctcccgataccatccgctcatggtcttatggcgaagtcaaaagacctgaatccatcaactaccgtacgttcaaacctgagcgtgacagtttgatctgtgccaaaatctttggcccggtcaaagact

SEQ ID NO: 594 - DNA, 466 bp, Neisseria meningitidis
acggcttgttcatggttctgcctttcaatgattgttttgaaagcctgattttgacaccataacttcatgcgctcaattcttaaacagaaccgccccgattaatacgggtacggaaacgccgagataacaataagaatccatcatttcaaaacctttttcagcagggacacatagtaaacggacgcgaggatgccgaatactatccagcctgtttcaagaccgctttgcacgttgtccttcggactgcattccgccaataaaagccttagcggctgaccgtccgacatcttccacaggctgccgttatattccggcctgacaatctgtccgttttctttgattcttggtgactaccaagctgaaatacaggttttcagcctggtgcttctcaagacatttatttccgacttggtacaacatgccgtcttacttcaccactctcttaacgatgggaactacaaaaagc

SEQ ID NO: 595 - DNA, 555 bp, Neisseria meningitidis
aacttgtatacaaaacctacaatattgtcaatatcggcaattcccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagacgaatatcgtttcagacggcattttgactgtttaaagcggaggaagttctacaaacggcaagaaatgctgaaatttctgaaacatttcaagatgtatctctaacgcttttactgctttttcttttgaaatacgcagatcatacacatctatcccccttaaaaacgcaatgtcggtcaaggtattttttttcgattttgatagtctgcacattgaaacagaacctacagtattgtcaatatcggtaattcccccatcaaaatccgccaaatc

SEQ ID NO: 596 - DNA, 344 bp, Neisseria meningitidis
  misc_feature (35)..(35): N is any nucleotide
ggtcttcgccctggttaacctcattaagagtctcncaaaatgctccgggcctacctagtcaatctagtcactctccgagcctccgcgcctgccaaccgtcgtgcaatcagcaatacaaatactaagccctcctgggctgctatcattctagcattcaaactcgctgctttcaggggtacatccttgttaaaggaggttattagtgtcaagttcaaatgggtgttcctcgtcagcggggccctcctccgaaacaactgggccgtaaacttaaggattcaagccctggcctatgggttcttcatcaaagtcaggagtgccgtcaaaatgagtacctgggctactct

SEQ ID NO: 597 - DNA, 749 bp, Neisseria meningitidis
ctactaaccacaatcccatccttccgtctattgggggttctattccagggttatcttcgatttctcagcgtaaccgcgctttagccagacgtggtccgaaacgaccagaccaagcggctcctccgaagtcgcttctcttccctcgcttcagcgggccaagcgtcctaaacggccagggcacggccgtgggcgaccgtgtaaacactcctacggcttagctgggcgtcgttatcggcgaccaactcctaactacctgcgtcagtaaagttgcaggcggctttagtatcttctgcatagtcgcttttaacctaataagatatctcttccgtacccgcctcatcgtcacatcctgggcccgggcaatgctgtcctcgaacgcactctcgtctataaaagtacatccttggtcctagtccgcggtaatatggtcagccgtactttgggtagatggggtatcatagtctttccgggcgggcttctcttccaacctagaggggtataacgcctcatcatcctaagtaccggaagtcctacggctacgggcatcctcctctacaaccgctgcagcatccggcttctgttctatagagtaaatggtagggtcgttagcggtaccttccctggcacccacagcttcttccgcgtcaaccgaagcttgggcttcattaagattatacctctcctggtgggcgtcctgctattcaaagactgtacggtcattaaagaccccctggttctctgcttgggcc

SEQ ID NO: 598 - DNA, 439 bp, Neisseria meningitidis
tcctgtcctatccgtaccggcacttgcttctttaacctctccgagtcaaacactcctgggctttcatccgcagcggcttcggcaggggtttcgacggctgctgcttcggcatcctcctaggcatccatccacacttgatttcgttcttcagggctctcctcctaggtacctgcttccgaagcggggctctcctcctccctacaaaccctggtaagctctttaacgtcccaacccacctccgaagttgcttcttcactccgctagggcttagaggcttcttcaacctcggcctcagctttaaagtcctcggaagttctttcaaatctctcttcttcgtaactaccaggttcagctccgtcggggcaaactctcggggtacccaaaagctcggtaaatttaaacttgctttcttccctaagatcctagtcttctgggcttc

SEQ ID NO: 599 - DNA, 378 bp, Neisseria meningitidis
aagcacggggcttgccggttaaaacggtgtaaggttaggaagagccggggcgtcggtcctaaaagcgcgctgcgcaggcagatcaaaatcaacgggtactcaactgaaaagcctgaaaggtctctatagtgaagatagtagactgatcagaataagttcgagaaaaaactgcgtaccgggtatggcggtatccagaagaccaaagaaacgactccgggcacgaggtccgatgcgaattcgagaaattggattagggtctggtaaaacattcaagatcctcatgggattcctactattctcattctcgggcttgggctcggcgttcttaaaagaatgggtagtgctggtgatggtcttagtaaatagggtgaaagcgcc

SEQ ID NO: 600 - DNA, 967 bp, Neisseria meningitidis
tcattgctacctagctaactggcctatgccttcgtcggggataatcgtcgcatgcccaaaatttgcctcggatttaatggaagtcttggctactatagtttttgggtcttactgcctcgaagactcaacacctttctattcagtctttggtttaatacggctctacttgcaagcctcaagcctcttgcagctccgaggggtgttggatctagtgcgctccgagggtatattctagagccgctatgtgtacgataagtgctgtgcagcttctagacggaacttacttttcatatttcttaatatttctgcatctctttgcatccctggcgtgctgtttcctagttctggatacataactgcgcattcgtgttcccactgctagcgcgtacaccggggtattcgtagtattcaaatctctcacatcaaacccttgtcgcagatcttgagggggagaccggaagcgtagcagaagaagccgggtggacatcgtaccgcctatggggtccccaaagcgctctccaattttgagggcgggagggggtgaaagataggtaaagagcgagttctgtagcacataagaatttgcagaaagctggtaagaagaggcaaaaaccaacacgagcacgaggtaatagggttcgcgtctttggaggtttggggggctcctaggggcttggttgcgggggctgtatttacaaatctgccgcaaacgaaaacagctgcaacagtacggcccgctatcacgcccggatagtcaatgccagtgtaatactccgaacagttggcacacggggtcttttcaacaatcggggttaagcagcactatggggaaacggtgctgagcgcctctccgaggagtttcgaggcatcttccctaacactaatgtccgtcttctagatatgaggtgtacaagcatggccggcacgatgtattacgtatacaaaactagtggatccagcctagcat

SEQ ID NO: 601 - DNA, 369 bp, Neisseria meningitidis
tcgttactaacttggtcgtcgcttactcctctacgggggttactcaaaaagttaaagctactctctatagcttctgcggcgtccctactacccgggtccagatcgttcttaaagtcttctcgattacgtacagggtcttcctacagccctccgaggtttgcttctttagggcgaattccggtgcttttcatattagcatcaataacctctacggcgcctgcaaaggcgccagggtccgcccaaatctctttcggttcttcgtctctagttctcataaccgcagctttcaagtcaactccggcagctatagggttacagctaaattccctgcggggcttgctctaagcactctctgcgtccaatacttcg

SEQ ID NO: 602 - DNA, 437 bp, Neisseria meningitidis;
ggtgcgttccatggtaaaacttcatagaatctagaggggttaaatgcaagggggttactcgggtgggaagatctggccgcgtccccctaggggttttggggggcgtccgggttagctcctccaacgtcaagctcggtcctttgcgaactgctcctccctgcgagattcctctaattcctacccgaccgctggccaaaccgagcagggtgctgggcctggtctcgtctcgggcgcttagttaggtcgggaccgttgtacaattggcccaatatctccacacacttacaaactgcagcacgaacctagacgcgggtagcccggtttgaatcgaacggagggggctgtcctaggggcgcttctggtgctcctaactgtggtgatccaggggctggccgaccgccgcctaagcctctgcaccggtaacagctgctgtggct

SEQ ID NO: 603 - DNA, 466 bp, Neisseria meningitidis
gcggcggcttcgataatattactcaattcttggtcagaagccggggctttcgagaccgcggcggcttcgctacggctacggcctgcttcttggggggcagtaccttctttcgcttgcaaagcgtcggatccaaccacgacctaagagtccagcgattgggtcgagtcctccgaaacgtcttcaatccaaaccatctcccgttcggtagccttggatttctagttactacgttttacttcaatggctgcgttatcttcatgctattcagcgttgcacttcgtcgtactaatcgccgatctaccggcgtcggctgtagttatcccgagggtgctactactacacttcttcgcttccggatcagcccgctccaaaaccagcggttcctaagggcaagtcccgggcgatcccgcaaatccatctggctggtagacccgcttcatacctattatagcctacgaaggttcta

SEQ ID NO: 604 - DNA, 466 bp, Neisseria meningitidis
gtccgatttccctggggggccgggggctattgctccaggtcaggatcgtacccgaaagtcgcttggcgcttaattagggcctcggccgaacggggggggtggtcctagtaaagatggtcagaaaggttctattcagcaggggctcggggggtgtccccgtccggatcttcctcacgggtcttagaaatgctttggtcctagtcatcgcgagtatgggtatatttaacggctccctcaatagagttagtattaggggctgggtcggtacctctaataaattcgcagtcatcaatatctaccgtacggccgtcttcagcctctccgcaagtactctcctcctgatccaacacgttatcttcatccatacattgaaaagtatggtcgtctgcttcattgcggtctccaggggcctaatcctggtggtcagcgacggtcctagtcgttactttccggcgctcttctaaag

SEQ ID NO: 605 - DNA, 437 bp, Neisseria meningitidis
gttagttcgggcttcagggtcccaagggttaaaagtgcggcctcggctcttacgggtaatgctaaagctctgctcattcgagtccggacttcctgcggggtcctaagcttcggcagctgcttcagaagggtcctccccagggggggaggcacgggcctcgaggcggtaaatgctcttaatacccgctcctctatcctggtcaccgtccgaggcttctttcgcgtggtggttatcattcgtgtgagagcccaaatcaatacattctttcgcgtggtaagccgtacaatatcgttctcagatactttggtcattaagatggggattcgcttcgtcccgacgggtaatatggctaccatggcgctcattcgattccgtgcagataccgtcctcctaagtccggtggtgattcttctagtccgggctcttaataccaaaat

SEQ ID NO: 606 - DNA, 368 bp, Neisseria meningitidis
cggtggctaatagaccaccgacgcctcctccaccgacgtgaaaacggtcaccctcatggtggtggtcgttaatctcggctcgttcatgctcttcttcctcctaaccggcgacttcttggtggtcatcagcaggggtccttagactaggttcccccgcgtcgacacttacaacgtagtcctcaccaacacctcggcggtcctgggccgcagcttcccggtcggcttccggggcctccaggggggcttgagtagcttcggcagcaaccgccatggcttaatcggccccagcttctacagcaacatctctaacccgggagtgagcttggcctccgccccaagtagcctatcatacctggcccgaaggggct

SEQ ID NO: 607 - DNA, 391 bp, Neisseria meningitidis
cgaaggcttgggccgatcaacataaaacatcgaggaagacaattgagcctgctgatcctcggcatacggtcaggagctcttggagcgttcagcatactacaggttttcaacgtaaacaaggcagccaaacttaaagcgagacctgcctatcgttcggggccaaggcctagaaacaacaatgcaagaaaggaacggtgggccaggccaagaaggggcggggaaagacggctatagggcaggccaatcctccacaggcgcgccgtaagaaaccgcagcagggtacaaagcccctgcagggggtttggaggtctaaggtaaaagataaacaacaaagccagcttaaaaactgccaacacaggggagtcggcaaacgtcagcttaagtttcataa

SEQ ID NO: 608 - DNA, 461 bp, Neisseria meningitidis
gtttttcgtcttggctcttcgaacattcacgctaacttgtagtttattctctctgaggaccaaaaaagctcagcgtcaactttgcggtccatggtttggttgtcattgtagggattaacttcttcaaagttattcttaaaagggtaatttctctcaaagttactgggttatctgcggcgttagtaaaattcctccggcgtttcaacatgctcttgaggcgttctaagtcctctattataagattaagtgccctaaacactacagcagccagcgccagcaaagtcgtcaaaaacttaaaagtcttaaagtctctcctctaacttccggggcgagccctctcctcgcctctcctttgaaatttaaacatcgccacatccgggttctaagtagtaaacttcgtaaccctggcccgagccaaattgctcctatcggtccgagctgtcaacaacgagcctccaaca

SEQ ID NO: 609 - DNA, 493 bp, Neisseria meningitidis
tagggaaatacgaaaattccttccggtgaaaaatccggggcttgcaggggcttgaaagcttcttcagcctcctcctaagctcggttcttttggtctctctttaagttcttgcttctcttgttattagtatctctatcatcccggtccggtttcaactctctaatatcatatctttgggcttggtcacggtgggggttatggttcttaatatcgtgggtcaactggttgcttaggctgcattgggggccagctctatcggaagtagtcgggctccagatcctgcttaagtcctctaaatccgcctcaccgtggccggtactcgggctacgcttcttaaaatggctactctccaaagaagcttcgtcttccgcggcgcgggcgttagatataaaagagccttctgcctggtcttcttcagcacttacttctcggccggtactgcggttaatatagactccgtcttcatgggcctctcctacaaagttatctttgc

SEQ ID NO: 610 - DNA, 437 bp, Neisseria meningitidis
gtccatcccaaaaggtggtcttgttctttcttactagtagagtccgtacattcgagggcagcctggtcgacctagaattgagcttggcctgcttccatcaatatctctgtcagcgtcccagcagctctttgggtactttcaaaaacagcttcagaggcctcctccgccgcgctcctagtagatctatagaccgcggcctctgcaacggctctcatcgcttccgtactaataaggtctttatagtcttcagcgtgggccgctgcttctgccaacacttctacctaatctttagttcgttcgtccgaagctgggtcgttttcactaaattcctagttcttactcttgctgttcttctagtcatctataccgatcatatctcttttagatggtgcactgctggctctcgttaagcgggtcctcctctcgaaggggtaagt

SEQ ID NO: 611 - DNA, 338 bp, Neisseria meningitidis
aagttaaaagtggtaataattggccggtgcttaaaagagttaatacgggaagttctaatctatccatattcgttcttgtagtaaatactccactgttccaagccaaacttacatcggttgtaccggttcttatattttgggtatctacagagcttaagcttgtggtagcccaaccactccctaaaattagtggttcctactcatggggaagccgtccgaaaattggcgttcttctcgcctgcattactaaaaacattatggcgcctcctccggtggttaatatgggtaataaatgcggcctcctggccataggtagatgggttctaccagcaagtaca

SEQ ID NO: 612 - DNA, 411 bp, Neisseria meningitidis
ttcatacgcagattcgcggtcctaaatgtcgcggctctactcgccaaagcggtctgccaggctaataccctgggacaacccagatacttgatcggtaactaacgattctttaagctacccctaggcttgctgggcggaatcttgctagtcatctaactccggggcaaatttacggctctcctatccagcctcctaatcgagttatttcccttgctattaagtatgatgatagtagaggcacatagtcgcgtagttgggctggggaatacgagtgtaaaagaaaaatcagatgggggcgggtggggggaggggcaagcatgctcggggcagccggggaacaaaaccttcgtgcaaacgttagagtgcttcaggtaggtcaagtaaagcgggtacatccttgtaagtcggtcg

SEQ ID NO: 613 - DNA, 499 bp, Neisseria meningitidis
  misc_feature (441)..(441): N is any nucleotide
aatgtaaaaaattccaggtttctgcaaaataccaagttccacgtgtacccggcacaaaaattcgggggtttcagaacgggttcgattcatacattgacaggtttcttgctctcccaagcatcagagggtacggggcgcgggggcagggggggcgggggctcccaagcatcagaaagcatcagagaacgagggggaggggaagttcttagaggagacgccaggaataaaaattacgatcctcggcttgtcttggactgtaaacacaatcaggtgtgaaccgctgcaactattaacgcaagtccggttcgatgagggctatgcgtgctcctggtcgtcttggcgttgcagggggcggaagttatgagaatctatttccttaaatactagaaacctatccctactttcagggccaggcattgagggttttcatatttgtcttcntactgtcggtcttaacctaacagatcttggccgatttgggcttgctctcgtcgaactt

SEQ ID NO: 614 - DNA, 578 bp, Neisseria meningitidis
aaaatgggcagtgtgggcttcgggattatcagcctagtcgtggggaaggtcctacgattggccaaatccttggcgcgctgcagtcgagggcaaaaccgctactactagggtcctaccccgtaccgtcggcatcctcatcatggtcagcgtcgccctgggggtaagggcatctaagctcacctccttcagctccttcaaattcggaagtctgatgggaagctgtagcgagagatgttaactgcgcaaatcaaagggtaagattgcgaggcgaggtgcaaagaaacggataggttatgaggatagtgaatgatggcttctggagggcagagacagcaaggggatgcgggctatacagggttaaaatggggattagtaagagggcaagggaaaaggggaagcagcaggggcagcaggcttaattgctggcgctcgaacgactaaagagttaagaggggtaggattgggggcgtaaagaacgggcacgggaacatggctgcgagaacatacagaactcgccagcggggggcatggaagaagagggtgcgccagaatgggctgcggggttgacggcgtgttat

SEQ ID NO: 615 - DNA, 504 bp, Neisseria meningitidis
gtccgattttcccccaaaacgacggcctcagggtctacctggtcgttaacgtgggcctcacgagtagtctcttttgcggcttcactcacctggtcagcagcgtctcctctcctagacgggtcagtacctccgttagactcctggtgatggtcgtcacagatctggctcatcgcttcagcaccagcctggccctaagggtcgtcgcggtccttgcctgcaataaagttagtcttatttaagtcctaccgcgtcgcttcgtcctcagcattaccagggtacatccttttcttattagcgtcagcttcattatcttcaatatctcctcgggcctcctcctcatcaacctcggctttccattccgcaggggagtcatggcccccagccgggttcgcttcgacctcaccctcctaattcttgctctcttcttcatccgcaacatgggccggatcttcctcatcgagctcctcctaacgatcagcgtcggctcggtcttggggccgcgtc

SEQ ID NO: 616 - DNA, 396 bp, Neisseria meningitidis
cctgaaagatgtagtagtcattcagacgcaattacgattcgcacccaaacctcaaaacaattttcccaccccacgcaaatacaattgcaaattgcagctagataaatacgcccactctttgacgccgcgcatgctcgattggggcgagaagcccgtaatcatggataggtacgactcactggaattcaagaccccacctcgacccaaattcacgtggaagaccctcagcacggctgcccgcgacatttcaaattcacgcagtgagttagccttaccggcaaccgcttcgaataccgatgccaccattcaatttatctagcggctaaaagctccccagcactgcgccagaccccgcaaacctgaaataaatgtccacagactgccggtgttttcaaa

SEQ ID NO: 617 - DNA, 412 bp, Neisseria meningitidis
gggcgctccaggtaaaagcaaatttccggggggtccatagagggggtgcattcgaggaactaggcttgagtttctgggcgccgagacgccaggaataaaaagtaccataacctcatcaacttctacatacgatcctaacctcacctaatctgcgatgccgggggcggaagttatgagagatcctacccacctccctgccgggcgggcctgcctcctcctcagcgctcccggcgcctgctgctctctttgcatgcttaaatgcttttaatactcggagctcctgggcgggaggatatgcggggggcttctacgaggccgcggtccctcctagcaggtcagcgaggccgagtttcgttgtcgtaagtgcagcagcggcctccgcggtcctcctacttgcgggcttccctacatc

SEQ ID NO: 618 - DNA, 305 bp, Neisseria meningitidis
ggcttgggctgatagagggtgtgcaatgcgccgagtgctgcataacaggctggaatgctgttgacaatgacgcggaaaccgtaaatatccataacctcggcaaagcgcagctttttcgccatcattttctgatggatgccgtacaggtttttttccctgcctttgattttggcctctatattcgcgcctaccagccgctggccgaatgcgcgcaagactttgccgacaacgtactgccggttcttccggctcttgtacatcgctctttttaaagtctcgtaacggatgggatgcaagttatggaa

SEQ ID NO: 619 - DNA, 415 bp, Neisseria meningitidis
tccctgggcctatcgtacctaggcgaggcctccgctgcagggggtgcggcaaacagaaaaaatctcttaatcttgcattttgggtttgcggtacatcctagagcttcgtgcaactgggggccactaaattctaagcattcgtttttagaggttctctccttttcgtagcctacataggcttcttggttcttgcattcaacaccaaaactaatcttgctgtcagtttcttcgacctcctagtagttgtggttcttctaatggttaaaatagtcaataatgtaaaatatgtattcttcaaagtaaactttgctctatatttcaatgtaggagtcttcgtcagtatcaaactcctacccgctaatcgggtagtcaaactggtatttcttgctttctaagcacgatctgtcctcacagg

SEQ ID NO: 620 - DNA, 389 bp, Neisseria meningitidis
aaactacttaattagcaaagtagtctgtaccctcaacctgatattactaactaaaatgcgtactatctacgtcagggctgcaaaactatgattcttctgattttgcgaaaacaccgagaaaagttctgggtatttgtactttctctttgatctccctggggggcgtacgggttcatgggctcccacgcaggctttctttacgtctcttaacttgcaggggcaggggttaatgttcttatagacttattaaatgtactcctcgcggttaatactcgccttcgtggcttcgtgggtcctccaggtccctcgattcctctcattagtaagctactacctccccgtcctagcatgcttggggtcataattggaagggttcgacttcaacctct

SEQ ID NO: 621 - DNA, 446 bp, Neisseria meningitidis
gtccgattccaaagggattctatcttgcttagaatccgctccgtcgcgatattcatcaacttagctttctataccactgctgtgagatacttgagtttcgtcctactcctctatgcttggagggttatcctcactcgttacattttcgcttccaagagcaaagtatccctaagttgcttactaggcagggggttcacctcctacctaaaaggatcagcaaaacgggtaactgcgagtacccgaaaaatcaaagttcttttcgtacccggggaattcttcctaatcattttaatcctacctgcattctcgattaaggtctctgggggttctgtaacttgggccaagatcctatctgggagatcctccgaggtcatgagcgttctaatccatcctcactctacctcaaagcctacgggacaatttcaaaatttcaggatttggagggg

SEQ ID NO: 622 - DNA, 444 bp, Neisseria meningitidis
tttcttgcgtttgtcgtcggcttcttcttgctattagtcgtcaactttgtaattgtaattgtcctgatgccagatgatgcattctttggggtcgtgcttaatttaatgatattcttattaaaacttctcgttcttactctagtcttcctattcgatgtcctcgaagtcgtcctgtctgtcgttttgatggtattttcgtgcgtcaaattaaatgtgccaggcgtagtcttacgattatttgtgggggtagcatttctattgataaagatacgggtgttattggtggtaggattaggtaactttgcattacttgtgtttgtctaccgggccatcgagatcttcatagctttcgatctagtagtcatattaggagtcctctagtttggcttgccctcctacgtactgattgcgccttacatgccaaagattgtatctgtcaatcta

SEQ ID NO: 623 - DNA, 467 bp, Neisseria meningitidis
gggtcttagttcggggttattaacgtggtcccagtcctcattaaaacgggctccagccctactatctttgctacgatcgtcggggtagtcattataaaaagtggcgtccgagccgtccctacctgcgtcaactcctctacagactctactattatggtatacctcatagtcctctccagctgcattaatgtcaacgttagaagtctattcatggccggcgtggtcgaccataggcttctgggcatggccctctcggtggttgtagtctcccgggcgactctggtcgaaattatggccgctcctaaagtcgtgcttacggttcttaaggtcgttctcgttaaagtagtcattctgcttaataaggtcgtgggcgttagtcatgtcagtactcgggtctctattctcgtccagatggttactaagatggtcttcgtcgtggttccgggcattacaagttacatcagagg

SEQ ID NO: 624 - DNA, 420 bp, Neisseria meningitidis
  misc_feature (409)..(409): N is any nucleotide
atccacctccctcacttctgcctcagccggggcctaaatgtcactctcgtccctcagggtagctccatctacttcgcatgttcaattttccccatctgccttcctctaggccgtttcgcgagctttaaattcacgggccccgtcttgaactccataaaaattccttttaaaccggcgttcccttcctcctgagccgggggatcttcgtcatctcggtgggtgcgagccagggccccagcgattaaatacccggagacctgggtctattcaggggagcggtcttgacaggccgggctcgtagtctttcattgatgctaatcccagaaattggccgtacgggcttcgtccgcgacaccaatacctcggctagcaccagcggaagcaacatagcggcattggcgctcatccnccacatagtcc

SEQ ID NO: 625 - DNA, 469 bp, Neisseria meningitidis
cctcctctcctcggcggggcgtacttactttatgggcgtgaggcttaggaacaaaggccaacaacactggcttcgtgtgggcgggcattccactacgaatcagaggaggatcattcacctcccccaatcgagtcggctatacctctcgaaccgaggccaacacctccactggagtacctagggcctaaagcaacaataaaatcactgccacccgctcggtaaatgtccctgcagggggatccggctcttcgattgctgcttcaaatgcaggcgggtcggctcttcgatgctattcaaaagcttgggcagcggccaacacaaggatatctagatgggcattcacgtctgtaaatctccccatcggcagctcaggagtcggcttcaattcgggtaacacttccctaggcggattcaatttggcgagcatcaattcgggggtcgcaggcgtttcaaccctaggtagggcacc

SEQ ID NO: 626 - DNA, 380 bp, Neisseria meningitidis
ctgggcaggtgcaaaagatcatgctatcctcggcccaactgccagcggcaatactttcaatagacatacgcttaacatcattaggaaacttcagcttcttaagattatttaacttgctgctaattagatccgtactacgctctttcgtacgttcctaataagcttcattactcgagaacgtacacttaaatttgcaatagaaatcatccatactataaatctttctcttggctttcttgggggcgtcttcattataagatgccaaataagtcctaataccccagatagatacctccgaaaatgtaactttaaattactcacaaaaaatcttaaaacaggcctcggcactcgagtttaacatactggcaaatcctgcgtct

SEQ ID NO: 627 - DNA, 234 bp, Neisseria meningitidis
aacagagagggttacacacatcctggctaagtatacacctaggtcggttcgggataagagctcagcatcgatgattgccgctaagaggatgacttaaaggattaaagctgaagaagctatgagaattactgacggacgaagaggtaggatcgggtcacagagtgggtgtaggtgggctacaaatgaaaggactaattagagggttaaaggtgctgaatctccagcactcgctct

SEQ ID NO: 628 - DNA, 495 bp, Neisseria meningitidis
  misc_feature (465)..(465): N is any nucleotide
tcttctgggtctccgaggccaaccgaaaggtcagacccgcctgcttgggcgttctcgaggttccaagccgccatatggccatcccaacccggattcgggtctctcccctaattggcagattcttggtccctactttccgtaccctcagggtcgtaaacttgggcatatggctccgaagtactgcggtgggggtatggggcggcagcagatctacctgcgagctcggggttacttacttgggcctcggggtctctattacgatcttatccgtgggtaaaagagtcattgtcattaggggctctcgccataaattccttaccaacctaagcagaatgaatcttaatattctcttcgaattgcttatctctccgtgcactacttcggggggaagcgtgggggtacaagaggtcgcggttactctctgggtccgtcgagaatccaggaagttctctccagactttaggngcgttagaagtgtagtctatctcgtcagat

SEQ ID NO: 629 - DNA, 399 bp, Neisseria meningitidis
gggtcttcgtccgtaatataggcttccgtcccggccgtccctctcaatactaaagtctcttcaggggctttctgggcacggtccctaccggggttacgctcgtaaacgttatctccgagggcaacaacttcctggtcttggtcgcggtcatcggggtcaggggccctggcatccaaatcaacgctgctttggtcatagctatcgtcctagacttcagcgaggtccctctcactcctaataaaagcctgggggtgctccagcgcttcgtgcaaaccggcaagggcttcttcaacaccggcaaaacagacaaaaatctcggggctcaattcggccgtactctcagaggcgtcctccgtacaggttactgcgaggtctccggcgacaacctccgtactctcg

SEQ ID NO: 630 - DNA, 407 bp, Neisseria meningitidis
tgggtttcagatctggctcttcgactggatcttggtcggctgcctaaacttctgcggcacctctatcttttacgggggagttaacttgggcactaccgtggccctagtcatccggggccgcagcagtctcttcggccgtctcttcagattcctacacctccaatttctcttgggggcgatccaaatcatgggaattaaactcccagtcataagaaagtgcttggccgccgaaaccagggcctgcgtccaagacctcggcgttattggcagcgtcatacacggggcatttagcttctctactcgtaccaaggcccatcgcttcggcttcgtcttcaaagtcagccaccctgtggtggggaacacggtctctagagtccggctccgctgggtcgtgggggcggctactc

SEQ ID NO: 631 - DNA, 359 bp, Neisseria meningitidis
tgatcggattctgtaccgcttgtgagtacctccaaggccctggccgtcaatgtggtaaaaaagatcagcgttcgagctcttgcggttatccatctcctcctactcgaccgtctcctcctcctttggtggattaacttaggtgtctttaattcctccctactcgcctcccataaagttctagtattcaataacctcaacgtaggattcttaaagatcttcattttcctaagctttaatctaatggccaaattggccggcttctcatgggccaacttactagttgcttccagaaaaaacatttgcagcttaaatgcagctacctaggcgtccatcgagtcggtaaagatgattctcaatgc

SEQ ID NO: 632 - DNA, 435 bp, Neisseria meningitidis
gctggttgcggatggtggggattatgcaaattaagcggtattagttacgctcatacaatgagtactaggaagcatccgaatcagcggcggccggaggcttgctggtgtggcgcctcccgggggaaataacacagaattactattgattttgaaaacgcgagtaggctaaatagaagcaggggccatagaggaagatggttcgttgcaggggtgcggttgacaaaggggtcgaggggaacataaaaggtaggagaactagtggtagtgggcaacaagaaaggcaaaagtacgggggtaaccaaacagttgtgggtaagggtacagatactgatggtcaggggggccaggggcatagtaaatactgcaggtaaaaggctgccaacagaatgatggcgtacgcgggtagaactggggacacaatgaagtaacgtactc

SEQ ID NO: 633 - DNA, 439 bp, Neisseria meningitidis
  misc_feature (17)..(17): N is any nucleotide
gcttctttgtaagtacnatggttttcggaaccggtagcttcttcggcactaatactcgctgcgtccgctcgggcccatcagacgctaccggcacgctcttcggcgaatccgaggtcccttccttcgagatcctcctagggctcagagcctcccggggggtgagcctgctggtaggccggggctgcgaatgtcctctcctgggctttcgggctctcggggtatttaacgagttcttcaaccgaagtaccgtcccctccctaggggtcctggccctcatggcggtcctccttgcggcttgcggcggcttcagaaaggcttactggcggcacgggggtagagggaatcccaaaaaggtctctcccggcttcttcccgggcacgagcaacgacgtccgttcatccggctccgctcccggcagcgaggtcgaaattcttctcgg

SEQ ID NO: 634 - DNA, 454 bp, Neisseria meningitidis
tcaactccggacaaagctacacgctccagctcctaagtacccccacgagcgcgggtagtcgagggttgggggttgggggccggcaaatccgacaagtacatgggaggtcccaccccgcgaatttgggttaaagtaccctaatatagaccctccgctgggagcgcgtcgcaaatagtaggcggttggagtccgggcgggagtacctggtccatcccctcctctctcttctctttcagcggctcttctcgcttccaatcttcgagcttcgtgcaaacttgcgttgggtacatcctaggctcgtagggtagtttggggggcactaccgtggtagaattcttcgcaggcctaatagggcgagaattgctggggggtactgtggcaaccctcctggtcctatcttcgttctgctcctacgacaacggcattcctcgcgtgggcgtccctctcctggtcg

SEQ ID NO: 635 - DNA, 266 bp, Neisseria meningitidis
aacctctaggtacgtccgacattaaactccaggtctgcaggccgcgcagtgtgaggtgtagggcggcggtaggggccggagcggtgaagcaagtgagagctacccctcctccgggcgtaagagtggtgcgctgctagtagtaaattcgtcaggccaaaacgctgctttgcttctgctatgggggtacatcattggaaattcgggtgaggaaaagactctaggttatggggtacatcctagttggagcgggtttcattaagttcttt

SEQ ID NO: 636 - DNA, 337 bp, Neisseria meningitidis
cctacatctcacggcttcaggcgggccgtcagcctcaaaccggtgggggttaataacttccggggccgcttgctcctttgctgctgggttcttggttgcttctaatgtaggatcttctggggcatcctacctcctagggagtgcgctgggcaacctcgacaaaactgctgctataacgggtgctattcatagcatctctagctgtcgaagcctcctaagtcctagtcctagcatgcggggccgcgatccaagtcggcttcgtagtcgtaaatgtcatcatggacctagctgctgcagctcttcattataaattggggtctctacgggcccctaaagc

SEQ ID NO: 637 - DNA, 460 bp, Neisseria meningitidis
ttaaaaactttcgcacctaactgtaaattctaacaaagctacctctcgctgggattagggttactggacctcctagtcctcctatacctggtatcttaaggcgcaatctgtttcaacgtcttagtggccctcgcgctaaagtttaaagtaaattgcgggccaatcctaaacacgggcttttctcttgcagcgctttcggcacttgcgttggtcattattcgcgtagtcatccgctccttccgagctctggtattcgaggtggcctcaactgcggcaaacatggttcttctaggattggagaaaagaaaatagtttgtgtaactacgtgcagaagcgggccaggctggcacaggcagcacgaagccgcggaaaggtaattgggaaaggaagaatggagcccaaagggtggagagacacctaggacggcttaataacagcactaaaagaagccatacggaaa

SEQ ID NO: 638 - DNA, 399 bp, Neisseria meningitidis
tttccgtcgaacgtagcttctttcttgcattcgctcagctattagaggccaaatgcatacctcgagtccgggccctagaggcacaggtccgagtcatcgctactggggtcctggtaatgggatttcttgcttcgggcttcgtcctccggggccgtactataatcggcgggggaaaaacaattgcgggcggggtccgagccgaaatcctggtcgtctgcttcatggtcgataataattgcttggtggccaacaatatcacagctcctcaagtaaaagccagcgtctgctgggttccaaatgcgggtctctttggtctctgtaaagcggtgggtaacgagtttgcggtcgtaaattcttgcttcgttaacttcgttaggcgcgaggctccggtcgtcccag

SEQ ID NO: 639 - DNA, 208 bp, Neisseria meningitidis
ggcaaagtagccgctctattcgcctgcttcacaaatgcggctacttcggtcagcttcgtgcaatcaggcgttcgagccggggatacttaggttactatcttcattctcgtggtcacgttccctcgcgtcgataccaaaattactcgcgtgctcttcgtctgcagcctcctggtggtcatagcatctcgccgtcagcccctcgggggca

SEQ ID NO: 640 - DNA, 480 bp, Neisseria meningitidis
tccgtttcctggcggtagcaaaactttatctgatcccgggtgaggtgtgttgctgaaccgggggcttcgaccgtccagatcaagagttcattgatagggtaaagggatagtgtggttaagggtctaaatggccgcgttaatgtgggtatctttgcgggcttcaaaggcagccgtacgtccctccaggtcttgggagtgctcctagtcagaagtatcttccgcttcaagggcctcgcctccatcggggcgttcagatccaaattgctcgaccgggcccctgcgggcgacgtcgtcagcaggggagtgggccagctcctccgggcctctcgcggcttcgaatgcgtcgacctacctgggggcatccataccgacgctaagatggtcccgcccagtgtggtcatcaactcccacatcagcttcaaggcccgggcgttcgctactagctcggcggctcttagccgcagcgacacctcgggctcc

SEQ ID NO: 641 - DNA, 106 bp, Neisseria meningitidis
atcgcactccggggagttaggattctagtaattaggttaaccaaggactacattcgtacaattataggaatcctaggcacaaggggtccaagtacctaaaatctcg

SEQ ID NO: 642 - DNA, 113 bp, Neisseria meningitidis
agccagccaggtcgtaggtttctctacctcccaagtgaccgtgcgtacgctccaaatggagtccagaaaatccgggtgccactaggaggtcgatgccaggtttatgggtcgcc

SEQ ID NO: 643 - DNA, 473 bp, Neisseria meningitidis
gcttcgggattctcttgagggacaactccctccataaaatcttgcttcttcggcttccatatacttgtcctcaagatattctatgtcggcttcttcctctaggcaaggggcttcatctccgtaaatgtcgctcttgctctcttcaatgcagctacgttcttcgattctaacctcgccctctaagcctcctcaggtgtcctggccaacagcactaccggaaacttagggcgcttcaacttcattaaactcaacgccgtcaacttcgtaatggtaatgtatttccataaagtcgcaggctacctaatcttcttcttcgtccatctcttagcctgcttcttaaacaacttccgcttaaatctctttgcttctgctttcgcgttcgattggtttaggctacttgcagcaaatttcatcgtcataaatggcttcaactttgcaaaattcggcaaagtaactacttctaaagttctcgg

SEQ ID NO: 644 - DNA, 375 bp, Neisseria meningitidis
ccggctaccaaaacccgggcaattcgctagttctggtcagcgtgcgcagccgcggggttggcaggggcggcggcctaggaggcggcaggagtcgtttgagctgccgtccctacggtaataagggcctagtctcttgcttttaaggaagtccggggagctacaatatctgctgcttcgccggccaaaaagataagtcctccagagcgccaaagtcagtacctagtgaggaggctcgcctggtacctctagatcccacacggcactaatctctggaacctcgccgggtttcggggcagcacctaccctcctaagaggcgtactacgagtcctaattgctgctgctggtttggctgctgggatgagggttgctgccag

SEQ ID NO: 645 - DNA, 417 bp, Neisseria meningitidis
cgcggctcttaatgcttccatagtcgggcttcacctcggcgggggcggtatgaacattaaacttgcttgcgtagcgattcttctcttcttcagggccaacttgggtacatcctaggccgtcagtacttacttcctcctcacgggcattcaattcgtccctgctccagactctcctagagtaccagcttctgctaataaccgcctcctgggggtgctctgcatcatccccgggggaaacaaatgcttcataggcttaactatcggaccaggaccaacgggatgcggctccaggctatatatgctagtccaaatagtgggtcttcgtcccatttgctttctctgtacggtcctaatcctccttcttaaagtcttcgaatttaaacgtcctataaaagctcgggggaagctaaagatcat

SEQ ID NO: 646 - DNA, 325 bp, Neisseria meningitidis
gaggtaggtaaattcctctaatatagggttagtatcttggagggcacttgcgttgagattcagcttctggtccctaaacgttcaatatctcgtaagattcttcgaggcctgtaccagggtcctaaaatttctacgctccaagcccctcgaaatcttcaaagtaaaccgggtatctgcgtttgttatctgcttcttcttaaacctttctaatgccaactctaatatactctccctagtaaaggacctgattctgccgaattcttccagagcttcaaaccccgtgcatcagcttattcgctctgcgtaaatttgggggtgcttcttc

SEQ ID NO: 647 - DNA, 156 bp, Neisseria meningitidis
aagatcttcatctttcaatagttctcgggctcactcctacagcctcggccataggtaaattcaagtacctctccacgctccatgcattcgttgtcatgcttcaatataacaaattgattctagttctctttcttagattcgatgtctacctccacc

SEQ ID NO: 648 - DNA, 483 bp, Neisseria meningitidis
tgattgcaaaaattctggctttagggttggcaggccaaaaagtccctgggggtaagctctccttccgaaagagagtcgaagctaccggcttcttaactgggagtgctttctcgagtttaaggctgcgcttcatgacacgggcctttcagaattagggcctccaggcgttgcaaatagcgttgatagtacttttaacagaaactgcagccttgccgggaaaggcttactgtaaagtcggctcttaagattagttttctgtcctacataaatgtagggtattcgtcaacttatcgatccgcgccgcgttcttcagacttacgggcgtggctcagcggactccccggggcggttaggcgctagcaatccagcgcgtagacctaaagactgcgggattcagggcaaaaccacgagggatagtacttcagcttcgttaaaggggtagatcgcatcgcttggtcttaaactggtggtactctctctaca

SEQ ID NO: 649 - DNA, 358 bp, Neisseria meningitidis
taccaggagggtaatagtactggaaccccagcataagcccatagagggaggtccaaacttcgcagggttcttgggtacatcctgcccatcctaagcatgcataattgaagatacagactaatcttcagaggcatgcggagtcctcgggggcggcttctggatcctagtagcaccaagatacaaaatcttaaaaactctctgcagtagccttcaatcgaataagcttctttggtaacaacttagaattagacgaaatccctgcctaaaaatacatccagctagatgtcttattgagatagtccagattttccataacaacaaacattcgcaacttagatgcatacggggaaattactct

SEQ ID NO: 650 - DNA, 224 bp, Neisseria meningitidis
aaggagtggtggtacttgccgggatgtcaggaggttaagcacgaagaagtcttccaggggtgttggggggaagagacgaaaaggtagcaaaagagccaggggtaccaagagcgtggggagtggtagaacttgtcgaggtaccagacctacagcctagggggggaattttcgaacgaactaagtgggtgtttagacgtcgctggaaatgatatctagtggggtcc

SEQ ID NO: 651 - DNA, 435 bp, Neisseria meningitidis
tttcttccgggctctcctcctgactaaagtagcattcctcacgctgggcccaagcctcctcctggccagccctcgtcccggggtcgaattggctctccgtacgctccaaatcacggttcgatttaaattgaaacaccaaaagccaggatgtagaaggcgacgtgggtgggtacattggagcgtcgtgcaaatcccaaattcagaccatccccaaagagacgccaggaataaaaagtaccataacctcctcacttctacatacgatacagacgatccaattcaggtatggccgctggtactattggacacaagtcggtgtgggcactgaacctcacctaatcttcgatgccgggggcggaagttatgagaaatgctttcttgcgcacgcctccactacccaagtgcgcgctccaggagcttagaaaatccgcgttc

SEQ ID NO: 652 - DNA, 359 bp, Neisseria meningitidis
aaattctataggtaaacttatacaaaggctccggaagtaagttctagtaggtgtggttcctacaaacgagttcatagtattcctaatagtattctaatacataatcttaaacgaaagggcccggataaaaatcctcagcaccgggctcgctctgtccatgagattccggatcggattgctaatatacctaatggagttcagaacctgggaaatactgggccactcatatacaggaatcctaagcgcaagtgcaattacaagctcctaggccgtggccctaaactgctaggagccccctaaaggtaaccctaaccaaatacttcgcgtacttgaaattaatagactaaagcctagggcat

SEQ ID NO: 653 - DNA, 386 bp, Neisseria meningitidis
cccgcggcgatctggggttcaactcggtacttatcaacctcctggccgtcctaattttcgttctcttcagaggactaattgctttcgcttgcttcaatctggttaaccctcgcaaccttcgtgacaaaaggggccgccgtcctcctacgggccctctccatcggggcaataaaattcgattctacctaggcctgggctgctttcataagctctcggtctacagcgattattaagtcccatcccctaactgccctactggctacctccaggatcatctctgccctcgcaaacttcaagctcgccaagggaggattcatagccgcgttcttgattctcagcttcagggccgcagggcttcgcttcctctctgcatcaggcttcacggc

SEQ ID NO: 654 - DNA, 466 bp, Neisseria meningitidis
gtcgtgcgaaatccctgaatcctgctttactcctacgttcagcgttcaaagtacttgcgtccctaccatcgtcgtctccaactcctaaactgctctcccatccttgggctgctttcagatcttccgagttcatcctgtcagcaccggggctgctgcaagtgcctcctccaacggggctggcgctactaagtgcttctgcagcctggtcatctgcggggctacggctactactcgcaaggtccctcctagtacggtaaaaagtatcccctccgagggcaggggcctctctacctcacataccctccgtcttacgatctcctccgccgtcgcctctagccctgcttttcgaactctcaacgtcaacgggcttgctcctgtcctcctggttctgagtaccttctgggtagatactagggtagactcggctaaaatcgaggtggttcattacggggttccggtcattttt

SEQ ID NO: 655 - DNA, 402 bp, Neisseria meningitidis
gatttagctcttcgttttctctgtaccaaaggtcacgagtaatgccgtcaagggtactctatcctccaggtctagggcaacgctaatgggtttgaatacaaaaaccttacgagctccgactagatccttgggttgctaacaaacaggcttagcacttatatctaatgcatttaacctcaatcagattatagttaagattgcgtttcttatgctattcgtattcaaagtcttaaatactggaattcttataaaactattagtacttctcaaagtacatcctattctatttaaccctactaagatactcttcaaaaactttactcctaaacttacatgagtaaatactcgaactcataatttgagaactgtcaggtctactgcaggtactatagtcatttttgg

SEQ ID NO: 656 - DNA, 468 bp, Neisseria meningitidis
tagggcgagttctcgggagtccagggtgcggggggtatgagaagacttccgggcttcggctacctccggggagcccaaacctccagcagccgatcctcgggcagaagtcctagtactcccctcactccgggttaagatcctcgcaacctgggccaatggggctctctctaacagcgtcaaatctattggcgccgagtcaaaccgctccacagcctctctctggtccaaatcctggagctcacacatcaccgagagcttggcctccatggtcgctagttcagtcctaagagtcccctcgctaggcttactccgatcgggaaaatccagcccagctgccgtctttttgcggtcagctccatctggcttgtgcgtctctatcctggtcctcataagtgctgcatctcgctcctccagcgccggggcaaccaaactcctcctgccgctgcagccgctctcaaatcttctgca

SEQ ID NO: 657 - DNA, 400 bp, Neisseria meningitidis
atttctgcgaatattcgtactgttcttaaatcttggagtccctccatctggcttcagtgctagtaaaagatctatgattgcttggattcgggtcctcataagtaatctcggagtcaatgctagatctcctacccccgcaaaatcttgcgtcaacgcgtcctccaaagttgtaaaatttggaaagtctctcttcaacaaattggccctcctcagggccgtcctcgccacaggattcgttttcttgagggtcatcagctttaatcttaccttattaaacagcttctctcgtgcctcccgggcaatcgaggctcttgctgtaatcaatttattcttcttctaagtcttgatccctgccataatcttgtccaacctatcgggcgtcgcgatcatggaacccctc

SEQ ID NO: 658 - DNA, 290 bp, Neisseria meningitidis
tgcttgggcagggctgttcttatggccctgggcttcgtaaaactcgcgcccgcgccgtcgtcagggcgggcgttaaggtcgtaagtacttccgtaaaagccctaagtacggcgggcatctggttcatggctcgggtagcaattgaagctacatccgggggtgtcctacgttctagagttattacggccggctcctccggaattagactggttaatatggtggttatggtccgccctcagcgccgaccctagccgggctgaattggtgggtgcacgtagtagtgcgctcaa

SEQ ID NO: 659 - DNA, 363 bp, Neisseria meningitidis
aaaaatgcggtaatggtggtggtgccatggtggccgtgctggtcattaattcgttgcatcacaaggggatggatattaataatgccattctgatcaattgggcagtaataatcgattacattatgacaaaatgagagcgccgtaggtattactcggcggtggtgctgcagccctagtccgggctgcagcgccccggaggttggttgcattaaatatcaccaacgccaacgcttcgtgcaacatttcagggttaaaagttaatgcattttggtctaaaaactaggccctaaagatcgtggttgcatccgtctttgcgggcgccgataacgaggctgccctccatgcattctctatgatattcgt

SEQ ID NO: 660 - DNA, 467 bp, Neisseria meningitidis
tgggttccccaaggcttcactgctggcttgagagctacaatcaatgctgcagctagagcagcaaacaccaaaccagctgcgggttcagcaggaagtacccgcgtccatctccgctcctcagctttagtcctcgcagcagctatcaatatcaacaatatcattctcttagtctatcctgtaaacactgcattcataagggttaattcttacaacccctggctccaactgccatctcctgggatctctgcctcaaacaagccgccaccagggcaatcattataggtagggccaaaatcagaggggcgggctttctcgatgtcaggtggaacccagaccacgtccagagggttagcttcgtgcaaagatccggggttcgggtacatcctagggttcgcgggtactttactaaggtccctccaagctcctagatcccaagtcccggcaggggcgctgctagcctctccgca

SEQ ID NO: 661 - DNA, 426 bp, Neisseria meningitidis
caggaaacgcacttgctaataaaaatctcaacaactccatcacggagatcaaagtaacaacaaaaaatgcatttaacctcatcaaggctaatttcctcgataaaaaagccgcaaacgggggagtcttagtaaatcttcgtgctaacttcctcataaaagcctcccttcttatccgaataaacctcgccgagtctctaggtgcttacgccaacatagcttggatagcctccatscttcgttccgacatagtcgatgcaatttaggccctcgattggtttcgagcaatagtccgtacaggggccaacggtatggcccggccctactaaaaccgagtcctcactcgagtcattcgagctgcaaacactaatctaaactacctcacggctctcacggtggcaatacatgtgataatcctactccgaacaa

SEQ ID NO: 662 - DNA, 453 bp, Neisseria meningitidis
gcgtcaccttaggccgagttacggtcctaaccgacctgggaattggcctcactacctgtggcgtcgctccatccggggtcgtcacttacaatatcctacctcgcggctgtacatccctctccggcatcctaacggcgatttacgtgggaattccactcgtgggccgggcctatagatcttacagcgtcttcctggtaatcgtcgctgctaggaccatggggttgcttctagtaagcatggccatggccttcgtcctggtcagggtaaaccggggcggcgctcacttcgaggtggttcttctggctcttagtacgttcatcggccctatacgatttagccggcgtcccgtaaagctcttcgcggtctcctacaacgtcagccggctggccgaaatcttcctagactgctgcgtcccaagtatcctgggccgcgtggctctgggcttcgggggcg

SEQ ID NO: 663 - DNA, 403 bp, Neisseria meningitidis
gcaaaaattggtaataaactcctccaaatagaggggccccagcttctggattttttgcgcccctactacttcctatccggcctatcctcgggtcctctactacgtttgctggcttcaacgcgggcttcttagtcctctcctcctaccgatccataaattccgttagcgcaaagagcttctcttccatcagcttaaaagttgctgccctaacctaattcgttgctttcaacataatcctaatcctcgccgaagccgcaggcatcatagtattcggggcagatatctctaaaaacaacttctcgcccctcaacgcctcaactcctgcctatatcaaagttctaagttctgtatctttagttactgggttcttcaatcctgcctcgccaaaggccctcccaactgc

SEQ ID NO: 664 - DNA, 435 bp, Neisseria meningitidis
gttctaaattattgttaattgtataaatttgggaaaagttctgagaagtctttctaagggcagggaactaggtggatggcaaagcctataaaaaagttaagttcgtaaacctagcaatcattggtgcttgcgtaactaaaaacagggtaaatgcatcctgctcggggcctacctcgggcaacagatccgtccttctgccatatctctggatccggagtactaaagttcgatcttcaggcgtcactaaattccgggcgggcgttctgttagtcctcaccaaattcagcgccgtcctaaccaaagcgatattggtgttcaggtaaatcaggtgggcacgggcactggctcgttgcaaccgatcctggttgcttgctcgctccgccgtcaatataattggtgcgataagactttctaaaactgcgccgagagcccctt

SEQ ID NO: 665 - DNA, 370 bp, Neisseria meningitidis
aatgtggctgaggctagctgctaggctatacgggcagggcatactggcgacaaagtaaggttcaggaggattaataagtcaggcacaaaagaaaaagaagggattgcaactgacaagtacggggccctagttaccggaggcgaggaggcaagaatggaaaaagagacacaaaggaattagctaaggtgttgatgtagcctgcaaaatttaacttcagattcaatgggttgttcagaactgccaatagtgcggaatcagcgttcctggccaacgccaacacctgcaaatgcttctcttgctcggactccctcgccgcaggcttcaacgcaaagttcggcaaaaatagttccagctacattcgggcaatcgg

SEQ ID NO: 666 - DNA, 437 bp, Neisseria meningitidis
gctttgttgtgcaacttcattatgctatttagtactgctggctttcagatagaggcgctatgggtcttacagatctccttagacgttctattcacagacaatgcagccggtccagcaaaagattaacggaaacgaggtgcttacgacaaattgtctgtgttcaaaacatgtgctgttttagtaaagttctcaatccgcgactcctgcttcaggcataagggagtggccctaattaatcctcggggcggttaggcactggcaagcctccggctcgacaaaaatgctgcgggcttgaaaagaaagcccctcctgctcgttaaatgcctacgaagcaggggtagatcacagcgattgccaacaagagtcttcttcggggtggatccgctacctagatgggcctctagcttccgtttctcgggcgaacataatggcttcgt

SEQ ID NO: 667 - DNA, 467 bp, Neisseria meningitidis
gtccgatttcgcgagtccggttcgatgagtgcgatgcgtgctcctggtcgtcttggcgttgcagggggcggaagttatgagatgattggtatagggtggaagaaaggggagcacgaattagatggtggccgtcgttaaaagtccgggtcgttggctgctcctaccggtccttagtccgggccctctcagggccaaagggttggagatcctacctattaatcctcctctccgcgggggttgctgcgggggcagagggatgagtggccgtctttgatttcggtactggcttcaaggggagagtccctctatccctccgaaaaagcttcgtcaggttggtacccggtgctcgttccctatctaagcctgggcccgtccctcgagccctcggcttcttgctgggaggggctgcgtcggggatactcgccgtcctccagcccgaggaaaggagcgtcgttatacggggatcc

SEQ ID NO: 668 - DNA, 314 bp, Neisseria meningitidis
agggcaagggtttgacggagtgaccatacttttgaggtgggaatgaagggtgaactggcaaaggagcacattagagctgatgattagggagtaatgggggaggggcgggaggcccacgcgggggatgagcattgtagcgcaattgcggaagcaataaattacgggtaataagtttcacttaagcataccagggcaatagatccggatagggcaggggtaccctattaaaagccggagttttgagcctgagtggctatccgagatctaacataagcttataaaagcctgggttcatatcttaccctaccagctgg

SEQ ID NO: 669 - DNA, 131 bp, Neisseria meningitidis
ttttgtgtttgcgcccgacacctcctaaattctaccgggctggccctcctaggggtaatcgctacctgctggggtcaggggggctactggtccggggactggtctacaaatgtgctgggtggtcaaactgt

SEQ ID NO: 670 - DNA, 360 bp, Neisseria meningitidis
aaaactttggcgaaatcttgcggggcattggtcgtatcctaatcccagtcatcagagctcttatcaaaaaccggtgcttcgtagtggttatcggcagggtaaggcttcggtttctactcgggcacttcgctagtgtctcttttctcttaaatggtagagaagtcccaagtcttcttggtagactgcatcttctcagcatggtcttcgttcaagtcagggttgtctggcaactcgaattttaaattggcattcgcgtcgtcgttgctcgtgttagtggcctcagggtgctcgagaatgggcgtagcccgggatgttgcttgcgagaaagcctagctgcaagggaaactttgggggtaacct

SEQ ID NO: 671 - DNA, 421 bp, Neisseria meningitidis
cgcgtcgtgcaaacacctccgtcgggcctccgtaggctgggttaggtcggccaacagtctaggcgcaactacgggcgtaaaaaagaggtctaatatctcttttgcttctctgccctcctccgtacccaactccagggctttcactgcttttgcaaaagtcgccctaccctaggaaacttcccgcacctccaaaggcttcttaagttcaccctcacaacgctccggggctcgcgcctccactccatgcttccgttcagattccaataagtatacacaaaaatcgtgcaagcctaagcaataaaggcaagggttggtgctgctggctccgcgctcgggttctgggggttcggcgcagctactaaaattacgatacctgtaagggtatactgggccagaacctcaaaaaataccaaagtcttgg

SEQ ID NO: 672 - DNA, 451 bp, Neisseria meningitidis
tgcgaggcgtcttcgggcttcgcttgggcctactccgcggtccctgctgccgtccaacgggtggaaagcgtcgtagggattctcgcttccgtagcagccaatctcctgccatccgagggcttaaacaagagggaaattgcttctgcattcaacaccaaacttcgattggtaattgcagcaaattccaggttgctgcgtttaaagcttctcgcttcagatctctcgcctacaatagtttcaggcgtactgattgctgttgctctcctaaagctctggttgcttaaattaaaagtactagatcggagtttggaagtcactgctgcattcctcgaggcggtccctgccgtcttgcctaagatcctgccgtggccaggatctgccctccaggccgatgcattctcgggtgcagggtttgcattgggagtcagctccatatttaagattgctttca

SEQ ID NO: 673 - DNA, 452 bp, Neisseria meningitidis
ccttaaagtcttccgataagctcctactggtctctaaagtctctacatccttaagctttctaacaggcctcctggggcttgcggtcctacgcacggttatgggcgtgggcaactcctgcgctacaggcgtcctgctgaaaacgaaagtttttagggggctccggcgattcgtgcggggccgagactgcttggctgcacttaaacgcggattcggattcacagggggagggatagtgggagacctcacagttaaacaggccagatttaaggtggtaacccgatctaaggtaggactggcccaaagcttcgttgcaggcacagttgcttagatatctacccgggccaagctcctcgtgcttctcggcagcagcggcgtcttcgggcaagttaaggtccttaaacttctcgacttcgcgggcctaaaacaattgtgcttagggccgcggcgtctt

SEQ ID NO: 674 - DNA, 375 bp, Neisseria meningitidis
tatttagaacccgagagcgggccaaaaagcaggtgaaaatgggacctcgcttcatacgaaacgtgggcagggtacaacgtacagagactccgaaggcgcttaggcccgaatctgtgtgggacgcaaggggagaggaaggggcagaggttagacggtatgaaaaagttattaattatgacttagaaagaacggacgaggttgaaaataaatccggggaagttgcttgggggcaggctctggctggctcgtcggaacttaactctacttaggcagcaaaggaagaacaaacaagtcagggtaatcaagaagggtatcacggtggggccgaagaaagtaaaacaaggaaaaagcctaatattaagaaaaacgatacta

SEQ ID NO: 675 - DNA, 370 bp, Neisseria meningitidis
aagatcatagttctttagaacaggtccgagtcaaatttcttctaagggccagcaaagtaaacggcttaagatgtaccaagtgggcggcaaaagcaagcaccgctgccaaccaacacaacccctgctctctcagagtcgaggctgtaatattcatcttctttgcgagcttccaaagcgtctgctggtctgggtacatcctagagtgcttctatcccaacttagtcaggtacctacccttaaagtcaaaaaacaccacgggcgtccggggtaattataataaacagcttaggggtggccaaacagccactggcccgcagcttcttagcaggagccaatggggcgcctaaaatagaactatggtatcaacaca

SEQ ID NO: 676 - DNA, 477 bp, Neisseria meningitidis
gcctcttagattcttgctaccgtgcttcgttatccatctttcttaagaagagcccacattaaagtcagcgcgttcagggtggggatcgcctccagagttcgtcctgggctggtacgtgtgagaatccttgtagtcgtcaaacaactggtaagcgtgggattcttgttcgtggtacctctggttggttctagagatcttcgagacgggggcgaaggggtcggagacttcgcggtggggtgcttagatacggtcccaaaccagagctgcttcatccaggtcttgcgcgtcatcagattgattgtgattttctcgttgcgagacttgctggtaaggctaccgggcaccggcagtaaaggtggcgagctcgtagggcccgggccaaacgtgttccgagctacaggtcccccccccctaggcaggggcctagtttgcgtgcgaattctaatcgtagtttcattcctatacactagctggtgc

SEQ ID NO: 677 - DNA, 447 bp, Neisseria meningitidis
ggggatatatgtagcaaggtagtaaagccaagtgcgcagccgtgaagagtgagtttagtaagaaataaaagagcaggagtggggactgggaatgcacagaaactagtgggaaaggggtgggtaagaaaattgaaagggctggccaagggatgggtgcgaaaacggagggcggcccaggttgtggtattgacgggaataaaggggttaaaaagtagggttctactggtggggcaaggggtgaggaaacggaggctggcgataagggttccagtaaaactcttagaagaagaggtagggagacttgtagtgaacctgggaaagggaggaaagaggcaacagaagaggttcggggtgggatagggcagggcagggcagagtaatacagagaaaagcatgggttaaagatggcgaaaagtgcaaatacggaacgcgtggctgggtgggact

SEQ ID NO: 678 - DNA, 392 bp, Neisseria meningitidis
aaatctgagtctcaataaagtcaataggtacattggttgcttgtctacctgagcgtgggtggaaaacaatgtcaactcccctggaagccggagattgagggccaacatcaagacatctagtaacctagtccagagcgtcgtgcaactttcaggggtggatgtaaatattaagtagtatcattcaggcaaattaaggataaccaagtaggatcagctaagatactatatgcctaccataaattcataatgtttgtcgggttaagaagggtcccgggggctcttgcttctggaaggggagcttcgagcaaacgtagcttcaggcccggaggattcctcgcttggagcagagcctccgggtaccctcggttcctctctcgggtccgttgcaactt

SEQ ID NO: 679 - DNA, 351 bp, Neisseria meningitidis
gaatcgaggactaccgaaacttttgtggttttcgttcctactcatttcagtcacttcaggcgctggttgcttctcattagagaatttggcttcatccaaagggtctgtaaattcctagacagctgcagcgacggtgtcttcacagtcattatgattatgggcttcgacttcgttaatgtcgttctagactggattcggtttcctctaagctgggtaattcggcttccgctacgccaagacaatatcttgggttaaagagtcttcttctgttccggtgctttcaaaacgttccgtcctatattcgtaattccggggggtaaatcgctggctagctcctgcaaattcgtccta

SEQ ID NO: 680 - DNA, 390 bp, Neisseria meningitidis
  misc_feature (357)..(357): N is any nucleotide
attccgggcttcttcaggggattcagggtgctggtggggggccgccaagatgcgttctgccgacctggtccctgcgagcaaaaattcttctgtaactttaacctccaactacttcttcaactagccggggcaagagtgggagcttacagggtctggcggggtactaccggggggcagggcgtcctagtgcaaataatactcctcttcattaagttccggggcttcgggatctcaagttcagacttcgtgttgttgctaaacagattctgggctgtcggcatccagctagaagttcactgctggggtcactccggagactgcttattcatatgaaacttcgacttgattcgaatggcnctccaaataggggttgcgggcttgggaaatatc

SEQ ID NO: 681 - DNA, 428 bp, Neisseria meningitidis
ctctttcggattgccttcagtccgagccctaaaaatggtaaccctcgcgattatagttgcaatcagcaaagggagtgtgggcaactgcctcctcaatcttgcttctatcacggtcatagtagtaaacctagtcagaagttgcaaggccaataatctgggttcggccaaagttactacggctctcatcaaagtcaaggccgctacctcctggttaatcacgggaagtgtcatcaaggttgtcttcctcaatgtatctttcgaggtggtcctgtgctcaggaataatggtccgaggtaccaaagttgtaaggtaggcaggcatgccctctttctcttcaaattctctcatctcattcgatcgagccgtcacttccatcacttcaacggggttccagggagtggtaaaagttaacttaagagccatttcaa

SEQ ID NO: 682 - DNA, 435 bp, Neisseria meningitidis
gtctcctcatagtcagcttcgccgaatccctcgaccgggttccagtcgaggttggtatgggcaaaagtcgcaatctctgccgaagtattactaatcttctatttatagaaaatcttatcattatccgtgctcctataatcttgggtgtcctccgcggtcttaaattcagagatctaaatataaatcctacaagtcttcttatcattctctttcgagggctgaacaaatgggcaagtttcgacctcgacttgggtgctgttgtcggcattagcgtcttcattagtagtggaaatcctgctagtcttagagggcatcatatcgtgaatactctaagtagtactctcttcaatcataaacttcttactcatctagacttcaaattcaactgctttcacggtcctagtaaaagtagtataagaattctaagtactcgct

SEQ ID NO: 683 - DNA, 432 bp, Neisseria meningitidis
gtccgatttatcattcttcccgagcaactttctttggaggttttcgtgagtccaatatctaattgctcctagggttcattaggtaccaaatgtggagccaggggaaaacatgtatcctcgggggtcttagtctctgccgcaggagcagtcctgccacaaaacagcggttttatgttcaactttcgttttctcttttaatacctactataataataccttcgaattctggttcttcaacttctctgtctctttctaatcttcaggattcgaatcattcatatccggtaacttcgtaggcagcaaaaaactcctcattgctcttcctgcatttgctgtaaagataaactaattcctcatcaaaagaaattcggtagttgcgggcctcatcctaaacaagatattgatcgtctttaagttcaatggggccatctc

SEQ ID NO: 684 - DNA, 509 bp, Neisseria meningitidis
aattgtcacaggtgacaggtttatgggtcgcccaagcatccggtacggctaggttcataatattctaagtggcaaattttgttcttcggagaaacataaagtctcctataaaaaacttcgtgcaaagctgcggtcctccgggtacatcctagggctgtaaatgggagtacctcgaagcctctcgggtcttggtgttcttcataggtgtgctatactcgggctacatccgggtagacttgctaattctctttatagtctcccgcgacgcttactactcggtctagggggtattagtatgcctgggactcctaatcctaacggtctgcttgatgggtatggtgctgggacatattactaaactaaactctaaggtggtctttaaactaggtacagacttccttagggtggttcctctccgaagggtcctggtcctggctaaccatcaattcatccggggcgtcctctctaaacctgtcagcctcctccggattctggtctccctggtctcc

SEQ ID NO: 685 - DNA, 455 bp, Neisseria meningitidis
aatccgtactcgtcgtcctaaaacttcgttctctcttatcgtcccctgcggctatatggtcattcttgttcataaaagtagtgttcctcagattggctcttaaaaacttcgtaatggccctcatctgggacatcctcgattccctagttatctggtctaagatcctcctcctctcgtgctgtttcgtaggtctccgtaaatacctacctccaggaaacgcggcaattagtatcctcaaatacctcagagcctccagggggtctttcagtatcttaggagccgacagattcttggcgtctaataccgtcaaagttgctctcccttccggatctgtggcgatactgtccctaagcgcctcccctgccgtcagcggcttcagcctaaaagttttcaaaaagcttgcaaatcctcgagtccctcaatgtccaggctcgggcactactcctaagtgccaa

SEQ ID NO: 686 - DNA, 408 bp, Neisseria meningitidis
gtccgatttctccatggctggggttctgggcctgaacgagcgtgtgcggggaaacgcaggaggcagaggtgctagaggttcaatccatagtaagctagtattggcgatggttaaattcctatgcttaggaataaaccgagtccttagcttgcttctagcagcggcggtagttacgtcaggattgatcctaaaaagattggtctgccagacgaccctattggtggccggagcaagtgtgggtctgttaagagttaaatcgggttggctactgaggctttttctgggccgatgcttggttcgtcgggtggtttccggaactacgagggctctcgttaccctaagagccggcttagacaggggcttgcgtttccgcggccgtaaccgggcattgctattcagcgcccgtaa

SEQ ID NO: 687 - DNA, 359 bp, Neisseria meningitidis
gtcgtactggatctactatttacccttggctagaagttccatgccgagcaaaagcatgagcaacaaagttttggccagctcggccaacagcaaaagcgagtgcaagtacggcatatagtacataaatacttgtaacataagatccaatggtagcaaaaagagcaaaagcaggagcaacaaagttttggccagctcggccaacagcaacagcgagttcaagtccggcatatagtacataaatacttgtaacataagatccaatggtagcaaaaacggcacatacgcacgggctaattaacacttctctacttctcactttaacttcttatgtactgctaactttaacttcttctctaact

SEQ ID NO: 688 - DNA, 488 bp, Neisseria meningitidis
  misc_feature (467)..(467): N is any nucleotide
tcatcaattctacatcgataaagacgatccaattcaggtatggccgctggtactattggacacaagtcggtgtgggcactgaacctcacttaatcttcgatgccgggggcggaagttatgagatgggttccatgggttcctaactttgcttgcttctgcaaagagtgggtcctccaggcgctgttcttagagtcctggattcggcctcccctccgggcagcaacatcctataaagcttcgggcaaccatcggtacatcctagggcgctgcaggtctagtaacagggaggcgggcctgcttgtcagggccagcgtcagctccatctggggccgtagattaatcggaatcaccgacgttagcttttagggccgctccgtcagccgccgctgcaacgtcttcttataaatggtccggggtgttagtccctgggccgactacggcaagggggtcctgggcacgggcatccncctccggggcttcgctagccg

SEQ ID NO: 689 - DNA, 351 bp, Neisseria meningitidis
  misc_feature (321)..(321): N is any nucleotide
aaagaataaccttcgtgcaaagtgcgggggtaatgggggtacatccttggctaatggcctagggtaggtcgatccggatcttctgaaacctcctgaattcgattgatcactgtgcagaaaaagcagggagccaactaactgcgacttgctagcaaattgaaaagttagctcgaaccgcgcgctggtactctctatctcggttagcagggatcctgtaagcttcgtgcaaaactgtataagggggtacatcctagggcggagctaacgaaagaggtacaggtgtgcgagatgcggtacatctcgctcgctgcaacatattgntgatctggctgctacaatgggtcccgaaaa

SEQ ID NO: 690 - DNA, 267 bp, Neisseria meningitidis
tagaaccgattttgctggtgtcaagaagggtgattcatgggggcagctgggtaagacaaggtagcttccgacacacaagaagacctggattaaaacaccttattacgggaaggaagcccgacggaggataggtcttacacttcaggggagagctgccaagagttagatcggcgaagtcgaaactactgctatcacacaaaccacgatgcagaaaaagtagatttggatgtgtgatcgaggtggggaagggaagtgtagtggtggtag

SEQ ID NO: 691 - DNA, 324 bp, Neisseria meningitidis
aaaacgaccagcttagggctataataactaaatgcgttataaaaatgaggtggtagcaaaaataagttataccgagctataaaacccaagttcttggattcatatttgaaaaaaaacaaagttgcagcagggggaaaagaaaaaaaacggatttatacaaaagggtgttgagtaagagaagtagtcggggaggagggaaaggggagaggggagggagaatttggtactaaaatccgatactaaactcgaaacctagtggggtaaaaaaggaaaaacggaaccaggcggaaataacgcgaaagtcccgacacggctccgtcagaa

SEQ ID NO: 692 - DNA, 445 bp, Neisseria meningitidis
tccggggctgactagggtccgtggagggctctagcctgggggtcctcccgcgtacgctggtcagaaacctggtctctgccaacagctctgtcctcgagggcactactcctctcctatggggctttacgggcatagtcgacgccgtcacttcttatactactccactaaccctcatagtaagtagacaaaaagtggtcttcaccagcgagggctggggctgcaatcaacccctaactagccgtacattcggcttcagcctggtctctctggggcttgcggttggcggccgcctcctccccggggtgaatatggccatcgccggcaataaggtgggggttagatccgatactattacttccttttcattctctagaatcccagtcttccctagtactgctccagcccccaactcggtcgtaagcgaggtcggcagcagaggccatgt

SEQ ID NO: 693 - DNA, 464 bp, Neisseria meningitidis
ggtttgccggctacctccgaggtcctctcctgccgcaataggtccgacccggtcggtatcttgggccgcagcaccgtcgttattaagatcttcaccgacctggcggtctcctctactaccactcccgtggcgttctctatagaggctatcctcggtctcttgcttaagaaattggctctcctcctggtggtcgacttccgtcgattcggcagggctttcctcaaaaataagttcctaagccggggccgggtcacctggctgggcaccggctctccagtcaacgacgtcgaggtcagcctcgacttcccctctaccagagccctcggggttaaattgggtagatgctccatcactctcagggccagcgtcaatcctacctgccgccacagattcggaccagacgaggtcgctcgccgtacattggtcccggtcaccaaaagtgccgcctgcgtgggcgtcctcaa

SEQ ID NO: 694 - DNA, 480 bp, Neisseria meningitidis
cctatcttgggtagtcctagggttggtgttcttatctctataccgtccaagttctattcgagtttttgttctaagatcctgcgtcccgggctactcgggtggcggtaattctattgtcttcctctccagaagctccgccagagcctgtggcccaatatttggcaccagggggagtacagacggagtaacctcggcatttcttgtagcggtcctaattttgagtaactgcattcaagtgggctggagggtcgctcggggtagtgagaagttcaatagttcgggtactaaaaactctctttcttctcttgttgcaaatccgggatgggaaaatccaaggggagaggaaaaatctatgttctaaactaggggtttgctcttgcggtttacttcctacctctacaatcgaagtaacgggcaaggcaggggcttcgggtcctctccaacgaacatcctacttccctttaacgtttaaatctaaat

SEQ ID NO: 695 - DNA, 292 bp, Neisseria meningitidis
ctcaaagatagaggaaaaatgtaagccacgcagcctagagggaccagacagagatgcaatcaacaaaagaaaggggcggtggggttgtagcggggacccacgcaggataaaagcaaagtctgcagcgcaggagagtccagctgcggtaactcattgcaaaagacaatggggggtaactgcttgggcgacggaatccacaaagggacataaagtttcaggctctatggggaatatagtgggtggaggctccagacaagatgaacgaagcagaaacagctgaggccgaggggaa

SEQ ID NO: 696 - DNA, 167 bp, Neisseria meningitidis
ccgtccaactcgctcaatcaggctggcacacgtgatcgtctgcgtgctgcgctggaagcggccggtcatgcgcgacaattacaggttgagcatgggccggtgacggatagtcgcgcccgccgaatggccctggtaagaaaagccagccagttgctggccgaggacat

SEQ ID NO: 697 - DNA, 403 bp, Neisseria meningitidis
aaatcgaaataaaccgtgttgtaacgggagaccgatgccgtcattcgcgcgcaggcgggaatctagaccattggacaccggcaatattcaaagattatctgaaagtccgagattctrgattcccactttcgtgggaatgacgggatgtaggttcgtgggaatgacgcggtgcaggtttccgtgcggatggattcgtcattcccgcgcaggcgggaatctagaccttagaacaacagcaatattcaaaggttagctgaagctttagagattctggattcccactttcgtgggaatgacgggatttgagattgcggcatttatcggaaaaaacagcaaccgctccgccgtcattcccgcgcaggcgggaatccagaccttgggataacagtaatattcaaagatt

SEQ ID NO: 698 - DNA, 333 bp, Neisseria meningitidis
ccgagtccgtgccgtctgaagatgctttgggcaaatggtggaaaaccatagaggaatggcgttcccgagattgcttgtggtttgacaacggcagcgaaattatcaagccacaatatgtgattcagaagcttgccgagattaccggcaattcggcaatcatcacatcggatgtagggcagcatcaaatgtttgcggctcaatattatcccttcgaacgtccgcgccaatggctcaattccggcggtttgggtccgcaacacaggcgcctcttcaaactgcaggtcccgagccgcctgctgcatggctttttcgagtttggcgatttcgttaatc

SEQ ID NO: 699 - DNA, 303 bp, Neisseria meningitidis
ccgtggtgtgactgcgtaccttttgtataatgggtcaacgacttacattcagtagcgagcttaaccgaataggggaggcgtagggaaaccgagtcttaatagggcgatgagttgctgggtgtagacccgaaaccgagtgatctatccatggccaggttgaaggtgccgtaacaggtactggaggaccgaacccacgcatgttgcaaaatgcggggatgagcacgatgggcgtgggtctgccttatgcgattggtgcaaaacttgccgccccggatcaagacgtattctgtatcaccggcgacg

SEQ ID NO: 700 - DNA, 324 bp, Neisseria meningitidis
ccggtttcggttttttccgataaattcctgttgcgttgcgtttttggattcccgcttttgcgggaatgacggtcggtggggtttcggttttttccgataaagtcctgctgcgttgtgttgctggattcccgcctgcgcgggaatgacagccgccggacgggaaacgaccatacacaattattgacaaccccatttattgcgaaagtcagcctaggagaatcctctgtaaaaccggtctgagtcttcttttcccccgtactcaataatttatccgccgcctctttaccaccaaattcatttacaatttgtaaaaatcgtgtcgcc

SEQ ID NO: 701 - DNA, 182 bp, Neisseria meningitidis
cgtccgaccaaccgttcaaaactttcattttacccgaccacgcaagccgccgaacaaaaaacaaggggctgtcctagataactaggacaaacttgattttactaattgttttaaaacggaccaggacttttaatttaatggtggttaaaaggcatttggaattctttaaaatcaagttaaaa

SEQ ID NO: 702 - DNA, 326 bp, Neisseria meningitidis
cccgacaaatttttggcgcatggctttgatgcggccgcgcatttcatcgagttcggcaatccattgtgctttcaaatcatcatttttcaacatcgtcgcaatggtgttcgcaccgtgtgaagccgggttggaatacaaggtacggatgatggttttgacttggctgtgggcgcgggctgctgtttcttcatcttcggccaccaaagtgaacgcgccgacgcgctcgttgtacataccgaagtttttggaataagagctgtctatcagcaattctgtattgtgttttatgatcactcgcaagccgtttgcatcttcttccaaaccat

SEQ ID NO: 703 - DNA, 251 bp, Neisseria meningitidis
cggttacgggcgcgaattgtccgcattcgggctgtacgagttcgtcaacgtcaacacctactgggagaaatgacacaccccgtgccgcttcatacggtatcgggtttgcgctagagccgattaacggcagtatttgtttacggcgttattgtatttccgaatcaactcatccttgttttttgcatttgaatttcccaccgccttcaggttcatttttgaaatccggcagttttcttctttggtctgccgtt

SEQ ID NO: 704 - DNA, 522 bp, Neisseria meningitidis
ccgcaaatacaacccgattttcgactggtcggaacacgacgtgtgggcatacatcctcgccaacaatgtgccttacaacgatttgccacgtaaggatcccttaccgagaatgccgcaaaacacatcaatgactatctcgccaaacgcggcaaaggcttgggcgtacgcttgggtgtgaaaaccagcggctgctcggggatggcgtacaaccttgaatttgtcgacgaagccgatggcgacgacctgattttcgaaggacacggcgcgcgcatttatatcgatccgaaaagcctggtttatctggatggcacgcaagtcgattacaccaaagaaggtttgcaggaaggattcaaatttgaaaaccccaatgtcaaagactcctgcggctgcggcgaaagcttccacgtttaaggcataaaaacggcgggaccgtatcaaaaccgtcccgccatttttacgcttactgcctgttgtagctgcctttgcctttccttttccgttccaccttgtgccggaacaaat

(The sequence listing continues in the following parts.)

The invention claimed is:

1. An isolated and purified polynucleotide comprising the nucleotide of SEQ ID NO 35.

2. An isolated and purified polynucleotide comprising a nucleotide sequence having greater than 70% sequence identity to SEQ ID NO 35.

3. An isolated and purified polynucleotide which encodes a protein, wherein the polynucleotide comprises the nucleotide sequence of SEQ ID NO 35 or a complement thereof.

4. An isolated and purified polynucleotide which encodes a protein, wherein the polynucleotide comprises a nucleotide sequence having greater than 70% sequence identity to SEQ ID NO 35 or a complement thereof.

* * * * *

UNITED STATES PATENT AND TRADEMARK OFFICE
CERTIFICATE OF CORRECTION

PATENT NO. : 7,612,192 B2  Page 1 of 1
APPLICATION NO. : 10/915740
DATED : November 3, 2009
INVENTOR(S) : Fraser et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 381 days.

Signed and Sealed this

Nineteenth Day of October, 2010

David J. Kappos
*Director of the United States Patent and Trademark Office*